US012797487B2

(12) United States Patent
Aznarez et al.

(10) Patent No.: US 12,797,487 B2
(45) Date of Patent: Nov. 17, 2026

(54) ANTISENSE OLIGOMERS FOR TREATMENT OF NON-SENSE MEDIATED RNA DECAY BASED CONDITIONS AND DISEASES

(71) Applicant: STOKE THERAPEUTICS, INC., Bedford, MA (US)

(72) Inventors: Isabel Aznarez, Jamaica Plain, MA (US); Enxuan Jing, West Roxbury, MA (US); Jacob Kach, Boston, MA (US); Aditya Venkatesh, Natick, MA (US); Juergen Scharner, Arlington, MA (US); Baruch Ticho, Newton, MA (US); Gene Liau, Wayland, MA (US)

(73) Assignee: STOKE THERAPEUTICS, INC., Bedford, MA (US)

( * ) Notice: Subject to any disclaimer, the term of this patent is extended or adjusted under 35 U.S.C. 154(b) by 251 days.

(21) Appl. No.: 18/299,956

(22) Filed: Apr. 13, 2023

(65) Prior Publication Data

US 2024/0033378 A1 Feb. 1, 2024

Related U.S. Application Data

(62) Division of application No. 16/758,776, filed as application No. PCT/US2018/057165 on Oct. 23, 2018, now abandoned.

(Continued)

(51) Int. Cl.
*A61K 48/00* (2006.01)
*C12N 15/113* (2010.01)

(52) U.S. Cl.
CPC .......... *A61K 48/005* (2013.01); *C12N 15/113* (2013.01); *C12N 2310/11* (2013.01); *C12N 2310/315* (2013.01); *C12N 2310/321* (2013.01)

(58) Field of Classification Search
CPC ............ A61K 31/7088; C12N 2310/11; C12N 2310/315; C12N 2310/321; C12N 2310/3231; C12N 2320/33
See application file for complete search history.

(56) References Cited

U.S. PATENT DOCUMENTS 4,476,116 A 10/1984 Anik
4,522,811 A 6/1985 Eppstein et al.
(Continued)

FOREIGN PATENT DOCUMENTS

AU 2018355237 A1 5/2020
AU 2018322319 B2 8/2021
(Continued)

OTHER PUBLICATIONS

Aartsma-Rus et al.: Antisense-mediated exon skipping: a versatile tool with therapeutic and research applications. RNA 13(10):1609-24 (2007). Epub Aug. 7, 2007.
(Continued)

*Primary Examiner* — Terra C Gibbs
(74) *Attorney, Agent, or Firm* — Wilson Sonsini Goodrich & Rosati

(57) ABSTRACT

Alternative splicing events in genes can lead to non-productive mRNA transcripts which in turn can lead to aberrant protein expression, and therapeutic agents which can target the alternative splicing events in genes can modulate the expression level of functional proteins in patients and/or inhibit aberrant protein expression. Such therapeutic agents can be used to treat a condition or disease caused by protein deficiency.

22 Claims, 78 Drawing Sheets

Specification includes a Sequence Listing.

Related U.S. Application Data

(60) Provisional application No. 62/667,200, filed on May 4, 2018, provisional application No. 62/575,924, filed on Oct. 23, 2017.

(56) References Cited

U.S. PATENT DOCUMENTS

| | | | |
|---|---|---|---|
| 4,866,042 | A | 9/1989 | Neuwelt |
| 5,034,506 | A | 7/1991 | Summerton et al. |
| 5,142,047 | A | 8/1992 | Summerton et al. |
| 5,151,510 | A | 9/1992 | Stec et al. |
| 5,166,315 | A | 11/1992 | Summerton et al. |
| 5,185,444 | A | 2/1993 | Summerton et al. |
| 5,217,866 | A | 6/1993 | Summerton et al. |
| 5,506,337 | A | 4/1996 | Summerton et al. |
| 5,521,063 | A | 5/1996 | Summerton et al. |
| 5,656,612 | A | 8/1997 | Monia |
| 5,665,593 | A | 9/1997 | Kole et al. |
| 5,698,685 | A | 12/1997 | Summerton et al. |
| 5,914,396 | A | 6/1999 | Cook et al. |
| 5,916,808 | A | 6/1999 | Kole et al. |
| 5,976,879 | A | 11/1999 | Kole et al. |
| 6,083,482 | A | 7/2000 | Wang |
| 6,147,200 | A | 11/2000 | Manoharan et al. |
| 6,166,197 | A | 12/2000 | Cook et al. |
| 6,210,892 | B1 | 4/2001 | Bennett et al. |
| 6,294,520 | B1 | 9/2001 | Naito |
| 6,383,752 | B1 | 5/2002 | Agrawal et al. |
| 6,391,452 | B1 | 5/2002 | Antonsen et al. |
| 6,436,657 | B1 | 8/2002 | Famodu et al. |
| 6,451,991 | B1 | 9/2002 | Martin et al. |
| 6,485,960 | B1 | 11/2002 | Harris et al. |
| 6,531,591 | B1 | 3/2003 | Fensholdt |
| 6,573,073 | B2 | 6/2003 | Harris |
| 6,605,611 | B2 | 8/2003 | Simmonds et al. |
| 6,632,427 | B1 | 10/2003 | Finiels et al. |
| 6,639,059 | B1 | 10/2003 | Kochkine et al. |
| 6,670,461 | B1 | 12/2003 | Wengel et al. |
| 6,677,445 | B1 | 1/2004 | Innis et al. |
| 6,734,291 | B2 | 5/2004 | Kochkine et al. |
| 6,756,523 | B1 | 6/2004 | Kahn et al. |
| 6,770,748 | B2 | 8/2004 | Imanishi et al. |
| 6,794,499 | B2 | 9/2004 | Wengel et al. |
| 6,846,921 | B2 | 1/2005 | Innis et al. |
| 6,936,589 | B2 | 8/2005 | Naito |
| 6,963,589 | B1 | 11/2005 | Sugata et al. |
| 6,998,484 | B2 | 2/2006 | Koch et al. |
| 7,015,315 | B1 | 3/2006 | Cook et al. |
| 7,034,133 | B2 | 4/2006 | Wengel et al. |
| 7,053,199 | B2 | 5/2006 | Imanishi et al. |
| 7,053,207 | B2 | 5/2006 | Wengel |
| 7,060,809 | B2 | 6/2006 | Wengel et al. |
| 7,071,324 | B2 | 7/2006 | Preparata et al. |
| 7,084,125 | B2 | 8/2006 | Wengel |
| 7,101,993 | B1 | 9/2006 | Cook et al. |
| 7,169,594 | B2 | 1/2007 | Guan |
| 7,214,783 | B2 | 5/2007 | Jeon et al. |
| 7,217,805 | B2 | 5/2007 | Imanishi et al. |
| 7,314,923 | B2 | 1/2008 | Kaneko et al. |
| 7,335,765 | B2 | 2/2008 | Kaneko et al. |
| 7,368,549 | B2 | 5/2008 | Dempcy et al. |
| 7,399,845 | B2 | 7/2008 | Seth et al. |
| 7,432,249 | B2 | 10/2008 | Crooke |
| 7,432,250 | B2 | 10/2008 | Crooke |
| 7,547,684 | B2 | 6/2009 | Seth et al. |
| 7,553,644 | B2 | 6/2009 | Germino et al. |
| 7,569,575 | B2 | 8/2009 | Soerensen et al. |
| 7,569,686 | B1 | 8/2009 | Bhat et al. |
| 7,572,582 | B2 | 8/2009 | Wengel et al. |
| 7,595,304 | B2 | 9/2009 | Zhao et al. |
| 7,615,619 | B2 | 11/2009 | Imanishi et al. |
| 7,662,946 | B2 | 2/2010 | Ginsburg et al. |
| 7,662,948 | B2 | 2/2010 | Kurreck et al. |
| 7,666,854 | B2 | 2/2010 | Seth et al. |
| 7,687,617 | B2 | 3/2010 | Thrue et al. |
| 7,696,345 | B2 | 4/2010 | Allerson et al. |
| 7,741,457 | B2 | 6/2010 | Seth et al. |
| 7,750,131 | B2 | 7/2010 | Seth et al. |
| 7,816,333 | B2 | 10/2010 | Kaneko et al. |
| 7,846,686 | B2 | 12/2010 | Kramer |
| 7,951,934 | B2 | 5/2011 | Freier |
| 7,994,145 | B2 | 8/2011 | Imanishi et al. |
| 8,022,193 | B2 | 9/2011 | Seth et al. |
| 8,030,467 | B2 | 10/2011 | Seth et al. |
| 8,048,998 | B2 | 11/2011 | Rasmussen et al. |
| 8,067,569 | B2 | 11/2011 | Iversen et al. |
| 8,084,458 | B2 | 12/2011 | Soerensen et al. |
| 8,088,746 | B2 | 1/2012 | Seth et al. |
| 8,090,542 | B2 | 1/2012 | Khvorova et al. |
| 8,110,674 | B2 | 2/2012 | Manoharan et al. |
| 8,124,745 | B2 | 2/2012 | Allerson et al. |
| 8,129,515 | B2 | 3/2012 | Esau et al. |
| 8,168,605 | B2 | 5/2012 | Zhao et al. |
| 8,258,109 | B2 | 9/2012 | Bennett et al. |
| 8,268,980 | B2 | 9/2012 | Seth et al. |
| 8,278,036 | B2 | 10/2012 | Kariko et al. |
| 8,278,283 | B2 | 10/2012 | Seth et al. |
| 8,278,425 | B2 | 10/2012 | Prakash et al. |
| 8,278,426 | B2 | 10/2012 | Seth et al. |
| 8,293,684 | B2 | 10/2012 | Mouritzen et al. |
| 8,361,979 | B2 | 1/2013 | Aartsma-Rus et al. |
| 8,383,792 | B2 | 2/2013 | Okamoto et al. |
| 8,394,947 | B2 | 3/2013 | Bhat et al. |
| 8,415,465 | B2 | 4/2013 | Freier |
| 8,436,163 | B2 | 5/2013 | Iversen et al. |
| 8,450,467 | B2 | 5/2013 | Manoharan et al. |
| 8,461,124 | B2 | 6/2013 | Chattopadhyaya |
| 8,492,390 | B2 | 7/2013 | Detlef et al. |
| 8,501,703 | B2 | 8/2013 | Bennett et al. |
| 8,501,805 | B2 | 8/2013 | Seth et al. |
| 8,518,908 | B2 | 8/2013 | Hrdlicka et al. |
| 8,530,640 | B2 | 9/2013 | Seth et al. |
| 8,541,562 | B2 | 9/2013 | Obika et al. |
| 8,546,556 | B2 | 10/2013 | Seth et al. |
| 8,592,156 | B2 | 11/2013 | Liu et al. |
| 8,637,478 | B2 | 1/2014 | Bennett |
| RE44,779 | E | 2/2014 | Imanishi et al. |
| 8,653,252 | B2 | 2/2014 | Elmen et al. |
| 8,673,560 | B2 | 3/2014 | Leamon et al. |
| 8,680,254 | B2 | 3/2014 | Lutz et al. |
| 8,691,783 | B2 | 4/2014 | Thum et al. |
| 8,703,728 | B2 | 4/2014 | Swayze et al. |
| 8,710,021 | B2 | 4/2014 | Anro et al. |
| 8,735,366 | B2 | 5/2014 | Bauer et al. |
| 8,748,089 | B2 | 6/2014 | Kariko et al. |
| 8,779,118 | B2 | 7/2014 | Allerson et al. |
| 8,796,437 | B2 | 8/2014 | Swayze et al. |
| 8,809,516 | B2 | 8/2014 | Manoharan et al. |
| 8,846,386 | B2 | 9/2014 | Ambati et al. |
| 8,846,637 | B2 | 9/2014 | Seth et al. |
| 8,846,639 | B2 | 9/2014 | Swayze et al. |
| 8,846,885 | B2 | 9/2014 | Hirai et al. |
| 8,895,722 | B2 | 11/2014 | Iversen et al. |
| 8,957,040 | B2 | 2/2015 | Bennett et al. |
| 8,957,200 | B2 | 2/2015 | Seth et al. |
| 8,957,201 | B2 | 2/2015 | Kaneko et al. |
| 9,005,906 | B2 | 4/2015 | Swayze et al. |
| 9,006,194 | B2 | 4/2015 | Katsikis et al. |
| 9,006,415 | B2 | 4/2015 | Ren et al. |
| 9,012,139 | B2 | 4/2015 | Collard et al. |
| 9,029,335 | B2 | 5/2015 | Prakash et al. |
| 9,045,518 | B2 | 6/2015 | Christensen et al. |
| 9,045,754 | B2 | 6/2015 | Bhanot et al. |
| 9,057,066 | B2 | 6/2015 | Hung et al. |
| 9,109,001 | B2 | 8/2015 | Parsy et al. |
| 9,127,272 | B2 | 9/2015 | Esau et al. |
| 9,127,276 | B2 | 9/2015 | Prakash et al. |
| 9,156,873 | B2 | 10/2015 | Prakash et al. |
| 9,157,081 | B2 | 10/2015 | Bennett et al. |
| 9,181,549 | B2 | 11/2015 | Prakash et al. |
| 9,187,515 | B2 | 11/2015 | Mayes et al. |
| 9,192,621 | B2 | 11/2015 | Mayes et al. |
| 9,193,752 | B2 | 11/2015 | Migawa et al. |
| 9,193,969 | B2 | 11/2015 | Montefeltro et al. |

(56) References Cited

U.S. PATENT DOCUMENTS 9,211,300 B2 12/2015 Mayes et al.
9,217,147 B2 12/2015 Singh et al.
9,221,864 B2 12/2015 Seth et al.
9,243,245 B2 1/2016 De Kimpe et al.
9,290,534 B2 3/2016 Seth et al.
9,296,778 B2 3/2016 Parsy et al.
9,309,275 B2 4/2016 Stewart et al.
9,315,535 B2 4/2016 Mitsuoka et al.
9,334,495 B2 5/2016 Khvorova et al.
9,339,541 B2 5/2016 Dousson et al.
9,347,068 B2 5/2016 Dhugga et al.
9,359,445 B2 6/2016 Finkbeiner et al.
9,359,603 B2 6/2016 Lutz et al.
9,359,609 B2 6/2016 Duffield et al.
9,410,155 B2 8/2016 Collard et al.
9,428,534 B2 8/2016 Christensen et al.
9,447,166 B2 9/2016 Ambati et al.
9,453,261 B2 9/2016 Lee et al.
9,464,292 B2 10/2016 Okumura et al.
9,499,818 B2 11/2016 Van Deutekom
9,518,259 B2 12/2016 Rigo et al.
9,534,222 B2 1/2017 Ambati et al.
9,550,988 B2 1/2017 Swayze
9,714,422 B2 7/2017 Vorechovsky et al.
9,745,577 B2 8/2017 Vorechovsky et al.
9,771,579 B2 9/2017 Collard et al.
9,914,922 B2 3/2018 Freier et al.
9,976,143 B2 5/2018 Krainer et al.
10,119,168 B2 11/2018 Vaidya et al.
10,196,639 B2 2/2019 Vorechovsky et al.
10,517,853 B2 12/2019 Welch et al.
10,583,128 B2 3/2020 Collard et al.
10,683,503 B2 6/2020 Aznarez et al.
10,696,969 B2 6/2020 Krainer et al.
10,906,931 B2 2/2021 Moghadam
10,913,947 B2 2/2021 Aznarez et al.
10,941,405 B2 3/2021 Vorechovsky et al.
11,083,745 B2 8/2021 Aznarez et al.
11,096,956 B2 8/2021 Aznarez et al.
11,390,869 B2 7/2022 Vorechovsky et al.
11,702,660 B2 7/2023 Vorechovsky et al.
11,814,622 B2 11/2023 Aznarez et al.
11,873,490 B2 1/2024 Aznarez et al.
11,891,605 B2 2/2024 Vorechovsky et al.
12,338,437 B2 6/2025 Aznarez et al.
2003/0087861 A1 5/2003 Iversen
2003/0148974 A1 8/2003 Monia et al.
2004/0063129 A1 4/2004 Gaarde et al.
2004/0102401 A1 5/2004 Dean et al.
2004/0219515 A1 11/2004 Bentwich
2005/0221354 A1 10/2005 Mounts
2005/0233327 A1 10/2005 Welch et al.
2005/0244851 A1 11/2005 Blume et al.
2006/0058253 A1 3/2006 Chabot et al.
2006/0062790 A1 3/2006 Reinhard et al.
2006/0134670 A1 6/2006 Piu
2006/0166922 A1 7/2006 Eichler et al.
2007/0009899 A1 1/2007 Mounts
2007/0087376 A1 4/2007 Potashkin
2007/0249538 A1 10/2007 Sazani et al.
2008/0152650 A1 6/2008 Rosenberg et al.
2008/0269123 A1 10/2008 Li et al.
2009/0186846 A1 7/2009 Chabot et al.
2009/0186946 A1 7/2009 Taketomi et al.
2009/0264353 A1 10/2009 Orum et al.
2009/0270332 A1 10/2009 Bare et al.
2010/0016215 A1 1/2010 Moulton et al.
2010/0088778 A1 4/2010 Mulley et al.
2010/0111935 A1 5/2010 Bhagat et al.
2010/0150839 A1 6/2010 Kelleher
2010/0166784 A1 7/2010 Murphy et al.
2010/0190837 A1 7/2010 Migawa et al.
2011/0124591 A1 5/2011 Bennett
2011/0229891 A1 9/2011 Michaud et al.
2012/0157512 A1 6/2012 Ben-Chanoch et al.
2012/0190728 A1 7/2012 Bennett et al.
2012/0252877 A1 10/2012 Lo
2013/0072671 A1 3/2013 Van Deutekom
2013/0096183 A1 4/2013 Collard et al.
2013/0109850 A1 5/2013 Prakash et al.
2013/0136732 A1 5/2013 Wagner et al.
2013/0184223 A1 7/2013 Land et al.
2013/0253036 A1 9/2013 Collard et al.
2013/0266560 A1 10/2013 Demopulos et al.
2013/0289092 A1 10/2013 Rigo et al.
2014/0011761 A1 1/2014 Hotamisligil et al.
2014/0128449 A1 5/2014 Liu et al.
2014/0154783 A1 6/2014 Rossomando et al.
2014/0186839 A1 7/2014 Margulies et al.
2014/0194610 A1 7/2014 Verdine et al.
2014/0235605 A1 8/2014 Shiffman et al.
2014/0309181 A1 10/2014 Collard et al.
2014/0336238 A1 11/2014 Collin et al.
2014/0343127 A1 11/2014 Kammler
2014/0349290 A1 11/2014 Watnick et al.
2014/0378526 A1 12/2014 Rossi et al.
2014/0378527 A1 12/2014 Van Deutekom
2014/0378533 A1 12/2014 Freier
2015/0004217 A1 1/2015 Guild et al.
2015/0018540 A1 1/2015 Prakash et al.
2015/0184153 A1 7/2015 Freier et al.
2015/0211006 A1 7/2015 Butler et al.
2015/0211010 A1 7/2015 Kerem et al.
2015/0232845 A1 8/2015 Ozsolak
2015/0232858 A1 8/2015 Ozsolak
2015/0238516 A1 8/2015 Dowdy et al.
2015/0267192 A1 9/2015 Heartlein et al.
2015/0291957 A1 10/2015 Smith
2015/0329918 A1 11/2015 Kang et al.
2015/0337310 A1 11/2015 Walker et al.
2015/0361497 A1 12/2015 Rose
2016/0017322 A1 1/2016 Vorechovsky et al.
2016/0024500 A1 1/2016 Popplewell et al.
2016/0046935 A1 2/2016 Bentwich et al.
2016/0122767 A1 5/2016 Gouya et al.
2016/0201063 A1 7/2016 Ozsolak
2016/0201064 A1 7/2016 Ozsolak
2016/0208264 A1 7/2016 Wilton et al.
2016/0215291 A1 7/2016 Garcia et al.
2016/0244762 A1 8/2016 Vorechovsky et al.
2016/0244767 A1 8/2016 Hastings
2016/0298121 A1 10/2016 Krainer et al.
2017/0044540 A1 2/2017 Sætrom et al.
2017/0101641 A1 4/2017 Vorechovsky et al.
2017/0159049 A9 6/2017 Krainer et al.
2017/0240904 A1 8/2017 Tallent et al.
2018/0002694 A1 1/2018 Vorechovsky et al.
2018/0201937 A1 7/2018 Gomez et al.
2018/0296501 A1 10/2018 During
2018/0346907 A1 12/2018 Crooke et al.
2018/0362987 A1 12/2018 Krainer et al.
2018/0369275 A1 12/2018 Arnarez et al.
2019/0024118 A1 1/2019 Tagliatela et al.
2019/0024119 A1 1/2019 Tagliatela et al.
2019/0024120 A1 1/2019 Tagliatela et al.
2019/0024121 A1 1/2019 Tagliatela et al.
2019/0070213 A1 3/2019 Aznarez et al.
2019/0192691 A1 6/2019 Barrett et al.
2019/0218255 A1 7/2019 Chung et al.
2019/0225939 A1 7/2019 Chambers et al.
2019/0264211 A1 8/2019 Vorechovsky et al.
2020/0024603 A1 1/2020 Aznarez et al.
2020/0024606 A1 1/2020 Aznarez et al.
2020/0029142 A1 1/2020 Kim
2020/0085838 A1 3/2020 Martinez Botella et al.
2020/0101174 A1 4/2020 Coller et al.
2020/0231969 A1 7/2020 Vorechovsky
2020/0399640 A1 12/2020 Gottesman et al.
2021/0087238 A1 3/2021 Hoffmann et al.
2021/0108208 A1 4/2021 Krainer et al.
2021/0155936 A1 5/2021 Vorechovsky
2021/0261963 A1 8/2021 Uno et al.
2021/0268667 A1 9/2021 Aznarez et al.
2021/0309996 A1 10/2021 Aznarez et al.

(56) References Cited

U.S. PATENT DOCUMENTS

| | | | |
|---|---|---|---|
| 2021/0317462 | A1 | 10/2021 | Petrou |
| 2022/0088058 | A1 | 3/2022 | Aznarez et al. |
| 2022/0162605 | A1 | 5/2022 | Aznarez |
| 2022/0290142 | A1 | 9/2022 | Aznarez |
| 2023/0116704 | A1 | 4/2023 | Aznarez et al. |
| 2023/0183693 | A1 | 6/2023 | Vorechovsky et al. |
| 2023/0250429 | A1 | 8/2023 | Aznarez et al. |
| 2023/0287410 | A1 | 9/2023 | Aznarez et al. |
| 2023/0416756 | A1 | 12/2023 | Vorechovsky et al. |
| 2024/0102011 | A1 | 3/2024 | Aznarez et al. |
| 2024/0150760 | A1 | 5/2024 | Aznarez et al. |
| 2024/0254488 | A1 | 8/2024 | Aznarez et al. |
| 2024/0309377 | A1 | 9/2024 | Vorechovsky et al. |
| 2025/0059535 | A1 | 2/2025 | Aznarez et al. |
| 2025/0066781 | A1 | 2/2025 | Ticho et al. |
| 2025/0243493 | A1 | 7/2025 | Aznarez et al. |

FOREIGN PATENT DOCUMENTS

| | | | |
|---|---|---|---|
| AU | 2016334804 | B2 | 3/2022 |
| AU | 2022204606 | A1 | 7/2022 |
| CN | 102171342 | A | 8/2011 |
| CN | 103667438 | A | 3/2014 |
| CN | 107109411 | A | 8/2017 |
| CN | 109312343 | A | 2/2019 |
| CN | 111278991 | A | 6/2020 |
| CN | 111518898 | A | 8/2020 |
| EP | 0549615 | A1 | 7/1993 |
| EP | 1281758 | A2 | 2/2003 |
| EP | 1201678 | B1 | 9/2004 |
| EP | 1409497 | B1 | 1/2005 |
| EP | 1579015 | A2 | 9/2005 |
| EP | 1007714 | B1 | 12/2005 |
| EP | 1334109 | B1 | 5/2006 |
| EP | 1178999 | B1 | 3/2007 |
| EP | 1203827 | B1 | 5/2007 |
| EP | 1501848 | B1 | 8/2007 |
| EP | 1569661 | B1 | 9/2009 |
| EP | 1161439 | B1 | 4/2010 |
| EP | 1984381 | B1 | 9/2010 |
| EP | 2284269 | A2 | 2/2011 |
| EP | 1013661 | B1 | 1/2012 |
| EP | 2092065 | B1 | 1/2012 |
| EP | 2099461 | B1 | 3/2012 |
| EP | 2170917 | B1 | 6/2012 |
| EP | 2066684 | B1 | 7/2012 |
| EP | 2284269 | A3 | 8/2012 |
| EP | 2356129 | B1 | 4/2013 |
| EP | 2376516 | B1 | 4/2013 |
| EP | 2114981 | B1 | 5/2013 |
| EP | 2149605 | B1 | 7/2013 |
| EP | 2285819 | B1 | 10/2013 |
| EP | 2161038 | B1 | 12/2013 |
| EP | 1562971 | B1 | 2/2014 |
| EP | 2295441 | B1 | 5/2014 |
| EP | 2314594 | B1 | 7/2014 |
| EP | 2410053 | B1 | 10/2014 |
| EP | 2176280 | B2 | 6/2015 |
| EP | 2361921 | B1 | 6/2015 |
| EP | 2462153 | B1 | 7/2015 |
| EP | 1015469 | B2 | 11/2015 |
| EP | 2173760 | B2 | 11/2015 |
| EP | 1937312 | B1 | 6/2016 |
| EP | 2141233 | B1 | 10/2016 |
| EP | 2410054 | B1 | 1/2017 |
| EP | 3329909 | A1 | 6/2018 |
| EP | 3359685 | A1 | 8/2018 |
| EP | 2753317 | B1 | 2/2020 |
| EP | 3673080 | A1 | 7/2020 |
| EP | 3155124 | B1 | 11/2021 |
| EP | 4015648 | A1 | 6/2022 |
| EP | 4069256 | A1 | 10/2022 |
| GB | 1517937 | A | 7/1978 |
| GB | 2546719 | A | 8/2017 |
| JP | 2007534772 | A | 11/2007 |
| JP | 6923517 | B2 | 8/2021 |
| JP | 2021180669 | A | 11/2021 |
| KR | 20130026484 | A | 3/2013 |
| WO | WO-9402501 | A1 | 2/1994 |
| WO | WO-9426887 | A1 | 11/1994 |
| WO | WO-9747772 | A2 | 12/1997 |
| WO | WO-0010608 | A1 | 3/2000 |
| WO | WO-0107660 | A1 | 2/2001 |
| WO | WO-2005049651 | A2 | 6/2005 |
| WO | WO-2006107846 | A2 | 10/2006 |
| WO | WO-2007002390 | A2 | 1/2007 |
| WO | WO-2007048628 | A2 | 5/2007 |
| WO | WO-2007048629 | A2 | 5/2007 |
| WO | WO-2007056113 | A2 | 5/2007 |
| WO | WO-2007002390 | A3 | 11/2007 |
| WO | WO-2008036127 | A2 | 3/2008 |
| WO | WO-2009003694 | A2 | 1/2009 |
| WO | WO-2009064920 | A2 | 5/2009 |
| WO | WO-2009084472 | A1 | 7/2009 |
| WO | WO-2009099942 | A2 | 8/2009 |
| WO | WO-2010051632 | A1 | 5/2010 |
| WO | WO-2010148249 | A1 | 12/2010 |
| WO | WO-2011057350 | A1 | 5/2011 |
| WO | WO-2011163499 | A2 | 12/2011 |
| WO | WO-2012168435 | A1 | 12/2012 |
| WO | WO-2012178146 | A1 | 12/2012 |
| WO | WO-2013036105 | A1 | 3/2013 |
| WO | WO-2013081755 | A1 | 6/2013 |
| WO | WO-2013106770 | A1 | 7/2013 |
| WO | WO-2013119916 | A2 | 8/2013 |
| WO | WO-2014012081 | A2 | 1/2014 |
| WO | WO-201428459 | A1 | 2/2014 |
| WO | WO-2014028459 | A1 | 2/2014 |
| WO | WO-2014031575 | A1 | 2/2014 |
| WO | WO-2014049536 | A2 | 4/2014 |
| WO | WO-2014121287 | A2 | 8/2014 |
| WO | WO-2014172698 | A1 | 10/2014 |
| WO | WO-2014201413 | A1 | 12/2014 |
| WO | WO-2014209841 | A2 | 12/2014 |
| WO | WO-2015024876 | A2 | 2/2015 |
| WO | WO-2015035091 | A1 | 3/2015 |
| WO | WO-2015024876 | A3 | 7/2015 |
| WO | WO-2015190922 | A1 | 12/2015 |
| WO | WO-2015193651 | A1 | 12/2015 |
| WO | WO-2015198054 | A1 | 12/2015 |
| WO | WO-2016022914 | A1 | 2/2016 |
| WO | WO-2016027168 | A2 | 2/2016 |
| WO | WO-2015193651 | A4 | 3/2016 |
| WO | WO-2016054615 | A2 | 4/2016 |
| WO | WO-2016061509 | A1 | 4/2016 |
| WO | WO-2016054615 | A3 | 5/2016 |
| WO | WO-2016077837 | A1 | 5/2016 |
| WO | WO-2016081885 | A2 | 5/2016 |
| WO | WO-2016087842 | A1 | 6/2016 |
| WO | WO-2016118697 | A1 | 7/2016 |
| WO | WO-2016128343 | A1 | 8/2016 |
| WO | WO-2016138534 | A2 | 9/2016 |
| WO | WO-2016161429 | A1 | 10/2016 |
| WO | WO-2016196386 | A1 | 12/2016 |
| WO | WO-2017053982 | A1 | 3/2017 |
| WO | WO-2017060731 | A1 | 4/2017 |
| WO | WO-2017106210 | A1 | 6/2017 |
| WO | WO-2017106211 | A1 | 6/2017 |
| WO | WO-2017106283 | A1 | 6/2017 |
| WO | WO-2017106292 | A1 | 6/2017 |
| WO | WO-2017106364 | | 6/2017 |
| WO | WO-2017106364 | A2 | 6/2017 |
| WO | WO-2017106370 | A1 | 6/2017 |
| WO | WO-2017106375 | A1 | 6/2017 |
| WO | WO-2017106377 | A1 | 6/2017 |
| WO | WO-2017106382 | A1 | 6/2017 |
| WO | WO-2017106364 | A3 | 7/2017 |
| WO | WO-2018007980 | A1 | 1/2018 |
| WO | WO-2018098446 | A1 | 5/2018 |
| WO | WO-2018187363 | A1 | 10/2018 |
| WO | WO-2018191482 | A2 | 10/2018 |
| WO | WO-2018206924 | A1 | 11/2018 |
| WO | WO-2019040923 | A1 | 2/2019 |
| WO | WO-2019084050 | A1 | 5/2019 |

(56) References Cited

FOREIGN PATENT DOCUMENTS

| | | | |
|---|---|---|---|
| WO | WO-2019109051 | A1 | 6/2019 |
| WO | WO-2019191341 | A1 | 10/2019 |
| WO | WO-2019199867 | A1 | 10/2019 |
| WO | WO-2019224864 | A1 | 11/2019 |
| WO | WO-2019227096 | A1 | 11/2019 |
| WO | WO-2019236750 | A2 | 12/2019 |
| WO | WO-2019243430 | A1 | 12/2019 |
| WO | WO-2020041348 | A1 | 2/2020 |
| WO | WO-2020176776 | A1 | 9/2020 |
| WO | WO-2020237294 | A1 | 12/2020 |
| WO | WO-2021113541 | A1 | 6/2021 |
| WO | WO-2021119756 | A1 | 6/2021 |
| WO | WO-2021231107 | A1 | 11/2021 |
| WO | WO-2022067398 | A1 | 4/2022 |
| WO | WO-2023028575 | A2 | 3/2023 |
| WO | WO-2023086342 | A2 | 5/2023 |
| WO | WO-2023141681 | A1 | 8/2023 |
| WO | WO-2023178386 | A1 | 9/2023 |
| WO | WO-2024026122 | A2 | 2/2024 |
| WO | WO-2024173582 | A2 | 8/2024 |
| WO | WO-2024249949 | | 12/2024 |
| WO | WO-2025024568 | A1 | 1/2025 |

OTHER PUBLICATIONS

Aizer et al.: Lack of reduction in racial disparities in cancer-specific mortality over a 20-year period. Cancer 120:1532-9 (2014).
Altschul et al.: Basic local alignment search tool. J. Mol. Biol. 215(3)403-410 (1990).
Aly et al.: Extreme genetic risk for type 1A diabetes. Proc Natl Acad Sci U.S.A. 103(38):14074-9 (2006). Epub (2006).
Amarnath et al.: The PDL1-PD1 Axis Converts Human TH1 Cells into Regulatory T Cells. Science Translational Medicine 3(111):1-13 (2011).
Anders et al.: Detecting differential usage of exons from RNA-seq data. Genome Res. 22(10):2008-17 (2012). Epub Jun. 23, 2012. doi: gr.133744.111 [pii] 10.1101/gr.133744.111. PubMed PMID: 22722343.
Au et al.: Molecular Genetic Basis of Tuberous Sclerosis Complex: From Bench to Bedside. Journal of Child Neurology 19:9 (2004).
Audentes Therapeutics Announces Expansion of AAV Technology Platform and Pipeline with New Development Programs for Duchenne Muscular Dystrophy and Myotonic Dystrophy. PRNewswire Apr. 8, 2019 (7 pgs).
Aznarez et al.: TANGO—Targeted augmentation of nuclear gene output—for the treatment of genetic diseases [abstract]. In: 2018 Annual Meeting Abstract of the American Society of Gene and Cell Therapy, May 16-19, 2018, Chicago, IL (2018), Abstract No. 304.
Bakkenist et al.: DNA damage activates ATM through intermolecular autophosphorylation and dimer dissociation. Nature 421(6922):499-506 (2003). doi: 10.1038/nature01368. PubMed PMID: 12556884.
Balagurumoorthy et al.: Hairpin and parallel quartet structures for telomeric sequences. Nucleic Acids Res. 20(15):4061-7 (1992).
Balkwill et al.: Repression of translation of human estrogen receptor alpha by G-quadruplex formation. Biochemistry 48(48):11487-95 (2009). doi: 10.1021/bi901420k.
Barratt et al.: Remapping the insulin gene/IDDM2 locus in type 1 diabetes. Diabetes 53(7):1884-9 (2004).
Bassi et al.: A novel mutation in the ATP1A2 gene causes alternating hemiplegia of childhood. J. Med. Genet. 41:621-628 (2004).
Battistini et al.: A new CACNA1A gene mutation in acetazolamide-responsive familial hemiplegic migraine and ataxia. Neurology 53(1):38-43 (1999).
Baughan et al.: Delivery of bifunctional RNAs that target an intronic repressor and increase SMN levels in an animal model of spinal muscular atrophy. Hum Mol Genet. 18(9):1600-11 (2009). doi: 10.1093/hmg/ddp076. Epub Feb. 19, 2009.
Bauman et al.: Therapeutic potential of splice-switching oligonucleotides. Oligonucleotides 19.1:1-13 (2009).
Beaudoin et al.: 5'-UTR G-quadruplex structures acting as translational repressors. Nucleic Acids Res. 38(20):7022-36 (2010). doi: 10.1093/nar/gkq557. Epub Jun. 22, 2010.
Beli et al.: Proteomic investigations reveal a role for RNA processing factor THRAP3 in the DNA damage response. Mol Cell. 46(2):212-25 (2012). doi: 10.1016/j.molcel.2012.01.026. PubMed PMID: 22424773; PubMed Central Pmcid: PMC3565437.
Berge, SM et al., Pharmaceutical Salts Journal of Pharmaceutical Sciences, vol. 66, No. 1, pp. 1-19 (1977).
Berger et al.: The molecular basis of human retinal and vitreoretinal diseases. Progress in Retinal and Eye Research 29:335-375 (2010).
Bethke et al.: Comprehensive analysis of the role of DNA repair gene polymorphisms on risk of glioma. Hum Mol Genet. 17(6):800-5 (2008). Epub 2007/12/01.doi: ddm351 [pii] 10.1093/hmg/ddm351. PubMed PMID: 18048407.
Bicknell et al.: Introns in UTRs: why we should stop ignoring them. Bioessays 34(12):1025-34 (2012). doi: 10.1002/bies.201200073. Epub Oct. 26, 2012.
Blencowe, Benjamin: Reflections for the 20th anniversary issue of RNA journal. RNA Journal 21(4):573-575 (2015).
Blencowe BJ: Splicing regulation: the cell cycle connection. Curr. Biol. 13(4):R149-51 (2003). PubMed PMID: 12593819.
Bolognini et al.: Characterization of two novel intronic OPA1 mutations resulting in aberrant pre-mRNA splicing. BMC Medical Genetics 18:22 (2017).
Bonifert et al.: Antisense Oligonucleotide Mediated Splice Correction of a Deep Intronic Mutation in OPA1. Molecular Therapy-Nucleic Acids, vol. 5 (2016).
Bonifert et al.: Pure and syndromic optic atrophy explained by deep intronic OPA1 mutations and an intralocus modifier. Brain 137(8):2164-2177 (2014).
Bonnen et al.: Haplotypes at ATM identify coding-sequence variation and indicate a region of extensive linkage disequilibrium. Am J Hum Genet. 67(6):1437-51 (2000). Epub Nov. 15, 2000.doi: S0002-9297(07)63213-3 [pii] 10.1086/316908. PubMed PMID: 11078475.
Boothby et al.: Removal of Retained Introns Regulates Translation in the Rapidly Developing Gametophyte of Marsilea vestita. Developmental Cell 24:517-529 (2013).
Booy et al.: The RNA helicase RHAU (DHX36) unwinds a G4-quadruplex in human telomerase RNA and promotes the formation of the P1 helix template boundary. Nucleic Acids Res. (9):4110-24 (2012). doi: 10.1093/nar/gkr1306. Epub Jan. 11, 2012.
Boutz et al.: Detained introns are a novel, widespread class of post-transcriptionally spliced introns. Genes Dev. 29(1):63-80 (2015). doi: 10.1101/gad.247361.114.
Braunschweig et al.: Widespread intron retention in mammals functionally tunes transcriptomes. Widespread intron retention in mammals functionally tunes transcriptomes. Genome Res. 24(11):1774-86 (2014). doi: 10.1101/gr.177790.114. Epub Sep. 25, 2014.
Bravo-Gil et al.: Improving the management of Inherited Retinal Dystrophies by targeted sequencing of a population-specific gene panel. Scientific Reports 6:23910, 10 pages (2015).
Brooks et al.: A pan-cancer analysis of transcriptome changes associated with somatic mutations in U2AF1 reveals commonly altered splicing events. PLoS One. 9(1):e87361 (2014). Epub Feb. 6, 2014.doi: 10.1371/journal.pone.0087361 PONE-D-13-26905 [pii]. PubMed PMID: 24498085.
Buchman et al.: Comparison of intron-dependent and intron-independent gene expression. Mol Cell Biol. 8(10):4395-405 (1988).
Buckley et al.: Cytoplasmic intron retention, function, splicing, and the sentinel RNA hypothesis.WIREs RNA 5:223-2330 (2014).
Bugaut et al.: 5'-UTR RNA G-quadruplexes: translation regulation and targeting. Nucleic Acids Res. 40(11):4727-41 (2012). doi: 10.1093/nar/gks068. Epub Feb. 20, 2012.
Bugaut et al.: An RNA hairpin to G-quadruplex conformational transition. J Am Chem Soc. 134(49):19953-6 (2012). doi: 10.1021/ja308665g. Epub Nov. 29, 2012.
Buratti et al.: DBASS3 and DBASS5: databases of aberrant 3'- and 5'-splice sites. Nucleic Acids Res. 39(Database issue):D86-91 (2011). doi: 10.1093/nar/gkq887. Epub Oct. 6, 2010.

(56) References Cited

OTHER PUBLICATIONS

Buratti et al.: RNA folding affects the recruitment of SR proteins by mouse and human polypurinic enhancer elements in the fibronectin EDA exon. Mol Cell Biol. 24(3):1387-400 (2004).
Burnette et al.: Subdivision of large introns in *Drosophila* by recursive splicing at non-exonic elements. Genetics (2005).
Burns et al.: Connections between pre-mRNA processing and regulation of the eukaryotic cell cycle. Front Horm Res. 25:59-82 (1999).
Buschmann et al.: Chitosans for delivery of nucleic acids. Advanced drug delivery reviews 65.9:1234-1270 (2013).
Busslinger et al.: β+ Thalassemia: Aberrant splicing results from a single point mutation in an intron. Cell 27.2:289-298 (1981).
Callis et al.: Introns increase gene expression in cultured maize cells. Genes Dev. 1(10):1183-200 (1987).
Catterall et al.: Nav1.1 channels and epilepsy. J Physiol. 1;588(Pt 11):1849-59 (2010).
Cavaloc et al.: The splicing factors 9G8 and SRp20 transactivate splicing through different and specific enhancers. RNA 5(3):468-83 (1999).
Cazzola et al.: Translational pathophysiology: a novel molecular mechanism of human disease. Blood 95(11):3280-8 (2000).
Chambers et al.: The INO80 chromatin remodeling complex prevents polyploidy and maintains normal chromatin structure at centromeres. Genes Dev. 26(23):2590-603 (2012). Epub Dec. 5, 2012.doi: 26/23/2590 [pii] 10.1101/gad.199976.112. PubMed PMID: 23207916.
Chen et al.: A functional single nucleotide polymorphism in promoter of ATM is associated with longevity. Mech Ageing Dev. 131:636-40 (2010).
Chen et al.: Chk1 kinase negatively regulates mitotic function of Cdc25A phosphatase through 14-3-3 binding. Mol Cell Biol. 23(21):7488-97 (2003). PubMed PMID: 14559997; PubMed Central PMCID: PMC207598.
"Schimpf, S. et al., "Activation of cryptic splice sites is a frequent splicing defect mechanism caused by mutations in exon and intron sequences of the OPA1 gene," Human Genetics, 2006, vol. 118, No. 6, pp. 767-771".
Choi et al.: CHK2 kinase promotes pre-mRNA splicing via phosphorylating CDK11p110. Oncogene 33:108-15 (2014).
Colla et al.: Telomere dysfunction drives aberrant hematopoietic differentiation and myelodysplastic syndrome. Cancer Cell. 27(5):644-57 (2015). doi: 10.1016/j.ccell.2015.04.007. PubMed PMID: 25965571.
Collie et al.: The application of DNA and RNA G-quadruplexes to therapeutic medicines. Chem Soc Rev. 40(12):5867-92 (2011). doi: 10.1039/c1cs15067g. Epub Jul. 25, 2011.
Consortium. TGP. An integrated map of genetic variation from 1,092 human genomes. Nature (London). 491:56-65 (2012).
Corallini et al.: Transcriptional and Posttranscriptional Regulation of the CTNS Gene. Pediatric Research 70(2):130-135 (2011).
Corey et al.: A non-classical translocation involving 17q12 (retinoic acid receptor alpha) in acute promyelocytic leukemia (APML) with atypical features. Leukemia 8(8):1350-3 (1994). PubMed PMID: 8057672.
Cornille et al.: Reversible optic neuropathy with OPA1 exon 5b mutation. Annals of Neurology 63(5):667-671 (2008).
Corvelo et al.: Genome-wide association between branch point properties and alternative splicing. PLoS Comput Biol. 6(11):e1001016 (2010). Epub Dec. 3, 2010.doi: 10.1371/journal.pcbi.1001016. PubMed PMID: 21124863.
Coulombe-Huntington et al.: Fine-Scale Variation and Genetic Determinants of Alternative Splicing across Individuals. PLoS Genet. 5(12):e1000766 (2009). Epub Dec. 17, 2009.doi: 10.1371/journal.pgen.1000766. PubMed PMID: 20011102.
Coutinho et al.: Functional significance of a deep intronic mutation in the ATM gene and evidence for an alternative exon 28a. Hum Mutat. 25(2):118-24 (2005). Epub Jan. 12, 2005.doi: 10.1002/humu.20170. PubMed PMID: 15643608.
Creacy, et al. G4 resolvase 1 binds both DNA and RNA tetramolecular quadruplex with high affinity and is the major source of tetramolecular quadruplex G4-DNA and G4-RNA resolving activity in HeLa cell lysates. J Biol Chem. 283(50):34626-34 (2008). doi: 10.1074/jbc.M806277200. Epub Oct. 7, 2008.
Culler et al.: Functional selection and systematic analysis of intronic splicing elements identify active sequence motifs and associated splicing factors. Nucleic Acids Res. 38(15):5152-65 (2010). doi: 10.1093/nar/gkq248. Epub Apr. 12, 2010.
Database Geneseq [Online], Nov. 13, 2008 (Nov. 13, 2008), Dual label detection probe, QF probe 1, 5. 3.11, XP055572852, retrieved from EBI Accession No. GSN:ARK21623.
Davies et al.: A genome-wide search for human type 1 diabetes susceptibility genes. Nature 8;371(6493):130-6 (1994).
Decorsiere et al.: Essential role for the interaction between hnRNP H/F and a G quadruplex in maintaining p53 pre-mRNA 3'-end processing and function during DNA damage. Genes Dev. 25(3):220-5 (2011). doi: 10.1101/gad.607011.
Dedic et al.: Alagille Syndrome Mimicking Biliary Atresia in Early Infancy, PLOS Oone, 10(11):e0143939: pp. 1-7 (2015).
Deere et al.: AntisensePhosphorodiamidate Morpholino OligomerLengthand TargetPosition Effects on Gene-SpecificInhibitionin *Escherichia coli*. Antimicrobial Agents Andchemotherapy 49(1):249-255 (2005).
Del Dotto et al.: OPA1 Isoforms in the Hierarchical Organization of Mitochondrial Functions. Cell Reports 19(12):2557-2571 (2017).
Derecka et al.: Occurrence of a quadruplex motif in a unique insert within exon C of the bovine estrogen receptor alpha gene (ESR1). Biochemistry 49(35):7625-33 (2010). doi: 10.1021/bi100804f.
Dias et al.: Antisense oligonucleotides: basic concepts and mechanisms Mol. Cancer Ther. 1:347-355 ( 2002).
Didiot et al.: The G-quartet containing FMRP binding site in FMR1 mRNA is a potent exonic splicing enhancer. Nucleic Acids Res. Sep. 2008;36(15):4902-12. doi: 10.1093/nar/gkn472. Epub Jul. 24, 2008.
Ding, H. et al.: DeliveringPD-1 inhibitory signal concomitant with blocking ICOS co-stimulation suppresses lupus-like syndrome in autoimmune BXSB mice.Clinical Immunology, vol. 118, pp. 258-267, (2006).
Divina, P et al.: Ab initio prediction of cryptic splice-site activation and exon skipping. Eur J Hum Genet. 2009; 17:759-65.
Dominski, et al.: Restoration of correct splicing in thalassemic pre-mRNA by antisense oligonucleotides. Proc Natl Acad Sci U S A. Sep. 15, 1993;90(18):8673-7.
Dredge, et al.: NeuN/Rbfox3 Nuclear and Cytoplasmic Isoforms Differentially Regulate Alternative Splicing and Nonsense-Mediated Decay of Rbfox2. PLoS One. 2011; 6(6): e21585.
Du, et al.: Correction of prototypic ATM splicing mutations and aberrant ATM function with antisense morpholino oligonucleotides. Proc. Natl. Acad. Sci. U S A. Apr. 3, 2007;104(14):6007-12. Epub Mar. 26, 2007.
Ducros et al.: Recurrence of the T666M calcium channel CACNA1A gene mutation in familial hemiplegic migraine with progressive cerebellar ataxia. Am J Hum Genet. vol. 64, No. 1, pp. 89-98 (Jan. 1999).
Duryagina et al.: Overexpression of Jagged-1 and its intracellular domain in human mesenchymal stromal cells differentially affect the interaction with hematopoietic stem and progenitor cells.Stem Cells Dev. vol. 22, No. 20, pp. 2736-2750 (2013).
Dutertre et al.: DNA damage: RNA-binding proteins protect from near and far. Trends Biochem Sci. 2014; 39(3):141-9. Epub Feb. 19, 2014.doi: S0968-0004(14)00015-2 [pii] 10.1016/j.tibs.2014.01.003. PubMed PMID: 24534650.
Eddy et al.: G4 motifs correlate with promoter-proximal transcriptional pausing in human genes. Nucleic Acids Res. Jul. 2011;39(12):4975-83. doi: 10.1093/nar/gkr079. Epub Mar. 3, 2011.
El Bougrini et al.: PML positively regulates interferon gamma signaling. Biochimie. 2011; 93(3):389-98. doi: 10.1016/j.biochi.2010.11.005. PubMed PMID: 21115099.
Emerick et al.: Multivariate analysis and visualization of splicing correlations in single-gene transcriptomes. BMC Bioinformatics. Jan. 18, 2007;8:16.
EP 15846242.4 Partial Supplementary Search Report and Search Opinion dated May 2, 2018.
EP 16876621.0 Extended European Search Report and Search Opinion dated Mar. 7, 2019.

(56) References Cited

OTHER PUBLICATIONS

EP15729929.8 Office Action dated Dec. 22, 2017.
EP15729929.8 Office Action dated Oct. 30, 2018.
EP15846242.4 Extended European Search Report dated Aug. 21, 2018.
EP16781187.6 Office Action dated May 20, 2019.
EP16876499.1 Extended Search Report dated Jun. 14, 2019.
EP168766061.1 Extended Search Report dated May 24, 2019.
Fairbrother, W.G., et al. Predictive identification of exonic splicing enhancers in human genes. Science. 2002; 297(5583):1007-13. PubMed PMID: 12114529.
Fededa, et al. A polar mechanism coordinates different regions of alternative splicing within a single gene. Mol Cell. Aug. 5, 2005;19(3):393-404.
Ferreira, P.G., et al.: Transcriptome characterization by RNA sequencing identifies a major molecular and clinical subdivision in chronic lymphocytic leukemia. Genome Res. 2014; 24:212-26.
Fletcher, Sue et al. Antisense suppression of donor splice site mutations in the dystrophin gene transcript.Molecular Genetics & Genomic Medicine, vol. 1, No. 3, pp. 162-173, Jun. 13, 2013.
Fred et al.: The human insulin mRNA is partly translated via a cap- and elF4A-independent mechanism. Biochem Biophys Res Commun. Sep. 9, 2011;412(4):693-8. doi: 10.1016/j.bbrc.2011.08.030. Epub Aug. 16, 2011.
Friedman, KJ et al. Correction of aberrant splicing of the cystic fibrosis transmembrane conductance regulator (CFTR) gene by antisense oligonucleotides. J Biol Chem. Dec. 17, 1999;274(51):36193-36199.
Friend, KL et al. Detection of a novel missense mutation and second recurrent mutation in the CACNA1A gene in individuals with EA-2 and FHM. Hum Genet. vol. 105(3):261-5 (Sep. 1999).
Furukawa & Kish 2008, GeneReviews Pagon Ra et al. eds. Univ. of WA Seattle, NCBI Bookshelf ID NBK1437.
Galante, et al.: Detection and evaluation of intron retention events in the human transcriptome. RNA. May 2004;10(5):757-65.
"Gallus, G. N. et al., "Alu-element insertion in an OPA1 intron sequence associated with autosomal dominant optic atrophy," Molecular vision, 2010, vol. 16, pp. 178-183".
Garner, et al. Selectivity of small molecule ligands for parallel and anti-parallel DNA G-quadruplex structures. Org Biomol Chem. Oct. 21, 2009;7(20):4194-200. doi: 10.1039/b910505k. Epub Aug. 14, 2009.
Geary et al.: Absolute Bioavailability of 29-O-(2-Methoxyethyl)-Modified Antisense Oligonucleotides following Intraduodenal Instillation in Rats. J Pharmacal Exp Ther. vol. 296, No. 3, pp. 898-904 (Mar. 2001).
Geary, RS, et al., Pharmacokinetic properties of 2'-O-(2-methoxyethyl)-modified oligonucleotide analogs in ratsJ Pharmacal Exp Ther. vol. 296, No. 3, pp. 890-897 (Mar. 2001).
Gianchecchi et al. Recent insights into the role of the PD-1/PD-L1 pathway in immunological tolerance and autoimmunity. Autoimmunity Reviews 12:1091-1100 (2013).
Gibson, G.: Hints of hidden heritability in GWAS. Nat Genet. 2010; 42(7):558-60. Epub Jun. 29, 2010.doi: ng0710-558 [pii] 10.1038/ng0710-558. PubMed PMID: 20581876.
Gohring, J. et al. Imaging of Endogenous MessengerRNA Splice Variants in Living Cells Reveals Nuclear Retention of Transcripts Inaccessible to Nonsense-Mediated Decay in *Arabidopsis*. The Plant Cell. vol. 26, pp. 754-764.(Feb. 2014).
Gomes et al. Translating chitosan to clinical delivery of nucleic acid-based drugs. MRS bulletin 39.1 (2014): 60-70.
Gomez, et al. Telomerase downregulation induced by the G-quadruplex ligand 12459 in A549 cells is mediated by hTERT RNA alternative splicing. Nucleic Acids Res. Jan. 16, 2004;32(1):371-9. Print 2004.
Goncharova et al. Tuberin regulates p70 S6 kinase activation and ribosomal protein S6 phosphorylation. A role for the TSC2 tumor suppressor gene in pulmonary lymphangioleiomyomatosis (Lam). J. Biol. Chem. (Aug. 23, 2002) 277(34);30958-67. EPub Jun. 3, 2002.
Gonzalez-Santos, et al., Mutation in the splicing factor Hprp3p linked to retinitis pigmentosa impairs interactions within the U4/U6 snRNP pigmentosa impairs interactions within the U4/U6 snRNP complex, PubMed Central Canada , Author Manuscript, 29 pages.
Goyenvalie et al.: Therapeutic approaches to muscular dystrophy. Hum Mol Genet. Apr. 15, 2011;20(R1):R69-78. doi: 10.1093/hmg/ddr105. Epub Mar. 24, 2011.
Gozani, O., et al.: A potential role for U2AF-SAP 155 interactions in recruiting U2 snRNP to the branch site. Mol Cell Biol. 1998; 18(8):4752-60. PubMed PMID: 9671485.
Graveley, B.R. The haplo-spliceo-transcriptome: common variations in alternative splicing in the human population. Trends Genet. 2008; 24(1):5-7. Epub Dec. 7, 2007.doi: S0168-9525(07)00349-6 [pii] 10.1016/j.tig.2007.10.004. PubMed PMID: 18054116.
Gutell, R.R., et al. A story: unpaired adenosine bases in ribosomal RNAs. J Mol Biol. 2000; 304(3):335-54. Epub Nov. 25, 2000.doi: 10.1006/jmbi.2000.4172 S0022-2836(00)94172-X [pii]. PubMed PMID: 11090278.
Guth, S., et al. Dual function for U2AF(35) in AG-dependent pre-mRNA splicing. Mol Cell Biol. 2001;21(22):7673-81. PubMed PMID: 11604503.
Guy et al.: A mouse Mecp2-null mutation causes neurological symptoms that mimic Rett syndrome. Nat Genet 27:322-326 (2001).
Hai, et al.: A G-tract element in apoptotic agents-induced alternative splicing. Nucleic Acids Res. Jun. 2008;36(10):3320-31. doi: 10.1093/nar/gkn207. Epub (2008).
Hamdan et al.: Mutations in SYNGAP1 in Autosomal Nonsyndromic Mental Retardation. The New England Journal of Medicine. N. Engl. Med. 360(6):599 (2009).
Hamdan et al.: De Novo SYNGAP1 Mutations in Nonsyndromic Intellectual Disability and Autism, Biol. Psychiatry, 69:898-901 (2011).
Han et al.: TANGO-Targeted augmentation of nuclear gene output for the treatment of genetic diseases. Poster session presented at the American Society of Gene and Cell Therapy, Chicago, IL. (May 2018).
Hargous et al.: Molecular basis of RNA recognition and TAP binding by the SR proteins SRp20 and 9G8. EMBO J. Nov. 1, 2006;25(21):5126-37. Epub (2006).
Harkin, et al.: The spectrum of SCN1A-related infantile epileptic encephalopathies. Brain 130(Pt 3):843-52 (2007).
Hastings et al.: Control of pre-mRNA splicing by the general splicing factors PUF60 and U2AF. PLoS One 2:e538. PubMed PMID: 17579712 (2007).
He et al.: Association of the insulin-like growth factor binding protein 3 (IGFBP-3) polymorphism with longevity in Chinese nonagenarians and centenarians. Aging (Milano). 2014;6:944-56.
Hegele et al.: Dynamic protein-protein interaction wiring of the human spliceosome. Mol Cell. 45(4):567-80 (2012). doi: 10.1016/j.molcel.2011.12.034.
Hernan et al.: Cellular Expression and siRNA-Mediated Interference of Rhodopsin cis-Acting Splicing Mutants Associated with Autosomal Dominant Retinitis Pigmentosa, Invest Ophthalmol. Vis. Sci. 52:3723-3729 (2011).
Heyn et al.: Introns and gene expression: Cellular constraints, transcriptional regulation, and evolutionary consequences. Bioessays 37:148-154 (2014).
Hiller et al.: Pre-mRNA secondary structures influence exon recognition. PLoS genetics 3.11:e204 (2007).
Hirata et al.: Prevention of Experimental Autoimmune Encephalomyelitis by Transfer of Embryonic Stem Cell-Derived Dendritic Cells Expressing Myelin Oligodendrocyte Glycoprotein Peptide along with TRAIL or Programmed Death-1 Ligand. J. Immunology 174:1888-1897 (2005).
Hishida et al.: Polymorphisms in PPAR Genes (PPARD, PPARG, and PPARGC1A) and the Risk of Chronic Kidney Disease in Japanese: Cross-Sectional Data from the J-MICC Study. PPAR 2013; 980471 pp. 1-8.
*Homo sapiens* pre-mRNA processing factor 3 (PRPF3), mRNA, NCBI Reference Sequence: NM_004698.2 Accessed (2017).
Hua et al.: Antisense correction of SMN2 splicing in the CNS rescues necrosis in a type III SMA mouse model. Genes Dev. Aug. 1, 2010;24(15):1634-44. doi: 10.1101/gad.1941310. Epub (2010).

(56) References Cited

OTHER PUBLICATIONS

Hua et al.: Antisense masking of an hnRNP A1/A2 intronic splicing silencer corrects SMN2 splicing in transgenic mice. Am. J. Hum. Genet. 82:834-848 (2008).
Hua et al.: Enhancement of SMN2 exon 7 inclusion by antisense oligonucleotides targeting the exon. PLoS Biol. 2007;5(4):e73. Epub Mar. 16, 2007.doi: 06-PLBI-RA-1492R3 [pii] 10.1371/journal.pbio.0050073. PubMed PMID: 17355180.
Hunt et al.: Negligible impact of rare autoimmune-locus coding-region variants on missing heritability. Nature. Jun. 13, 2013;498(7453):232-5. doi: 10.1038/nature12170. Epub May 22, 2013.
Huynh et al.: BCoR, a novel corepressor involved in BCL-6 repression. Genes Dev. 14(14):1810-23 (2000). PubMed PMID: 10898795; PubMed Central PMCID: PMC316791.
International Application No. PCT/GB2015/051756 International Preliminary Report on Patentability, Dec. 26, 2016.
International Application No. PCT/GB2015/051756 International Search Report and Written Opinion Mailed Nov. 30, 2015.
International Application No. PCT/GB2016/053136 International Search Report and Written Opinion Mailed Mar. 6, 2017.
International Application No. PCT/GB2016/053136 Partial International Search Report Mailed Jan. 19, 2017.
International Application No. PCT/US16/66576 International Search Report and Written Opinion Mailed May 4, 2017.
International Application No. PCT/US16/66691 International Search Report and Written Opinion Mailed May 10, 2017.
International Application No. PCT/US16/66708 International Search Report and Written Opinion Mailed May 8, 2017.
International Application No. PCT/US16/66721 International Search Report and Written Opinion mailed May 1, 2017.
International Application No. PCT/US2015/053896 International Preliminary Report on Patentability Mailed Apr. 4, 2017.
International Application No. PCT/US2015/53896 International Search Report and Written Opinion dated Mar. 3, 2016.
International Application No. PCT/US2016/066414 International Search Report and Written Opinion Mailed Apr. 19, 2017.
International Application No. PCT/US2016/066417 International Search Report and Written Opinion Mailed Apr. 19, 2017.
International Application No. PCT/US2016/066564 International Search Report and Written Opinion Mailed May 4, 2017.
International Application No. PCT/US2016/066705 International Search Report and Written Opinion Mailed Apr. 24, 2017.
International Application No. PCT/US2018/048031 International Search Report and Written Opinion Mailed Jan. 22, 2019.
International search report and written opinion dated Jun. 5, 2017 for PCT Application No. PCT/US2016/066684.
International Search Report and Written Opinion dated Mar. 28, 2019 for PCT/US2018/057165.
Itoh et al.: Methyl CpG-binding Protein Isoform MeCP2_e2 Is Dispensable for Rett Syndrome Phenotypes but Essential for Embryo Viability and Placenta Development. J Biol Chem 287:13859-13867 (2012).
Iwamoto et al.: Transcription-dependent nucleolar cap localization and possible nuclear function of DExH RNA helicase RHAU. Exp Cell Res. 314(6):1378-91 (2008). doi: 10.1016/j.yexcr.2008.01.006. Epub Jan. 16, 2008.
Jacob et al.: Intron retention as a component of regulated gene expression programs. Hum Genet 136:1043-1057 (2017).
Jarver et al.: A Chemical View of Oligonucleotides for Exon Skipping and Related Drug Applications, Nucleic Acid Therapeutics 24(1):37-47 (2014).
Jearawiriyapaisarn et al.: Sustained Dystrophin Expression Induced by Peptide-conjugated Morpholino Oligomers in the Muscles of mdx Mice. Mol Ther. 16(9):1624-1629 (2008).
Jurka et al.: Identification of new medium reiteration frequency repeats in the genomes of Primates, Rodentia and Lagomorpha. Genetica98 3:235-247 (1996).
Jurkiewicz et al.: Spectrum of JAG1 gene mutations in Polish patients with Alagille syndrome J. Appl. Genetics 55: 329-336 (2014).
Kach et al.: A novel antisense oligonucleotide approach to treat eye diseases by increasing target gene expression. No. 3423-A0194 ARVO Poster Apr. 19, 2019 (1 pg.).
"Kamakari, S. et al., "First report of OPA1 screening in Greek patients with autosomal dominant optic atrophy and identification of a previously undescribed OPA1 mutation," Molecular Vision, 2014, vol. 20, pp. 691-703".
Kaminker, P.G., et al. A novel form of the telomere-associated protein TIN2 localizes to the nuclear matrix. Cell Cycle. 2009;8(6):931-9. PubMed PMID: 19229133; PubMed Central PMCID: PMC2751576.
Kang et al.: Up-regulation of luciferase gene expression with antisense oligonucleotides: implications and applications in functional assay development. Biochemistry 37.18 (1998): 6235-6239.
Kaplan et al.: Medium reiteration frequency repetitive sequences in the human genome. Nucleic acids research 19.17 (1991): 4731-4738.
Katsani, K.R. et al.: Functional Genomics Evidence Unearths New Moonlighting Roles of Outer Ring Coat Nucleoporins Scientific Reports vol. 4, No. 4655 (Apr. 11, 2014).
Kawamata, N., et al. Genetic differences between Asian and Caucasian chronic lymphocytic leukemia. Int J Oncol. 2013;43(2):561-5. doi: 10.3892/ijo.2013.1966. PubMed PMID: 23708256; PubMed Central PMCID: PMC3775563.
Ke, et al.: Quantitative evaluation of all hexamers as exonic splicing elements. Genome Res. Aug. 2011;21(8):1360-74. doi: 10.1101/gr.119628.110. Epub Jun. 9, 2011.
Keir, M.E et al.: PD-1 and Its Ligands in Tolerance and Immunity. Annu. Rev. Immunol. Vol. 26, pp. 677-704 (2008).
Kervestin et al.: NMD: a multifaceted response to premature translational termination. Nature reviews Molecular cell biology13.11 (2012): 700.
Kikin, et al.: QGRS Mapper: a web-based server for predicting G-quadruplexes in nucleotide sequences. Nucleic Acids Res. Jul. 1, 2006;34(Web Server issue):W676-82.
Kim, E., et al. SRSF2 Mutations Contribute to Myelodysplasia by Mutant-Specific Effects on Exon Recognition. Cancer Cell. 2015;27(5):617-30. doi: 10.1016/j.ccell.2015.04.006. PubMed PMID: 25965569; PubMed Central PMCID: PMC4429920.
Kim et al.: ChimerDB 2.0—a knowledgebase for fusion genes updated. Nucleic Acids Res. 2009;38(Database issue):D81-5. Epub Nov. 13, 2009.doi: gkp982 [pii] 10.1093/nar/gkp982. PubMed PMID: 19906715.
Kim et al. The role of synaptic GTPase-activating protein in neuronal development and synaptic plasticity. J. Neurosci. 23(4):1119-1124 (Feb. 15, 2003).
Kim et al.: The splicing factor U2AF65 stabilizes TRF1 protein by inhibiting its ubiquitin-dependent proteolysis. Biochem Biophys Res Commun. 2014;443(3):1124-30. doi: 10.1016/j.bbrc.2013.12.118. PubMed PMID: 24389012.
Knudsen et al. Increased skewing of X chromosome inactivation in Rett syndrome patients and their mothers. Eur J Hum Genet 14:1189-1194 (2006).
Kole, et al. RNA therapeutics: beyond RNA interference and antisense oligonucleotides. Nat Rev Drug Discov. Jan. 20, 2012;11(2):125-40. doi: 10.1038/nrd3625.
Kralovicova, et al.: Allele-specific recognition of the 3' splice site of INS intron 1. Hum Genet. Oct. 2010;128(4):383-400. doi: 10.1007/s00439-010-0860-1. Epub Jul. 14, 2010.
Kralovicova, et al.: Compensatory signals associated with the activation of human GC 5' splice sites. Nucleic Acids Res. Sep. 1, 2011;39(16):7077-91. doi: 10.1093/nar/gkr306. Epub May 23, 2011.
Kralovicova et al.: Exon-centric regulation of ATM expression is population-dependent and amenable to antisense modification by pseudoexon targeting, Scientific Reports, 6:18741, doi:10.1038/srep18741, 13 pages (2016).
Kralovicova et al.: Global control of aberrant splice-site activation by auxiliary splicing sequences: evidence for a gradient in exon and intron definition. Nucleic Acids Res. 35(19):6399-6413 (2007).
Kralovicova et al.: Identification of U2AF(35)-dependent exons by RNA-Seq reveals a link between 3' splice-site organization and

(56) References Cited

OTHER PUBLICATIONS activity of U2AF-related proteins. Nucleic Acids Res. 43(7):3747-63 (2015). doi: 10.1093/nar/gkv194. Epub Mar. 16, 2015.
Kralovicova, et al.: Optimal antisense target reducing INS intron 1 retention is adjacent to a parallel G quadruplex. Nucleic Acids Res. 42(12):8161-73 (2014). doi: 10.1093/nar/gku507. Epub Jun. 17, 2014.
Kralovicova et al.: Phenotypic consequences of branch point substitutions. Hum Mutat. 27(8):803-13 (2006).
Kralovicova et al.: Position-dependent repression and promotion of DQB1 intron 3 splicing by GGGG motifs. J Immunol. Feb. 15, 2006;176(4):2381-8.
Kralovicova et al.: Variants in the human insulin gene that affect pre-mRNA splicing: is—23Hphl a functional single nucleotide polymorphism at IDDM2? Diabetes 55(1):260-4 (2006).
Kralovicova et al.: Antisense Oligonucleotides Modulating Activation of a Nonsense-Mediated RNA Decay Switch Exon in the ATMGene. Nucleic Acid Ther. 26(6):392-400 (2016).
Kralovicova et al.: Branch sites haplotypes that control alternative splicing. Hum Mol Genet. 13:3189-202 (2004).
Kralovicova et al.: The role of short RNA loops in recognition of a single-hairpin exon derived from a mammalian-wide interspersed repeat. RNA Biol. 2015;12(1):54-69. doi: 10.1080/15476286.2015.1017207. PubMed PMID: 25826413.
Kriaucionis et al.: The major form of MeCP2 has a novel N-terminus generated by alternative splicing. Nucleic Acids Res 32:1818-1823 (2004).
Krishnaraj et al.: RettBASE: Rett syndrome database update. Hum Mutat 38:922-931 (2017).
Lander, et al.: Initial sequencing and analysis of the human genome. Nature 409:860-921 (Feb. 15, 2001).
LaPlanche et al., Phosphorothioate-modified oligodeoxyribonucleotides. III. NMR and UV spectroscoptc studies of thRp-Rp, Sp-Sp, anRp-Sduplexes, [d(GGSAATTCC)]2, derived from diastereomeriO-ethyl phosphorothioates Nucleic Acids Res. vol. 14, No. 22, pp. 9081-9093 (1986).
Le Hir, et al.: How introns influence and enhance eukaryotic gene expression. Trends Biochem Sci. Apr. 2003;28(4):215-20.
Lee et al.: The Consensus 5' Splice Site Motif Inhibits mRNA Nuclear Export.PLoS One vol. 10, No. 3, p. e0122743 (Mar. 31, 2015).
Lee, J., et al.: Metastasis of neuroendocrine tumors are characterized by increased cell proliferation and reduced expression of the ATM gene. PLoS One. 2012;7:e34456.
Lehir, H et al.: 5'-End RET Splicing: Absence of Variants in Normal Tissues and Intron Retention in Pheochromocytomas, Oncology 63:84-91 (2002).
Lei et al.: Exonization of Alu Ya5 in the human ACE gene requires mutations in both 3' and 5' splice sites and is facilitated by a conserved splicing enhancer. Nucleic acids research 33.12 (2005): 3897-3906.
Lei, et al.: Identification of splicing silencers and enhancers in sense Alus: a role for pseudoacceptors in splice site repression. Mol Cell Biol. Aug. 2005;25(16):6912-20.
Lemaire, M., et al.: CDC25B phosphorylation by p38 and MK-2. Cell Cycle. 2006;5(15):1649-53. PubMed PMID: 16861915.
Lev-Maor et al.: Intronic Alus influence alternative splicing. PLoS genetics 4.9 (2008):e1000204.
Lev-Maor et al.: The birth of an alternatively spliced exon: 3'splice-site selection in Alu exons. Science 300.5623 (2003): 1288-1291.
Levy et al.TranspoGene and micro TranspoGene: transposed elements influence on the transcriptome of seven vertebrates and invertebrates. Nucleic acids research 36.suppl_1 (2007): D47-D52.
Li et al.: JAG1 Mutation Spectrum and Origin in Chinese Children with Clinical Features of Alagille Syndrome. PLoS One 10(6):e0130355 (2015).
Li et al.: PD-L1-Driven Tolerance Protects Neurogenin3-Induced Islet Neogenesis to Reverse Established Type 1 Diabetes in NOD Mice.Diabetes vol. 64, pp. 529-540 (Feb. 2015; epub Oct. 20, 2014).
Liang et al.: Short intronic repeat sequences facilitate circular RNA production. Genes & development (2014): gad-251926.
Liang et al., T ranslation efficiency of mRNAs is increased by antisense oligonucleotides targeting upstream open reading frames, Nature Biotechnology, 34(8):875-882 (Aug. 2016).
Lianoglou, S., et al.: Ubiquitously transcribed genes use alternative polyadenylation to achieve tissue-specific expression. Genes Dev. 2013;27(21):2380-96. Epub Oct. 23, 2013.doi: gad.229328.113 [pii] 10.1101/gad.229328.113. PubMed PMID: 24145798.
Lim et al.: A computational analysis of sequence features involved in recognition of short introns. Proceedings of the National Academy of Sciences98.20 (2001): 11193-11198.
Litchfield, D.W., et al.: Pin1: Intimate involvement with the regulatory protein kinase networks in the global phosphorylation landscape. Biochem Biophys Acta. 2015. doi: 10.1016/j.bbagen.2015.02.018. PubMed PMID: 25766872.
Liu et al.: Alternative splicing and retinal degeneration. Clinical Genetics 84(2):142-149 (2013).
Llorian et al.: Position-dependent alternative splicing activity revealed by global profiling of alternative splicing events regulated by PTB. Nature structural & molecular biology 17.9 (2010): 1114.
Lo, YL et al.: ATM Polymorphisms and risk of lung cancer among never smokers, Lung Cancer 69(2):148-154 (2010).
Long et al.: Correction of diverse muscular dystrophy mutations in human engineered heart muscle by single-site genome editing. Sci Adv 4:eaap9004 (2018).
Lorenz, et al.: 2D meets 4G: G-Quadruplexes in RNA Secondary Structure Prediction. IEEE/ACM Trans Comput Biol Bioinform. Jul.-Aug. 10, 2013-(4):832-44. doi: 10.1109/TCBB.2013.7.
Lu, F.: Conditional JAG1 MutationShows the Developing Heart Is More Sensitive Than Developing Liver to JAG1 Dosage.Am. J. Hum. Genet. vol. 72, pp. 1065-1070 (2003).
Ludecke et al.: Recessively inherited L-DOPA-responsive parkinsonism in infancy caused by a point mutation (L205P) in the tyrosine hydroxylase gene Hum. Mol. Genet. vo.l 5, pp. 1023-1028, (1996).
Luo et al.: Palmitic Acid Suppresses Apolipoprotein M Gene Expression via the Pathway of PPARb/d in HepG2 Cells. Biochemical and Biophysical Research Communications, 445(1):203-207 (Feb. 2014).
Magi-Galuzzi, C. et al.: TMPRSS2-ERG gene fusion prevalence and class are significantly difference in prostate cancer of Caucasian, African-American and Japanese patients. The Prostate. 2011;71:489-97.
Makishima, et al.: Mutations in the spliceosome machinery, a novel and ubiquitous pathway in leukemogenesis. Blood. Apr. 5, 2012;119(14):3203-10. doi: 10.1182/blood-2011-12-399774. Epub Feb. 9, 2012.
Maniatis et al. An extensive network of coupling among gene expression machines. Nature 416.6880 (2002): 499.
Mansouri, S. et al.: Epstein-Barr Virus EBNA1 Protein Regulates Viral Latency through Effects on let-7 MicroRNA and Dicer.Journal of Virology, vol. 88, No. 19, pp. 11166-11177, (Oct. 2014).
Marcel, et al. G-quadruplex structures in TP53 intron 3: role in alternative splicing and in production of p53 mRNA isoforms. Carcinogenesis. Mar. 2011;32(3):271-8. doi: 10.1093/carcin/bgq253. Epub Nov. 26, 2010.
Marquez, Y. et al. Unmasking alternative splicing inside protein-coding exons defines exitrons and their role inproteome plasticity. Genome vol. 25, pp. 995-1007 (2015).
Matsuoka et al. ATM and ATR substrate analysis reveals extensive protein networks responsive to DNA damage. Science 316(5828):1160-1166 (2007).
Matsuoka, S., et al. Ataxia telangiectasia-mutated phosphorylates Chk2 in vivo and in vitro. Proc Natl Acad Sci USA. 2000;97:10389-94.
Mayeda, et al. Surveying cis-acting sequences of pre-mRNA by adding antisense 2'-O-methyl oligoribonucleotides to a splicing reaction. J Biochem. Sep. 1990;108(3):399-405.
McKie et al. Mutations in the pre-mRNA splicing factor gene PRPC8 in autosomal dominant retinitis pigmentosa (RP13). Human Molecular Genetics 10(15):1555-1562 (2001).

(56) References Cited

OTHER PUBLICATIONS

Melhuish, et al. The Tgif2 gene contains a retained intron within the coding sequence, BMC Molecular Biology 7(2);1-10 (2006).
Melko, et al. Functional characterization of the AFF (AF4/FMR2) family of RNA-binding proteins: insights into the molecular pathology of FRAXE intellectual disability. Hum Mol Genet. May 15, 2011;20(10):1873-85. doi: 10.1093/hmg/ddr069. Epub Feb. 17, 2011.
Mendell, J.T., ap Rhys CM, Dietz HC. Separable roles for rent1/hUpf1 in altered splicing and decay of nonsense transcripts. Science. 2002;298(5592):419-22. Epub Sep. 14, 2002.doi: 10.1126/science.1074428 1074428 [pii]. PubMed PMID: 12228722.
Merendino, L., et al. Inhibition of msl-2 splicing by Sex-lethal reveals interaction between U2AF35 and the 3' splice site AG. Nature. 1999;402(6763):838-41. PubMed PMID: 10617208.
Michael, et al. Mfold web server for nucleic acid folding and hybridization prediction. Nucleic Acids Research. 31 (2003): 3406-3415.
Miller at al. 1993-2015 GeneReviews Eds. Pagon RA et al. Seattle (WA); University of WA, Seattle Bookshelf ID NBK1318.
Millevoi, et al. G-quadruplexes in RNA biology. Wiley Interdiscip Rev RNA. Jul.-Aug. 2012;3(4):495-507. doi: 10.1002/wrna.1113. Epub Apr. 4, 2012.
Min et al. Optimization of a novel series of ataxia-telangiectasia mutated kinase inhibitors as potential radiosensitizing agents. Journal of medicinal chemistry 59.2 (2016): 559-577.
Mirey, G., et al. CDC25B phosphorylated by pEg3 localizes to the centrosome and the spindle poles at mitosis. Cell Cycle. 2005;4(6):806-11. PubMed PMID: 15908796.
Mitelman, F., et al. The impact of translocations and gene fusions on cancer causation. Nat Rev Cancer. 2007;7(4):233-45. Epub Mar. 16, 2007.
Mnatzakanian et al. A previously unidentified MECP2 open reading frame defines a new protein isoform relevant to Rett syndrome. Nat Genet 36:339-341 (2004).
Mochizuki, T. et al. PKD2, a gene for polycystic kidney disease that encodes an integral membrane protein. Science vol. 272, pp. 1339-1342 (1996).
Montecucco, A., et al. Pre-mRNA processing factors meet the DNA damage response. Front Genet. 2013;4:102. doi: 10.3389/fgene.2013.00102. PubMed PMID: 23761808; PubMed Central PMCID: PMC3674313.
Moreno et al. Delivery of splice switching oligonucleotides by amphiphilic chitosan-based nanoparticles. Molecular pharmaceutics13.2 (2016): 344-356.
Morris, et al. An RNA G-quadruplex is essential for cap-independent translation initiation in human VEGF IRES. J Am Chem Soc. Dec.. 22, 2010;132(50):17831-9. doi: 10.1021/ja106287x. Epub Nov. 24, 2010.
Morrison, A.J., et al. Mec1/Tel1 phosphorylation of the INO80 chromatin remodeling complex influences DNA damage checkpoint responses. Cell. 2007;130(3):499-511. doi: 10.1016/j.cell.2007.06.010. PubMed PMID: 17693258.
Moskowitz, et al., Mutation in Scheie syndrome (Mps Is): a G→A transition creates new splice site in intron 5 of one IDUA allele, Hum. Mutat. 2(2):141-144 (1993).
Mulley et al. A new molecular mechanism for severe myoclonic epilepsy of infancy: Exonic deletions in SCN1A.Neurol. vol. 67, pp. 1094-1095 (2006).
Mulley et al. SCN1A mutations and epilepsy.Hum. Muta. vol. 25, pp. 535-542 (2005).
Murray, S.F. et al. Allele-Specific Inhibition of Rhodopsin with an Antisense Oligonucleotide Slows Photoreceptor Cell Degeneration, Invest Ophthalmol. Vis. Sci. 56:6362-6375 (Oct. 2015).
Neidle, S. and Balasubramanian, S. (2006) Quadruplex Nucleic Acids. RSC Biomolecular Sciences, Cambridge, UK.
Nemeroff et al. Identification of cis-acting intron and exon regions in influenza virus NS1 mRNA that inhibit splicing and cause the formation of aberrantly sedimenting presplicing complexes. Molecular and cellular biology 12.3 (1992): 962-970.
Nguyen, L.A., et al. Physical and functional link of the leukemia-associated factors AML1 and PML. Blood. 2005;105(1):292-300. doi: 10.1182/blood-2004-03-1185. PubMed PMID: 15331439.
Nishi, M. et al. Insulin gene mutations and diabetes. Journal of Diabetes Investigation vol. 2 Issue 2 (Apr. 2011).
Nishida, A. et al. Tissue- and Case-specific retention of intron 40 in mature dystrophin mRNA, Journal of Human Genetic 60;327-333 (2015).
Nisole, S., et al. Differential Roles of PML Isoforms. Front Oncol. 2013;3:125. doi: 10.3389/fonc.2013.00125. PubMed PMID: 23734343; PubMed Central PMCID: PMC3660695.
Nomakuchi et al. Antisense-oligonucleotide-directed inhibition of nonsense-mediated mRNA decay. Nat. Biotechnol. 34(2):164-166 (Feb. 2016).
Nozu et al. Alport syndrome caused by a COL4A5 deletion and exonization of an adjacent AluY. Molecular genetics & genomic medicine 2.5 (2014): 451-453.
Nussinov. Conserved quartets near 5' intron junctions in primate nuclear pre-mRNA. J Theor Biol. Jul. 8, 1988;133(1):73-84.
Oda, T. et al. Identification and cloning of the human homolog (JAG) of the rat Jagged1 gene from the Alagille syndrome critical region at 20p12.Genomics vol. 43, No. 3, pp. 376-379 (1997).
Okazaki, T. et al. PD-1 and PD-1 ligands: from discovery to clinical application. International Immunology(The Japanese Society for Immunology), vol. 19, No. 7, pp. 813-824, (2007).
Oustric, V. et al. Antisense oligonucleotide-based therapy in human erythropoietic protoporphyria. Am J Hum Genet. 2014;94(4):611-7. doi: 10.1016/j.ajhg.2014.02.010. PubMed PMID: 24680888; PubMed Central PMCID: PMC3980518.
Pacheco, et al. Diversity of vertebrate splicing factor U2AF35: identification of alternatively spliced U2AF1 mRNAS. J Biol Chem. Jun. 25, 2004;279(26):27039-49. Epub Apr. 19, 2004.
Pacheco, et al. RNA interference knockdown of hU2AF35 impairs cell cycle progression and modulates alternative splicing of Cdc25 transcripts. Mol Biol Cell. Oct. 2006;17(10):4187-99. Epub Jul. 19, 2006.
Page-McCaw, P.S., et al. PUF60: a novel U2AF65-related splicing activity. RNA. 1999;5(12):1548-60. PubMed PMID: 10606266.
Palazzo et al. Non-coding RNA: what is functional and what is junk?. Frontiers in genetics 6 (2015): 2.
Pandit et al. Genome-wide analysis reveals SR protein cooperation and competition in regulated splicing. Molecular cell 50.2 (2013): 223-235.
Papaemmanuil, et al. Clinical and biological implications of driver mutations in myelodysplastic syndromes. Blood. Nov. 21, 2013;122(22):3616-27; quiz 3699. doi: 10.1182/blood-2013-08-518886. Epub Sep. 12, 2013.
Passamonti, C. et al. A novel inherited SCN1A mutation associated with different neuropsychological phenotypes: Is there a common core deficit? Epilepsy & Behavior 43:89-92 (2015).
Pastor, et al. Interaction of hnRNPA1/A2 and DAZAP1 with an Alu-derived intronic splicing enhancer regulates ATM aberrant splicing. PLoS One. 2011;6(8):e23349. doi: 10.1371/journal.pone.0023349. Epub Aug. 8, 2011.
Pastor, F., et al. Induction of tumour immunity by targeted inhibition of nonsense-mediated mRNA decay. Nature. 2010;465(7295):227-30. doi: 10.1038/nature08999. PubMed PMID: 20463739; PubMed Central PMCID: PMC3107067.
Paz, A., et al. SPIKE: a database of highly curated human signaling pathways. Nucleic Acids Res. 2011;39(Database issue): D793-9. doi: 10.1093/nar/gkq1167. PubMed PMID: 21097778; PubMed Central PMCID: PMC3014840.
Pear, Warren S.: New roles for Notch in tuberous sclerosis, Journal of Clinical Investigation, 120(1):84-87 (Jan. 4, 2010).
Pecarelli et al. Regulation of natural mRNAs by the nonsense-mediated mRNA decay pathway. Eukaryotic cell(2014): EC-00090.
Pellagatti, A., et al. Deregulated gene expression pathways in myelodysplastic syndrome hematopoietic stem cells. Leukemia. 2010;24(4):756-64. doi: 10.1038/leu.2010.31. PubMed PMID: 20220779.
Peng, et al. Functional importance of different patterns of correlation between adjacent cassette exons in human and mouse. BMC Genomics. Apr. 26, 2008;9:191. doi: 10.1186/1471-2164-9-191.

(56) References Cited

OTHER PUBLICATIONS

Penton, A.L.: Notch signaling in human development and disease. Seminars in Cell & Developmental Biology. vol. 23, pp. 450-457 (2012).
Perdiguero, E., et al. Regulation of Cdc25C activity during the meiotic G2/M transition. Cell Cycle. 2004;3(6):733-7. PubMed PMID: 15136768.
Piaceri, I., et al. Ataxia-telangiectasia mutated (ATM) genetic variant in Italian centenarians. Neurophysiology. 2013;34:573-5.
Pilia et al. Jagged-1 mutation analysis in Italian Alagille syndrome patients. Hum Mut 14(5):394-400 (1999).
Pomentel et al. A dynamic intron retention program enriched in RNA processing genes regulates gene expression during terminal erythropoiesis. Nucleic acids research 44.2 (2015):838-851.
Precursor mRNA-Processing Factor 3, S. Cerevisiae, Homolog Of; PRPF3m, 3 pages.
Przychodzen, B., et al. Patterns of missplicing due to somatic U2AF1 mutations in myeloid neoplasms. Blood. 2013;122:999-1006. Epub Jun. 19, 2013.doi: blood-2013-01-480970 [pii] 10.1182/blood-2013-01-480970. PubMed PMID: 23775717.
Pugliese, et al. The insulin gene is transcribed in the human thymus and transcription levels correlated with allelic variation at the INS VNTR-IDDM2 susceptibility locus for type 1 diabetes. Nat Genet. Mar. 1997;15(3):293-7.
Rainey et al. Transient inhibition of ATM kinase is sufficient to enhance cellular sensitivity to ionizing radiation. Cancer research68. 18 (2008): 7466-7474.
Ramocki et al. The MECP2 duplication syndrome. Am J Med Genet A 152A:1079-1088 (2010).
Rangasamy et al.: Reduced neuronal size and mTOR pathway activity in the Mecp2 A140V Rett syndrome mouse model. F1000research 5:2269 (2016).
Ray, D. et al. A compendium of RNA-binding motifs for decoding gene regulation. Nature. vol. 499, No. 7457, pp. 172-177 (Jul. 11, 2013).
Reineke, E.L., et al. Degradation of the tumor suppressor PML by Pin1 contributes to the cancer phenotype of breast cancer MDA-MB-231 cells. Mol Cell Biol. 2008;28(3):997-1006. doi: 10.1128/MCB.01848-07. PubMed PMID: 18039859; PubMed Central PMCID: PMC2223389.
Rendu, J. et al. Hum Gene Ther. Exon skipping as a therapeutic strategy applied to an RYR1 mutation with pseudo-exon inclusion causing a severe core myopathy. Jul. 2013;24(7):702-13. doi: 10.1089/hum.2013.052.
Reynolds, DM et al.: Aberrant Splicing in the PKD2 Gene as a Cause of Polycystic Kidney Disease.Am. Soc. Nephrol. vol. 10, pp. 2342-2351 (1999).
Ritprajak et al. Keratinocyte-Associated B7-H1 Directly Regulates Cutaneous Effector CD8+ T Cell Responses. J Immunology vol. 184, pp. 4918-4925 (2010).
RNA 2-14 The Nineteenth Annual Meeting of the RNA Society. Quebec City, Canada. (Jun. 3-8, 2014).
Roberts, Jennifer et al. Efficient and Persistent Splice Switching by Systemically Delivered LNA Oligonucleotides in Mice. Molecular Therapy, Nature Publishing, vol. 14, No. 4, pp. 471-475, Oct. 1, 2006.
Romero, P.R., et al. Alternative splicing in concert with protein intrinsic disorder enables increased functional diversity in multicellular organisms. Proc Natl Acad Sci USA. 2006;103(22):8390-5. Epub May 24, 2006.doi: 0507916103 [pii] 10.1073/pnas.0507916103. PubMed PMID: 16717195.
Rosenbloom et al. The UCSC Genome Browser database: 2015 Update. Nucleic Acids Research 43, Database Issue doi:101093/nar/gku1177.
Ruchlemer, R. et al.: Geography, ethnicity and "roots" in chronic lymphocytic leukemia. Leuk Lymphoma. 2013;54(6):1142-50. doi: 10.3109/10428194.2012.740670. PubMed PMID: 23121522.
Rudd, M.F, et al. Variants in the ATM-BRCA2-CHEK2 axis predispose to chronic lymphocytic leukemia. Blood. 2006; 108(2):638-44. Epub Apr. 1, 2006.doi: 2005-12-5022 [pii] 10.1182/blood-2005-12-5022. PubMed PMID: 16574953.
Ruskin, et al. A factor, U2AF, is required for U2 snRNP binding and splicing complex assembly. Cell. Jan. 29, 1988;52(2):207-19.
Sadleir, et al. Not all SCN1A epileptic encephalopathies are Dravet syndrome. Neurology. Sep. 5, 2017; 89(10): 1-8.
Sahashi et al. Pathological impact of SMN2 mis-splicing in adult SMA mice. EMBO Mol. Med. 5(10):1586-601 (Oct. 2013).
Sahashi et al. Tsunami: an antisense method to phenocopy splicing-associated diseases in animals. Genes Dev. 26(16):1874-1884 (Aug. 15, 2012).
Sakabe, et al. Sequence features responsible for intron retention in human. BMC Genomics. Feb. 26, 2007;8:59.
Samatanga, et al. The high kinetic stability of a G-quadruplex limits hnRNP F qRRM3 binding to G-tract RNA. Nucleic Acids Res. Feb. 1, 2013;41(4):2505-16. doi: 10.1093/nar/gks1289. Epub Dec. 28, 2012.
Schanen et al.: A Severely Affected Male Born into a Rett Syndrome Kindred Supports X-Linked Inheritance and Allows Extension of the Exclusion Map. Am J Hum Genetics 63:267-269 (1998).
Schwarze, et al. Redefinition of exon 7 in the COL1A1 gene of type I collagen by an intron 8 splice-donor-site mutation in a form of osteogenesis imperfecta: influence of intron splice order on outcome of splice-site mutation. Am J Hum Genet. Aug. 1999;65(2):336-44.
Scott, S.P., et al. Missense mutations but not allelic variants alter the function of ATM by dominant interference in patients with breast cancer. Proc Natl Acad Sci USA. 2002;99:925-30.
SG 11201702682P Search Report and Written Opinion dated Apr. 9, 2018.
Shao, C., et al. Mechanisms for U2AF to define 3' splice sites and regulate alternative splicing in the human genome. Nat Struct Mol Biol. 2014;doi: 10.1038/nsmb.2906.
Shcherbakova, I., et al. Alternative spliceosome assembly pathways revealed by single-molecule fluorescence microscopy. Cell Rep. 2013;5(1):151-65. Epub Oct. 1, 2013.doi: S2211-1247(13)00467-1 [pii] 10.1016/j.celrep.2013.08.026. PubMed PMID: 24075986.
Shen, M., et al. Characterization and cell cycle regulation of the related human telomeric proteins Pin2 and TRF1 suggest a role in mitosis. Proc Natl Acad Sci USA. 1997;94(25):13618-23. PubMed PMID: 9391075; PubMed Central PMCID: PMC28355.
Shiloh, Y., et al.The ATM protein kinase: regulating the cellular response to genotoxic stress, and more. Nat Rev Mol Cell Biol. 2013;14(4):197-210. doi: 10.1038/nrm3546. PubMed PMID: 23486281.
Shiria, C.L. et al. Mutant U2AF1 Expression Alters Hematopoiesis and Pre-mRNA Splicing In Vivo. Cancer Cell. 2015;27(5):631-43. doi: 10.1016/j.ccell.2015.04.008. PubMed PMID: 25965570; PubMed Central PMCID: PMC4430854.
Shirley, M.H., et al Incidence of haematological malignancies by ethnic group in England, 2001-7. Br J Haematol. 2013;163(4):465-77. doi: 10.1111/bjh.12562. PubMed PMID: 24033296.
Sierakowska, H et al. Repair of thalassemic human beta-globin mRNA in mammalian cells by antisense oligonucleotides. Proc Natl Acad Sci U S A. Nov. 12, 1996;93(23):12840-4.
Singh, et al. An antisense microwalk reveals critical role of an intronic position linked to a unique long-distance interaction in pre-mRNA splicing. RNA. Jun. 2010;16(6):1167-81. doi: 10.1261/rna.2154310. Epub Apr. 22, 2010.
Sirand-Pugnet, et al.: An intronic (A/U)GGG repeat enhances the splicing of an alternative intron of the chicken beta-tropomyosin pre-mRNA. Nucleic Acids Res. Sep. 11, 1995;23(17):3501-7.
Skjevik et al. The N-Terminal Sequence of Tyrosine Hydroxylase Is a Conformationally Versatile Motif That Binds 14-3-3 Proteins and Membranes.J. Mol. Bio. vol. 426, pp. 150-168 (2014).
Smith, C.W., et al. Scanning and competition between AGs are involved in 3' splice site selection in mammalian introns. Mol Cell Biol. 1993;13(8):4939-52. PubMed PMID: 8336728.
Smith, et al.: Alternative pre-mRNA splicing: the logic of combinatorial control. Trends Biochem Sci. 25(8):381-8 (2000).
Smith, P.J., et al. An increased specificity score matrix for the prediction of SF2/ASF-specific exonic splicing enhancers. Hum Mol Genet. 2006; 15(16):2490-508. PubMed PMID: 16825284.

(56) References Cited

OTHER PUBLICATIONS

Soo, R.A., et al.: Ethnic differences in survival outcome in patients with advanced stage non-small cell lung cancer. J Thorac Oncol. 2011;6:1030-8.
Sorek et al. Minimal conditions for exonization of intronic sequences: 5' splice site formation in alu exons. Molecular cell 14.2 (2004): 221-231.
Soutar et al. Mechanisms of disease: genetic causes of familial hpercholesterolemia. Nat. Clin. Pract. Cardiovasc. Med. 4:214-255 (Apr. 1, 2007).
Spellman et al. Regulation of alternative splicing by PTB and associated factors. (2005): 457-460.
Spinner et al. Jagged1 mutations in alagille syndrome. Hum Mutat 17(1):18-33 (2001).
Stamm, S.: Regulation of alternative splicing by reversible protein phosphorylation. J Biol Chem. 2008;283(3):1223-7. PubMed PMID: 18024427.
Stankovic, T., et al.: Inactivation of ataxia telangiectasia mutated gene in B-cell chronic lymphocytic leukaemia. Lancet. 1999;353(9146):26-9. doi: 10.1016/S0140-6736(98)10117-4. PubMed PMID: 10023947.
Staropoli et al. Rescue of gene-expression changes in an induced mouse model of spinal muscular atrophy by an antisense oligonucleotide that promotes inclusion of SMN2 exon 7. Genomics 105:220-228 (2015).
Stead, et al. Global haplotype diversity in the human insulin gene region. Genome Res. Sep. 2003;13(9):2101-11.
Stec et al., Automated solid-phase synthesis, separation, and stereochemistry of phosphorothioate analogs of oligodeoxyribonucleotides J. Am. Chem. Soc., 1984, 106 (20), pp. 6077-6079 (1984).
Stein et al.: FDA-Approved Oligonucleotide Therapies in 2017. Mol Ther 25:1069-1075 (2017).
Stein et al., Physicochemical properties of phosphorothioate oligodeoxynucleotides. Nucleic Acids Res. 16(8):3209-21 (1988).
Story, M.D. et al. ATM has a major role in the double-stand break repair pathway dysregulation in sporadic breast carcinomas and is an independent prognostic marker at both mRNA and protein levels, Breast Diseases: A Yearbook Quarterly, 26(4);297-299 (Mar. 17, 2015).
Strausfeld, U., et al. Activation of p34cdc2 protein kinase by microinjection of human cdc25C into mammalian cells. Requirement for prior phosphorylation of cdc25C by p34cdc2 on sites phosphorylated at mitosis. J Biol Chem. 1994;269(8):5989-6000. PubMed PMID: 8119945.
Suarez, F. et al. Incidence, presentation, and prognosis of malignancies in ataxia-telangiectasia: a report from the French national registry of primary immune deficiencies. J Clin Oncol. 2015;33(2):202-8. doi: 10.1200/JCO.2014.56.5101. PubMed PMID: 25488969.
Summerton, James. Morpholino Antisense Oligos: Applications in Biopharmaceutical Research Morpholinos constitute a radical redesign of DNA, providing decisive advantages over the more conventional oligo types used for modulating gene expression. Innovations in Pharmaceutical Technology Issue No. 17 (2005).
Sun, H., et al.: Multiple splicing defects in an intronic false exon. Mol Cell Biol. 2000;20(17):6414-25. PubMed PMID: 10938119.
Supplementary European Search Report dated Apr. 18, 2019 for EP16876615.2.
Svasti, et al. RNA repair restores hemoglobin expression in IVS2-654 thalassemic mice. Proc Natl Acad Sci U S A. Jan. 27, 2009; 106(4): 1205-1210.
Swaans, RJM et al.Four novel mutations in the Tyrosine Hydroxylase gene in patients with infantile parkinsonism Annals of Human Genetic, vol. 64, No. 1, pp. 25-31, (Jan. 2000).
Tabrez, S. et al.: A Synopsis of the Role of Tyrosine Hydroxylase in Parkinson's Disease. CNS & Neurological Disorders—Drug Targets vol. 11, No. 4 (2012).
Takahashi et al. Skewed X chromosome inactivation failed to explain the normal phenotype of a carrier female with MECP2 mutation resulting in Rett syndrome. Clin Genet 73:257-261 (2008).
Tavanez, J.P., et al. hnRNP A1 proofreads 3' splice site recognition by U2AF. Mol Cell. 2012;45(3):314-29. Epub Feb. 14, 2012. doi: S1097-2765(12)00032-9 [pii] 10.1016/j.molcel.2011.11.033. PubMed PMID: 22325350.
Taylor, A.M., et al. Ataxia telangiectasia: more variation at clinical and cellular levels. Clin Genet. 2015;87(3):199-208. doi: 10.1111/cge.12453. PubMed PMID: 25040471.
Taylor, A.M., et al.: Leukemia and lymphoma in ataxia telangiectasia. Blood. 1996;87(2):423-38. PubMed PMID: 8555463.
Thisted, et al. Optimized RNA targets of two closely related triple KH domain proteins, heterogeneous nuclear ribonucleoprotein K and alphaCP-2KL, suggest Distinct modes of RNA recognition. J Biol Chem. May 18, 2001;276(20):17484-96. Epub Feb. 2, 2001.
Tilgner et al., Deep Sequencing of subcellular RNA factions shows splicing to be predominantly co-transcriptional in the human genome but inefficient for IncRNAs. Genome Research vol. 22, No. 9, pp. 1616-1625 (2012).
Tillotson et al. Radically truncated MeCP2 rescues Rett syndrome-like neurological defects. Nature 550:398 (2017).
Torres, V.E. et al. Autosomal dominant polycystic kidney disease: the last 3 years. Kidney International vol. 76, pp. 149-168 (May 20, 2009).
Trabattoni et al.: Costimulatory Pathways in Multiple Disease Sclerosis: Distinctive Expression of PD-1 and PD-L1 in Patients with Different Patterns of Disease. J. Immunol. vol. 183, pp. 4984-4993 (2009).
Trapnell, C. et al. Differential gene and transcript expression analysis of RNA-seq experiments with Top Hat and Cufflinks. Nat Protoc 2012;7(3):562-78. Epub Mar. 3, 2012.doi: nprot.2012.016 [pii] 10.1038/nprot.2012.016. PubMed PMID: 22383036.
Turnpenny, P.D. et al. Alagille syndrome: pathogenesis, diagnosis and management. European Journal of Human Genetics vol. 20, pp. 251-257 (2012.
Uhlmann, E. et al., Antisense oligonucleotides: a new therapeutic principle. Chemical Reviews vol. 90, No. 4, pp. 543-584 (1990).
U.S. Appl. No. 14/741,071 Non-Final Office Action mailed Dec. 1, 2016.
U.S. Appl. No. 14/874,420 Non-Final Office Action Mailed Mar. 21, 2017.
U.S. Appl. No. 14/874,420 Office Action dated Oct. 24, 2017 .
U.S. Appl. No. 15/619,984 Office Action dated Dec. 17, 2018.
U.S. Appl. No. 15/949,902 Office Action dated Mar. 1, 2019.
U.S. Appl. No. 15/288,415 Office Action dated Jun. 26, 2018.
Vafiadis, et al. Insulin expression in human thymus is modulated by INS VNTR alleles at the IDDM2 locus. Nat Genet. Mar. 1997;15(3):289-92.
Van Nostrand et al. Robust transcriptome-wide discovery of RNA-binding protein binding sites with enhanced CLIP (eCLIP). Nature methods 13.6 (2016): 508.
Verhaart, I.E.C. AON-Mediated Exon Skipping for Duchenne Muscular Dystrophy. Chapter 3. pp. 1-26 (Aug. 1, 2012).
Verret et al., Inhibitory Interneuron Deficit Links Altered Network Activity and Cognitive Dysfunction in Alzheimer Model, Cell, 149(3): 708-721 (2012).
Vieira, N. et al.: Jagged 1Rescues the Duchenne Muscular Dystrophy Phenotype. Cell vol. 163, pp. 1204-1213 (Nov. 19, 2015).
Voelker, et al. A comprehensive computational characterization of conserved mammalian intronic sequences reveals conserved motifs associated with constitutive and alternative splicing. Genome Res. Jul. 2007;17(7):1023-33. Epub May 24, 2007.
Vorechovsky Correspondence Pediatric Research 2010.
Vorechovsky, I. Letter to the Editor: MER91B-assisted cryptic exon activation in Gitelman syndrome. Pediatric research 67.4 (2010): 444-445.
Vorechovsky Transposable elements in disease-associated cryptic exons. Human genetics 127.2 (2010): 135-154.
Wahl, et al. The spliceosome: design principles of a dynamic RNP machine. Cell. Feb. 20, 2009;136(4):701-18. doi: 10.1016/j.cell.2009.02.009.
Wan et al., Synthesis, biophysical properties and biological activity of second generation antisense oligonucleotides containing chiral phosphorothioate linkages. Nucleic Acids Research, vol. 42, No. 22, pp. 13456-13468 (2014).

(56) References Cited

OTHER PUBLICATIONS

Wang, et al. A complex network of factors with overlapping affinities represses splicing through intronic elements. Nat Struct Mol Biol. Jan. 2013;20(1):36-45. doi: 10.1038/nsmb.2459. Epub Dec. 16, 2012.
Wang et al. Alternative isoform regulation in human tissue transcriptomes. Nature. 2008;456(November):470-476.
Wang et al. Human Adenovirus Type 36 Enhances Glucose Uptake in Diabetic and Nondiabetic Human Skeletal Muscle Cells Independent of Insulin Signaling. Diabetes vol. 57, pp. 1861-1869 (2008).
Wang, et al.: Intronic splicing enhancers, cognate splicing factors and context-dependent regulation rules. Nat Struct Mol Biol. Oct. 2012; 19(10):1044-52. doi: 10.1038/nsmb.2377. Epub Sep. 16, 2012.
Wang, et al.: Regulation of insulin preRNA splicing by glucose. Proc Natl Acad Sci U S A. Apr. 29, 1997;94(9):4360-5.
Wang, Z. et al.: Systematic identification and analysis of exonic splicing silencers. Cell. 2004;119(6):831-45. PubMed PMID: 15607979.
Warf, M.B., et al.: Role of RNA structure in regulating pre-mRNA splicing. Trends Biochem Sci. 2010;35(3):169-78. Epub Dec. 5, 2009.doi: S0968-0004(09)00196-0 [pii].
Wieland, et al.: RNA quadruplex-based modulation of gene expression. Chem Biol. Jul. 2007;14(7):757-63.
Wilton, et al. Splice modification to restore functional dystrophin synthesis in Duchenne muscular dystrophy. Current pharmaceutical design 16.8 (2010): 988-1001.
Wong et al. Orchestrated intron retention regulates normal granulocyte differentiation. Cell 154.3 (2013): 583-595.
Wu et al. AT-AC Pre-mRNA Splicing Mechanisms and Conservation of Minor Introns in Voltage-Gated lon Channel Genes. Molecular and Cellular Biology 19(5): 3225-3236 (May 1999).
Wu et al.: Functional recognition of the 3' splice site AG by the splicing factor U2AF35.Nature. 1999;402(6763):832-5. PubMed PMID: 10617206.
Wu et al.: MRE11-RAD50-NBS1 and ATM function as comediators of TRF1 in telomere length control. Nat Struct Mol Biol. 2007; 14(9):832-40. doi: 10.1038/nsmb1286. PubMed PMID: 17694070.
Wu, J.Y., et al.: Specific interactions between proteins implicated in splice site selection and regulated alternative splicing. Cell. 1993;75(6):1061-70. Epub Dec. 17, 1993.doi: 0092-8674(93)90316-1 [pii]. PubMed PMID: 8261509.
Xia, Y. et al.: Frequencies of SF3B1, NOTCH1, MYD88, BIRC3 and IGHV mutations and TP53 disruptions in Chinese with chronic lymphocytic leukemia: disparities with Europeans. Oncotarget. 2015;6(7):5426-34. PubMed PMID: 25605254.
Xing, et al.: The multiassembly problem: reconstructing multiple transcript isoforms from EST fragment mixtures. Genome Res. Mar. 2004;14(3):426-41. Epub Feb. 12, 2004.
Yamamoto et al. Mib-Jag1-Notch signalling regulates patterning and structural roles of the notochord by controlling cell-fate decisions. Development 137(15):2527-2537 (2010).
Yamamoto, Y., et al. BCOR as a novel fusion partner of retinoic acid receptor alpha in a t(X;17)(p11;q12) variant of acute promyelocytic leukemia. Blood. 2010;116(20):4274-83. doi: 10.1182/blood-2010-01-264432. PubMed PMID: 20807888.
Yan, et al. Systematic discovery of regulated and conserved alternative exons in the mammalian brain reveals NMD modulating chromatin regulators. Proc Natl Acad Sci U S A. Mar. 17, 2015; 112(11): 3445-3450.
Yang et al.: Biophysical analysis and small-angle X-ray scattering-derived structures of MeCP2-nucleosome complexes. Nucleic Acids Res 39:4122-4135 (2011).
Yang, S. et al. PML-dependent apoptosis after DNA damage is regulated by the checkpoint kinase hCds1/Chk2. Nat Cell Biol. 2002;4(11):865-70. doi: 10.1038/ncb869. PubMed PMID: 12402044.
Yang, S., et al. Promyelocytic leukemia activates Chk2 by mediating Chk2 autophosphorylation. J Biol Chem. 2006;281(36):26645-54. doi: 10.1074/jbc.M604391200. PubMed PMID: 16835227.
Yang, Y. et al. Oligomerization of the polycystin-2 C-terminal tail and effects on its Ca2+binding properties. J. Bio. Chem. vol. 290, No. 16, pp. 10544-10554 (2015).
Yeo, et al.: Discovery and analysis of evolutionarily conserved intronic splicing regulatory elements. PLoS Genet. May 25, 2007;3(5):e85. Epub Apr. 13, 2007.
Yoshida, et al. Frequent pathway mutations of splicing machinery in myelodysplasia. Nature. Sep. 11, 2011;478(7367):64-9. doi: 10.1038/nature10496.
Yoshida, K., et al. Splicing factor mutations and cancer. Wiley Interdiscip Rev RNA. 2014;5(4):445-59. doi: 10.1002/wrna.1222. PubMed PMID: 24523246.
Young et al. 915—a GABA-Selective AAV Vector-Based Approach to Up-Regulate Endogenous Scn1a Expression reverses key Phenotypes in a Mouse Model of Dravet Syndrome. 22nd Annual Meeting American Society of Gene & Cell Therapy. Washington, D.C. Apr. 29-May 2, 2019 (Abstract).
Yu, E.Y., et al. Regulation of telomere structure and functions by subunits of the INO80 chromatin remodeling complex. Mol Cell Biol. 2007;27(16):5639-49. doi: 10.1128/MCB.00418-07. PubMed PMID: 17562861; PubMed Central PMCID: PMC1952117.
Yuan et al. Brain localization and neurotoxicity evaluation of polysorbate 80-modified chitosan nanoparticles in rats. PloS one 10.8 (2015): e0134722.
Yuan X., et al. Nuclear protein profiling of Jurkat cells during heat stress-induced apoptosis by 2-DE and MS/MS. Electrophoresis. 2007;28(12):2018-26. doi: 10.1002/elps.200600821. PubMed PMID: 17523140.
Zamore, P.D., et al. Identification, purification, and biochemical characterization of U2 small nuclear ribonucleoprotein auxiliary factor. Proc Natl Acad Sci USA. 1989;86(23):9243-7. PubMed PMID: 2531895.
Zarnack K., et al. Direct competition between hnRNP C and U2AF65 protects the transcriptome from the exonization of Alu elements. Cell. 2013;152(3):453-66. Epub Feb. 5, 2013.doi: S0092-8674(12)01545-0 [pii] 10.1016/j.cell.2012.12.023. PubMed PMID: 23374342.
Zhang C., et al. RNA landscape of evolution for optimal exon and intron discrimination. Proc Natl Acad Sci USA. 2008;105(15):5797-802. Epub Apr. 9, 2008.doi: 0801692105 [pii] 10.1073/pnas.0801692105. PubMed PMID: 18391195.
Zhang et al.: Computational definition of sequence motifs governing constitutive exon splicing. Genes Dev. 2004;18:1241-50. PubMed PMID: 15145827.
Zhang, et al. Insulin as an autoantigen in NOD/human diabetes. Curr Opin Immunol. Feb. 2008;20(1):111-8. doi: 10.1016/j.coi.2007.11.005.
Zhang, et al.: The kinetics and folding pathways of intramolecular G-quadruplex nucleic acids. J Am Chem Soc. Nov. 21, 2012;134(46):19297-308. doi: 10.1021/ja309851t. Epub Nov. 12, 2012.
Zhang, J. et al. PowerBLAST: A New Network BLAST Application for Interactive or Automated Sequence Analysis and Annotation Genome Res., vol. 7, pp. 649-656, (1997).
Zimrin et al. An Antisense Oligonucleotide to the Notch Ligand Jagged Enhances Firbroblast Growth Factor-induced Angiogenesis in Vitro. J. Biol. Chem. 271(51):32499-502 (Dec. 20, 1996).
Zon et al. Phosphorothioate oligonucleotides: chemistry, purification, analysis, scale-up and future directions. Anti Cancer Drug Design vol. 6, No. 6, pp. 539-568 (1991).
Zon G. and Stec, W.J. (1991) In Eckstein,F. (ed.), Oligonucleotides and Analogues: A Practical Approach. Oxford University Press, Oxford, UK, pp. 87-108.
Zorio, D.A., et al. Both subunits of U2AF recognize the 3' splice site in Caenorhabditis elegans. Nature. 1999;402(6763): 835-8. PubMed PMID: 10617207.
Zuker, M. Mfold web server for nucleic acid folding and hybridization prediction. Nucleic Acids Res. 31, 3406-3415 (2003).
Griffey, Richard H. et al. 2'-O-aminopropyl Ribonucleotides: A Zwitterionic Modification that Enhances the Exonuclease Resistance and Biological Activity of Antisense Oligonucleotides. Journal of Medicinal Chemistry 39(26):5100-5109 (1997).

(56) References Cited

OTHER PUBLICATIONS

Hinnebusch, Alan G., et al. Translational control by 5'-untranslated regions of eukaryotic mRNAs. Science 352.6292: 1413-1416. (2016).
Kosei, T. et al. Physiological Function Analysis by Antisense Oligonucleotides. Molecular Biology for Physiologists, 60: 383-400 (1998).
Lebedeva, I.V. et al., Chapter 6:Phosphorothioate Oligodeoxynucleotides as Inhibitors Of Gene Expression: Antisense and Non-Antisense Effects, Applications of Antisense Therapies to Restenosis, p. 101 (1999).
Leppek, Kathrin, et al. Functional 5' UTR mRNA structures in eukaryotic translation regulation and how to find them. Nature Reviews, Molecular Cell Biology: pp. 1-17. (2017).
Liang, Xue-hai, et al. Antisense oligonucleotides targeting translation inhibitory elements in 5' UTRs can selectively increase protein levels. Nucleic acids research 45.16: 9528-9546. (2017).
PCT/US2024/032131 International Search Report mailed Jan. 10, 2025.
PCT/US2024/039369 International Search Report and Written Opinion dated Dec. 26, 2024.
Romagnoli, M. et al. Idebenone increases chance of stabilization/recovery of visual acuity in OPA1-dominant optic atrophy. Annals of Clinical and Translational Neurology 7(4): 590-594 (2020).
Zhang Y. et al., Pharmacological characterization of an antisense knockdown zebrafish model of Dravet syndrome: inhibition of epileptic seizures by the serotonin agonist fenfluramine. PLoS One, 10(5): 1-19, Article e0125898: I2015).
Madocsai, C. et al., Correction of SMN2 Pre-mRNA Splicing by Antisense U7 Small Nuclear RNAs. Molecular Therapy 12(6): 1013-1022 (2005).
Phillips, M., Antisense Inhibition and Adeno-Associated Viral Vector Delivery for Reducing Hypertension. Hypertension 29(1): 177-187 (1997).
U.S. Appl. No. 16/696,635 Final Office Action mailed Sep. 17, 2021.
U.S. Appl. No. 16/696,635 Non-Final Office Action mailed Feb. 23, 2021.
U.S. Appl. No. 17/924,966 Office Action dated Oct. 18, 2024.
Aceti et al.: Syngap1 haploinsufficiency damages a postnatal critical period of pyramidal cell structural maturation linked to cortical circuit assembly, Biol Psychiatry 77(9):805-815 (2015).
Arzimanoglou, A et al.: A Review of the New Antiepileptic Drugs for Focal-Onset Seizures in Pediatrics: Role of Extrapolation, Pediatr. Drugs 20(3):249-64 (2018).
Berecki, G. et al.: SCN1A Gain of Function in Early Infantile Encephalopathy. Ann Neurol. 85:514-25 (2019).
Boutz, et al.: Detained intron are a novel, widespread class of post-transcriptionally spliced introns. Genes & Development 29: 63-80.
Braunschweig et al., "Widespread intron retention in mammal functionally tunes transcriptomes", Chold Spring Harbor Laboratory Press, 2014 p. 1-14.
Braunschweig, Intron Retention, Supplemental Figure Legends.
Carvill, et al., "Aberrant Inclusion of a Poison Exon Causes Dravet Syndrome and Related SCN1A-Associated Genetic Epilepsies", The American Journal of Human Genetics, Vo. 103, No. 6, pp. 1022-1029 (2018).
"Cestele, S. et al., "Nonfunctional NaV1.1 familial hemiplegic migraine mutant transformed into gain of function by partial rescue of folding defects," Proc. Natl. Acad. Sci., 2013, vol. 110, No. 43, pp. 17546-175451".
"Cheah, C. S. et al., "Correlations in timing of sodium channel expression, epilepsy, and sudden death in Dravet syndrome," Channels, 2013, vol. 7, No. 6, pp. 468-472".
"Cheah, C. S. et al., "Specific deletion of NaV1.1 sodium channels in inhibitory interneurons causes seizures and premature death in a mouse model of Dravet syndrome," PNAS, 2012, vol. 109, No. 36, pp. 14646-14651".
Collin et al.: Antisense Oligonucleotide (AON)-based Therapy for Leber Congenital Amaurosis caused by a Frequent Mutation in CEP290. Molecular Therapy-Nucleic Acids, pp. 1-7 (2012).
Creson, et al., "Re-expression of SynGAP Protein in Adulthood Improves Translatable Measure of Brain Function and Behavior in a Model of Neurodevelopmental Disorders" BioRxiv (2018) pp. 1-27.
De-Lange et al.: Influence of contraindicated medication use on cognitive outcome in Dravet syndrome and age at first afebrile seizure as a clinical predictor in SCN1A-related seizure phenotypes, Epilepsia 59:1154-65 (2018).
"Depienne, C. et al., "Spectrum of SCN1A gene mutations associated with Dravet syndrome: analysis of 333 patients," J. Med Genet., 2009, vol. 46, pp. 183-191".
"Dhifallah, S. et al., "Gain of Function for the SCN1A/hNav1.1-L1670W Mutation Responsible for Familial Hemiplegic Migraine," Front Mol. Neurosci., 2018, vol. 11, No. 232, pp. 1-14".
"Djemie, T. et al., "Pitfalls in genetic testing: the story of missed SCN1A mutations," Mol Genet Genomic Med., 2016, vol. 4, No. 4, pp. 457-464".
Du, et al., "Downregulation of neuronal sodium channel subunits Nav. 1. and Nav1.6 in the sinoatrial node from volume-overloaded heart failure rat", Pflugers Arch—Eur J Physiol (2007) 454:451-459.
Duikers, et al. "Antisense Oligonucleotide-Based Splicing Correction in Individuals with Leber Congenital Amaurosis due to Compound Heterozygosity for the c2991+1655AG Mutation in CEP290" (2018) International Journal of Molecular Sciences, 19, 753, pp. 1-12.
Dulla, et al., "Splice-Modulating Oligonucleotide QR-110 Restores CEP290 mRNA and Function in Human c2991+1655AG LCA10 Models" (2018) Molecular Therapy: Nucleic Acids, vol. pp. 730-740.
EP16781187.6 European Second Office Action dated Feb. 24, 2023.
EP20763143.3 Extended European Search Report dated Nov. 13, 2023.
Escayg et al., Sodium channel SCN1A and epilepsy: mutations and mechanisms, Epilepsia, Sep. 2010, vol. 51, No. 9, pp. 1-16.
European Patent Application No. 21209655.6 Search Report dated May 23, 2022.
European Supplementary Search Report dated Sep. 20, 2023 issued in European Application No. 20897381.
"Fan, C. et al., "Early-onset familial hemiplegic migraine due to a novel SCN1A mutation," Cephalalgia, 2016, vol. 36, No. 13, pp. 1238-1247".
Friedman, et al., "Correction of Aberrant Splicing of the Cystic Fibrosis Transmembrane conductance Regulator (CFTR) Gene by Antisense Oligonucleotides" (1999) The Journal of Biological Chemistry, vol. 274, No. 51, pp. 36193-36199.
Garanto, et al., "In vitro and in vivo rescue of aberrant splicing in CEP290-associted LCA by antisense oligonucleotide delivery" (2016) Human Molecular Genetics, vol. 25, No. 12, pp. 2552-2563.
"Gataullina, S. et al., "From genotype to phenotype in Dravet disease," Seizure, 2017, vol. 44, pp. 58-64".
Geary, et al., "Pharmacokinetics, biodistribution and cell uptake of antisense oligonucleotides", (2015) Advance Drug Delivery Reviews.
"Genton, P. et al., "Dravet syndrome: the long-term outcome," Epilepsia, 2011, vol. 52, Suppl 2, pp. 44-49".
Gerard, et al., "AON-mediated Exon Skipping Restores ciliation in Fibroblasts Harboring the Common Leber Congenital Amaurosis CEP290 Mutation" (2012) Molecular Therapy-Nucleic Acids, pp. 1-9.
Goto, et al., "Targeted skipping of a Single Exon Harboring a Premature termination Codon Mutation: Implications and Potential for Gene Correction Therapy for Selective Dystrophic Epiderolysis Bullosa Patients" (2006) Journal of Investigative Dermatology, vol. 126, pp. 2614-262.
Hammond, et al"Genetic therapies for RNA mis-splicing diseases" (2011) Cell Press 10 pages.
Han et al.: Antisense-Mediated Increase of SCN1A Expression Using TANGO Technology for the Treatment of Dravet Syndrome. Molecular Therapy 22nd Annual Meeting of the American Society of Gene and Cell Therapy (ASGCT) 27(4):304-305 (2019).

(56) References Cited

OTHER PUBLICATIONS

Han, et al., "TANGO—Targeted Augmentation of Nuclear Gene Output for the Treatment of Genetic Diseases" Poster.
Han, Zhou, et al., Antisense Oligonucleotides increase Scn1a Expression and Reduce Seizures and SUDEP Incidence in a Mouse Model of Dravet Syndrome. Science Translational Medicine 12(558):eaaz6100,14 Pages (2020).
Han Zhou et al.: "Antisense-Mediated Increase of SCN1A Expression Using TANGO Technology for the Treatment of Dravet Syndrome", Molecular Therapy, vol. 27, No. 4, Suppl. 1, Apr. 22, 2019 (Apr. 22, 2019), pp. 304-305.
Havens, et al., "Targeting RNA Splicing fo rDisease Therapy" (2013) Wiley Interdiscip Rev RNA , 4(3): 247-266.
Hsiao, J. et al., "Upregulation of Haploinsufficient Gene Expression in the Brain by Targeting a Long Non-coding RNA Improves Seizure Phenotype in a Model of Dravet Syndrome," EBioMedicine, 2016, vol. 9, pp. 257-277.
Hug, et al., "Mechanism and regulation of the nonsense-mediated decay pathway", Nucleic Acids Research, 2016, vol. 44, No. 4 1483-1495.
International search report and written opinion dated Jun. 26, 2020 for PCT Application No. PCT/US20/20175.
International Search Report and Written Opinion for corresponding PCT application PCT/GB2016/053136 issued Jan. 19, 2017.
Khorkova et al., Oligonucleotide therapies for disorders of the nervous system. Nat Biotechnol. Mar. 2017;35(3):249-263. doi: 10.1038/nbt.3784. Epub Feb. 27, 2017. PMID: 28244991; PMCID: PMC6043900.
Kim, et al. "Reduced Sodium Channel nav1.1 Levels in BACE1-NULL Mice", JBC (2010) 1-21.
Kralovicova, et al., "Optimal antisense target reducing INS intron 1 retention is adjacent to a parallel G quadruplex" (2014) Nucleic Acids Research, v. 42, n.12, p. 8161-8173.
Kralovicova, et al., "Exon-Centric Regulation of ATM expression is population-dependent and amenable to antisense modification by pseudoexon targeting", Scientific Reports (2016) p. 1-13.
Kwong et al. Identification of SCN1A and PCDH19 Mutations in Chinese Children with Dravet Syndrome. PloS one, vol. 7, Issue, 7, Jul. 2012: e41802.
Laceerra, et al., "Restoration of hemoglobin A synthesis in erythroid cells from peripheral blood of thalassemic patients" (2000) PNAS, vol. 97, No. 17, pp. 9591-9596.
"Lagae, L. et al., "Quality of life and comorbidities associated with Dravet syndrome severity: a multinational cohort survey," Dev. Med. Child Neurol., 2018, vol. 60, No. 1, pp. 63-72".
Le Gal, et al., "A case of SUDEP in a patient with Dravet syndrome with SCNIA mutation" (2010) Epilepsia, 5199): 1915-1918.
LeFave, et al., "Splicing factor hnRNPH drives an oncogenic splicing switch in gliomas", (2011) The EMBO Journal, vol. 30, No. 19, pp. 4084-4097.
Levin, et al., "Treating Disease at the RNA Level with Oligonucleotides" (2019) The New England Journal of Medicine 380:57-70.
Liang, et al., "Translation efficiency of mRNAs is increased by antisnse oligonucleotides targeting upstream open reading frames" (2016) Nature Biotechnology, V. 34, N. 8, p. 875-882.
Lim, et al., "Antisense oligonucleotide modulation of non-productive alternative splicing upregulates gene expression" (2020) Nature Communication.
"Liu, Y. et al., "Dravet syndrome patient-derived neurons suggest a novel epilepsy mechanism," Ann Neurol., 2013, vol. 74, No. 1, pp. 128-139".
Lo, et al., "ATM polymorphisms and risk of lung cancer among never smokers", (2010) Lund Cancer 69, p. 148-154.
Maljevic, et al., "Models for discovery of targeted therapy in genetic epileptic encephalopathies", Journal of Neurochemistry (2017) Vo. 143, No. 1, pp. 30-48.
Mantegazza et al., Identification of a Nav1.1 sodium channel (SCN1A) loss-of-function mutation associated with familial simple febrile seizures, PNAS, Dec. 13, 2005, vol. 102, No. 50, p. 18177-18182.
Martinez-Losa, et al."Nav1.1-Overexpressing Interneuron Transplants Restore Brain Tyhthms and Cognition in a Mouse Model of Alzheimer's Disease", Neuron. Apr. 4, 2018; 98(1): 75-89.
"Meng, H. et al., "The SCN1A Mutation Database: Updating Information and Analysis of the Relationships among Genotype, Functional Alteration, and Phenotype," Hum Mutation, 2015, vol. 36, No. 6, pp. 573-580".
Menzi, et al., "Towards Improved Oligonucleotide Therapeutics Through Faster Target Binding Kinetics", (2017) ChemPubSoc Europe, 23, p. 14221-14230.
Minn; Alexandra H. et al.: Insulinomas and expression of an insulin splice variant. Lancet 363(9406):363-367 (2004). doi: 10.1016/S0140-6736(04)15438-X. Abstract.
Palhais, Bruno et al.: Splice-shifting oligonucleotide (SSO) mediated blocking of an exonic splicing enhancer (ESE) created by the prevalent c903+469TC MTRR mutation corrects splicing and restores enzyme activity in patient cells. Nucleic Acids Research 43(9):4627. 4639 (2015). https://doi.org/10.1093/nar/gkv275.
Parihar, et al., "The SCN1A gene variants and epileptic encephalophathies", Journal of Human Genetics (2013) 58, 573-580.
PCT/US2016/066708 International Preliminary Report on Patentability dated Jun. 28, 2018.
Raghavan, et al., "The spliceosomal U1 snRNP component Mud1 is autoregulated by promoting premature cleavage and polyadenylation of its own transcript", The Nineteenth Annual Meeting of the RNA Society.
"Ragona, F. et al., "Cognitive development in Dravet syndrome: A retrospective, multicenter study of 26 patients," Epilepsia, 2011, vol. 52, No. 2, pp. 386-392,".
Sazani, et al., "Therapeutic potential of antisense oligonucleotides as modulators of alternative splicing" (2003) The Journal of clinical Investigation, 112(4):481-486.
Scheffer, et al., "SCN1A-related pehnotypes: Epilepsy and beyond" Epilepsia (2019);60(s3):S17-S24.
Sierakowska, et al., Repair of thalassemic human B-globin mRNA in mammalian cells by antisense oligonucleotides. PNAS 93: 12840-4 (1996).
Smith, et al.: Nonsense-mediated RNA decay—a switch and dial for regulating gene expression. Bioessays 37(6): 612-623 (2015).
Supplemental European Search Report issued in corresponding EP application No. 18848036 issued Apr. 15, 2021.
Takeshima Y et al.: Modulation of in vitro splicing of the upstream intron by modifying an intra-exon sequence which is deleted from the dystrophin gene in dystrophin Kobe. The Journal of Clinical Investigation 95(2):515-20 (1995). doi: 10.1172/JCI117693.
Tsuchiya, Teizo et al.: Evidence for the Essential Role of Myosin Subfragment-2 in the ATP-Dependent Actin-Myosin Sliding in Muscle Contraction. The Japanese Journal of Physiology 48(5):383-387 (1998). https://doi.org/10.2170/jjphysiol.48.383.
Vacher, et al., "ATM has a major role in the double-strand break repair pathway dysregulation in sporadic breast carcinomas and is an independent prognostic marker at both mRNA and protein levels", (2015), Br J Cancer 112: 1059-1066.
Van Wart, et al., "Imparied Firing an dCell-Specific compensation in Neurons Lacking Navv1.6 sodium Channels" The Journal of Neuroscience, (2006), 26(27):7172-7180.
Vickers, et al., "Fully modified 2' MOE oligonucleotides redirect polyadenylation", Isis Pharmaceuticals, Department of Molecular and Structural Biology, Nucleic Acids Research, 2001, vol. 29, No. 6 p. 1293-1299.
Vorechovsky, "Modulating Splicing-Mediated gene expression using antisense technology", Southhampton.scuk/business.
Weiss, et al., "Sodium channels SCN1A, SCN2A, SCN3A in familial autism", (2003) 8, p. 186-194.
Zammarchi, et al. "Antitumorigenic potential of STAT3 alternative splicing modulation", (2011) PNAS, vol. 108, No. 43, pp. 17779-17784.
Office Action issued in European Patent Application No. 18871437.2 dated Sep. 12, 2023.

(56) References Cited

OTHER PUBLICATIONS

Abramova, Tatyana V. et al. Novel Oligonucleotide Analogues Based on Morpholino Nucleoside Subunits Antisense Technologies: New Chemical Possibilities. Indian Journal of Chemistry 48B:1721-1726 (2009).
Alanis, Eugenio F., et al., An exon-specific U1 small nuclear RNA (snRNA) strategy to correct splicing defects. Human Molecular Genetics 21(11):2389-2398 (2012). https://doi.org/10.1093/hmg/dds045.
Araujo et al.: Before It Gets Started: Regulating Translation at the 5' UTR. Comp Funct Genomics. 2012:475731 (2012) doi: 10.1155/2012/475731.
AU 2018322319 Examination Report No. 1 dated Oct. 16, 2020.
Boisguerin, P. et al. Delivery of therapeutic oligonucleotides with cell penetrating peptides. Advanced Drug Delivery Reviews 87:56-27 (2015).
Co-pending U.S. Appl. No. 18/658,390, inventors Aznarez; Isabel et al., filed May 8, 2024.
Co-pending U.S. Appl. No. 18/672,649, filed May 23, 2024.
Du, et al. "Correction of prototypic ATM splicing utations and aberrant ATM function with antisense morpholino oligonucleotides" (2007) PNAS, vol. 104, No. 14, pp. 6007-6012.
Gadgil, Ankur, et al., U7 snRNA: A tool for gene therapy. The Journal of Gene Medicine 23(4):e3321 (2021). https://doi.org/10.1002/jgm.3321.
Gong, Q. et al. Inhibition of nonsense-mediated mRNA decay by antisense morpholino oligonucleotides restores functional expression of hERG nonsense and frameshift mutations in long-QT syndrome. J Mol Cell Cardiol. 50(1):223-9 (2011).
Harris, et al. Single-molecule DNA sequencing of a viral genome. Science 320(5872):106-9 (2008).
Huppert et al. Prevalence of quadruplexes in the human genome. Nucleic Acids Res. 33(9):2908-16 (2005).
International Preliminary Report on Patentability issued in PCT/US2021/030254, dated Nov. 15, 2022.
International Search Report and Written Opinion issued in PCT/US2021/030254, mailed Jul. 28, 2021.
Koizumi, Makoto. ENA Oligonucleotides as Therapeutics. Current Opinion in Molecular Therapeutics 8(2):144-149 (2006).
Kralovicova, et al. Global control of aberrant splice-site activation by auxiliary splicing sequences: evidence for a gradient in exon and intron definition, (2007) Nucleic Acids Research, v. 35, n. 19, p. 6399-6413.
Kuzmiak, HA. et al. Applying nonsense-mediated mRNA decay research to the clinic: progress and challenges. Trends Mol Med. 12(7):306-16 (2006).
Lenaers, G. et al. Dominant optic atrophy, Orphanet J Rare Diseases, 2012, vol. 7, No. 46, pp. 1-12.
Lochmann, D. et al. Drug delivery of oligonucleotides by peptides. European Journal of Pharmaceutics and Biopharmaceutics 58: 237-251 (2004).
Margulies et al. Genome sequencing in microfabricated high-density picolitre reactors. Nature. 437(7057):376-380 (2005).
Martin, L et al. Identification and characterization of small molecules that inhibit nonsense-mediated RNA decay and suppress nonsense p53 mutations. Cancer Res. 74(11):3104-13 (2014).
Meyer et al.: Antisense Derivatives of U7 Small Nuclear RNA as Modulators of Pre-mRNA Splicing. Alternative pre-mRNA Splicing: Theory and Protocols (2012). https://doi.org/10.1002/9783527636778.ch45.
Michaels, W. et al. Antisense oligonucleotide-mediated correction of CFTR splicing improves chloride secretion in cystic fibrosis patient-derived bronchial epithelial cells. Nucleic Acids Research 48(13): 7454-7467 (2020).
Mishra et al. G4IPDB: A database for G-quadruplex structure forming nucleic acid interacting proteins. Sci Rep. 6:38144 pp. 1-9 (2016).
Obika, et al. Synthesis of 2'-O,4'-C-methyleneuridine and -cytidine. Novel bicyclic nucleosides having a fixed C3, -endo sugar puckering. Tetrahedron Letters 38 (50): 8735 (1997).
Ogiwara, Ikuo et al. Nav1.1 Localizes to Axons of Parvalbumin-Positive Inhibitory Interneurons: A Circuit Basis for Epileptic Seizures in Mice Carrying an Scn1a Gene Mutation. The Journal of Neuroscience 27(22):5903-5914 (2007).
PCT/US2020/063157 International Search Report and Written Opinion dated Mar. 10, 2021.
PCT/US2021/030254 International Search Report and Written Opinion dated Jul. 28, 2023.
PCT/US2022/049318 International Search Report and Written Opinion dated Mar. 4, 2024 (Pub. No. WO2023086342).
PCT/US2023/029040 International Search Report and Written Opinion dated Feb. 16, 2024.
PCT/US2024/015838 International Search Report and Written Opinion dated Sep. 3, 2024.
Popp, MW et al. Attenuation of nonsense-mediated mRNA decay facilitates the response to chemotherapeutics. Nat Commun. 6(6632): 1-32 (2015).
Sazani, et al. Splice Switching Oligonucleotides as Potential Therapeutics, Antisense Drug Technology, Second Edition, p. 90-114.
Scheffer, Ingrid E. Diagnosis and Long-term Course of Dravet Syndrome. European Journal of Paediatric Neurology 16(Suppl 1):S5-S8 (2012).
Singh et al. Encyclopedia of Pharmaceutical Technology 2nd Ed. pp. 751-753 (2002).
Stefanovic et al. Assemble, nuclear import and function of U7 snRNPs studied by microinjection of synthetic U7 RNA into Xenopus oocytes. Nucleic Acids Research 23(16):3141-3151 (1995). https://doi.org/10.1093/nar/23.16.3141.
Stoke Therapeutics Presents Data from the Phase 1/2a Monarch Study of STK-001 in Children and Adolescents with Dravet Syndrome at the American Epilepsy Society (AES) 2021 Annual Meeting. Stoke Therapeutics. American Epilepsy Society (AES) 2021 Annual Meeting: 1-3 (2021).
The AON based uORF blockage in the expression of OPA1—a pre-clinical development of therepy for OPA1-linked optic atrophy, Wissinger Lab, Molecular Genetics Laboratory, Web page http://www.eye-tuebingen.de/wissinger/lab/members/ting-xiao/, 3 pages, Oct. 22, 20109, retrieved from Internet Archive Wayback Machine https://web.archive.org/web/20191022233241/ http://www.eye-tuebingen.de/wissinger/lab/members/ting-xiao/ on Jun. 7, 2022.
Tilgner, H. et al. Deep sequencing of subcellular RNA fractions shows splicing to be predominantly co-transcriptional in the human genome but inefficient for IncRNAs, Genome Research, 2012, vol. 22, No. 9, pp. 1616-1625.
Todd et al. Highly prevalent putative quadruplex sequence motifs in human DNA. Nucleic Acids Res. 33(9):2901-7 (2005).
U.S. Appl. No. 16/561,960 Pre-Interview First Office Action Mailed Dec. 19, 2019.
U.S. Appl. No. 17/924,966 Restriction Requirement dated Jun. 27, 2024.
Venkatesh, A. et al. Antisense oligonucleotide mediated increase of OPA1 expression using TANGO technology for the treatment of autosomal dominant optic atrophy, Molecular Therapy, 2020, vol. 28, No. 4S1.
Venkatesh, Aditya, Antisense oligonucleotide mediated increase of OPA1 expression using TANGO technology for the treatment of autosomal dominant optic atrophy. Stoke Therapeutics. Association for Research in Vision & Ophthalmology Meeting 2020.
Wagnon, J. TANGO With SCNIA: Can This Molecular Dance Defeat Dravet Syndrome? Epilpesy Currents 21(1):60-61 (2021).
Wang, AG et al., OPA1 expression in the human retina and optic nerve, Exp Eye Res 83(5): 1171-1178 (2006).
Wang, W. et al. The developmental changes of Na(v) 1.1 and Na(v)1.2 expression in the human hippocampus and temporal lobe, Brain Res 1389:61-70 (2011).
Wu, Y. et al. Incidence of Dravet Syndrome in a US Population. Pediatrics 136(5): e1310-e1315 (2015).
Co-pending U.S. Appl. No. 19/035,483, inventor Aznarez; Isabel, filed on Jan. 23, 2025.
Co-pending U.S. Appl. No. 19/236,584, inventors Vorechovsky; Igor et al., filed Jun. 12, 2025.

(56) References Cited

OTHER PUBLICATIONS

Doench, John G. et al. Optimized sgRNA Design to Maximize Activity and Minimize Off-target Effects of CRISPR-Cas9. Nature Biotechnology 34(2):184-191 (2016).
Ferenchak, Kevin et al. Antisense Oligonucleotide Therapy for Ophthalmic Conditions. Seminars in Ophthalmology 36(5-6):452-457 (2021).
Gagliardi, Maria, and Ana Tari Ashizawa. The Challenges and Strategies of Antisense Oligonucleotide Drug Delivery. Biomedicines 9(4):433, 1-18 (2021).
Jeong, J.H. et al. Anti-GAD antibody targeted non-viral gene delivery to islet beta cells. J Control Release. 107(3): 562-700 (2005).
Mignot, Cyril et al.: Genetic and neurodevelopmental spectrum of SYNGAP1-associated intellectual disability and epilepsy. J. Med. Genet. 53:511-522 (2016). doi:10.1136/jmedgenet-2015-103451.
OPA1 genereviews-A comprehensive review of the OPA1 gene and its association with human diseases, pages Science of Bio Genetics, retrieved on-line Apr. 2, 2025 Genetics https://genethics.ca, pp. 1-47 (Year: 2023).
Prchalova, Darina et al.: Analysis of 31-year-old patient with SYNGAP1 gene defect points to importance of variants in broader splice regions and reveals developmental trajectory of SYNGAP1-associated phenotype: case report. BMC Medical Genetics 18:62 (2017). DOI 10.1186/s12881-017-0425-4.
Sciezynska, Aneta et al. Processing of OPA1 with a Novel N-terminal Mutation in Patients with Autosomal Dominant Optic Atrophy: Escape from Nonsense-mediated Decay. PLoS One 12(8):e0183866, 1-9 (2017).
Soni, G. et al. Progress toward ultrafast DNA sequencing using solid-state nanopores. Clin Chem. 53(11): 1996-2001 (2007).
U.S. Appl. No. 14/741,071 Notice of Allowance dated May 12, 2017.
U.S. Appl. No. 16/561,960 Notice of Allowance dated Apr. 22, 2020.
U.S. Appl. No. 17/924,966 Notice of Allowance dated Mar. 26, 2025.
U.S. Appl. No. 18/483,333 Office Action dated May 19, 2025.
Venkatesh, A. et al., “Antisense oligonucleotide mediated increase of OPA1 expression using TANGO technology for the treatment of autosomal dominant optic atrophy,” ARVO Annual Meeting (Abrstract), 2020, vol. 61, No. 2755.
Boehm et al.: Exon Junction Complexes Suppress Spurious Splice Sites to Safeguard Transcriptome Integrity. Molecular Cell 72(3):P482-495.E7 (2018). doi: 10.1016/j.molcel.2018.08.030.
Chen, Hong-Jung et al. A synaptic Ras-GTPase activating protein (P135 SynGAP) inhibited by CaM kinase II. Neuron 20(5):895-904 (1998).
Frazier, Kendall S. Antisense oligonucleotide therapies. Toxicologic Pathology 43(1):78-89 (2014).
Fu, et al. Context-dependent control of alternative splicing by RNA-binding proteins. Genetics, vol. 15, (2014) p. 689-701.
Ge, Y. et al. The functional consequences of intron retention: alternative splicing coupled to NMD as a regulator of gene expression. BioEssays 36(3): 236-243 (2013).
Gerard et al.: Intravitreal Injection of Splice-switching Oligonucleotides to Manipulate Splicing in Retinal Cells. Molecular Therapy Nucleic Acids 4:E250 (2015). DOI:https://doi.org/10.1038/mtna.2015.24.
Havens, Mallory A., and Michelle L. Hastings. Splice-switching antisense oligonucleotides as therapeutic drugs. Nucleic Acids Research 44(14):6549-6563 (2016).
Kralovicova, J. et al., Global control of aberrant splice-site activation by auxiliary splicing sequences: evidence for a gradient in exon and intron definition. Nucleic Acids Research 35(19):6399-6413 (2007). https://doi.org/10.1093/nar/gkm680.
Lim, et al. TANGO (Targeted Augmentation of Nuclear Gene Output) for the Treatment of Genetic Diseases. Cold Spring Harbor Meeting on Eukaryotic mRNA Processing, Aug. 20-24, 2019 (Abstract).
McGlincy, Nicholas J. and Christopher W. J. Smith. Alternative splicing resulting in nonsense-mediated mRNA decay: what is the meaning of nonsense?. Trends in Biochemical Sciences 33(8):385-393 (2008).
Muslehiddinoglu, J. et al. Technical Considerations for Use of Oligonucleotide Solution API. Nucleic Acid Therapeutics. 30(4):189-197, (2020).
No Author, “Stoke Therapeutics Announces Publication of Data in the Journal Nature Communications That Support the Company’s Proprietary Approach to Addressing Severe Genetic Diseases by Precisely Upregulating Protein Expression” Retrieved from https://www.businesswire.com/news/home/20200709005385/en/Stoke-Therapeutics-Announces-Publication-of-Data-in-the-Journal-Nature-Communications-That-Support-the-Company%E2%80%99s-Proprietary-Approach-to-Addressing-Severe-Genetic-Diseases-by-Precisely-Upregulating-Protein-Expression.
Sazani, Peter et al. Abstract: Splice Switching Oligonucleotides as Potential Therapeutics. Antisense Drug Technology, Edition 2nd Edition. CRC Press, chapter 4, 26 Pages (2007). Accessed at https://www.taylorfrancis.com/books/edit/10.1201/9780849387951/antisense-drug-technology-stanley-crooke?refld=7edadcf9-9c8f-44bc-9672-37385a26bac2&context=ubx.
Sibley et al. Lessons from non-canonical splicing. Nat Rev Genet. 17(7):407-421 (2016). doi: 10.1038/nrg.2016.46. Epub May 31, 2016.
Staiger et al. Enter exitrons. Genome Biol. 16(1):136 (2015). doi: 10.1186/s13059-015-0704-3.
Wang et al. Mechanism of alternative splicing and its regulation. Biomedical Reports 3(2):152-158 (2014).
Yang, R. et al. Upregulation of SYNGAP1 expression in mice and human neurons by redirecting alternative splicing, Neuron, 2023, vol. 111, pp. 1-14.
Biliouris, K. et al., A Semi-Mechanistic Population Pharmacokinetic Model of Nusinersen: An Antisense Oligonucleotide for the Treatment of Spinal Muscular Atrophy. CPT Pharmacometrics Syst Pharmacol 7(9):581-592 (2018).
Brown, P., Pharmacology Review (Nusinersen), Center for Drug Evaluation and Research. Available at URL: https://www.accessdata.fda.gov/drugsatfda_docs/nda/2016/209531Orig1s000PharmR.pdf pp. 1-90 (2016).
FDA. Integrated review (Tofersen). Available at URL: https://www.accessdata.fda.gov/drugsatfda_docs/nda/2023/215887Orig1s000IntegratedR.pdf pp. 1-135 (2023).
Kouzehgarani, G. et al., Harnessing cerebrospinal fluid circulation for drug delivery to brain tissues. Adv Drug Deliv Rev 173:20-59 (2021).
Metz, T. et al., Biodistribution of Radioactively Labeled Splice Modulating Antisense Oligonucleotides After Intracerebroventricular and Intrathecal Injection in Mice. Nucleic Acid Ther 34(1):26-34 (2024).
Monine, M. et al., A physiologically-based pharmacokinetic model to describe antisense oligonucleotide distribution after intrathecal administration. Journal of Pharmacokinetics and Pharmacodynamics 48:639-654 (2021).
Parker, D. et al. Pharmacogenetics of antiepileptic drugs: A brief review. The mental health clinician 6(1):28-34 (2016).
Rigo, F. et al., Pharmacology of a central nervous system delivered 2'-O-methoxyethyl-modified survival of motor neuron splicing oligonucleotide in mice and nonhuman primates. J Pharmacol Exp Ther 350(1):46-55 (2014).
Vuillemenot, B. et al., Safety Evaluation of CNS Administered Biologics-Study Design, Data Interpretation, and Translation to the Clinic. Toxicol Sci 152(1):3-9 (2016).
World Health Organization, Who Drug Information. 35(2):270-604 (2021); relevant page is p. 576.
Yamamoto, Y et al., Development of a population pharmacokinetic model to characterize the pharmacokinetics of intrathecally administered tominersen in cerebrospinal fluid and plasma. CPT Pharmacometrics Syst Pharmacol 12(9):1213-1226 (2023).
Yin, W. et al., Targeting RNA: A Transformative Therapeutic Strategy. Clin Transl Sci 12(2):98-112 (2019).

gcccagactggtggcccaccgagtcctccagccccaaatgtctctgcctgtcaacaccttgcatcctccagccccacaagccattctaatctccttct
agGAACAGAACTGGCAAAGAGGCAAGAGGTCACTGAGGGCCTCTGTCACCCAGgtgaggacctgagccaagcttcagctctgggtgtggcagaagcag
gtggggccatgattgctttgggaggggcccagcagcgcccagcctgacccagatt GRCh38/hg38: chr2 148505761 148505830 gtagattatttactcttctttctacccataatgtgaaaaattcctgaaaaataacgaagaaagaatttttaaaatgacaaagatttgactacttttgt
agACTGAGGGGAAGAAGAAAAGAGGAAAAGGCTGAAAAAGGAAGGTGTCATTTGGAGCAAGATAATTAAGAGgttggtttttcacctggactcaagtc
ctgtttctaccacttcatagctgtgtgttcgtaatctccctgggcctaaattcttcatttctaaaatgggcata

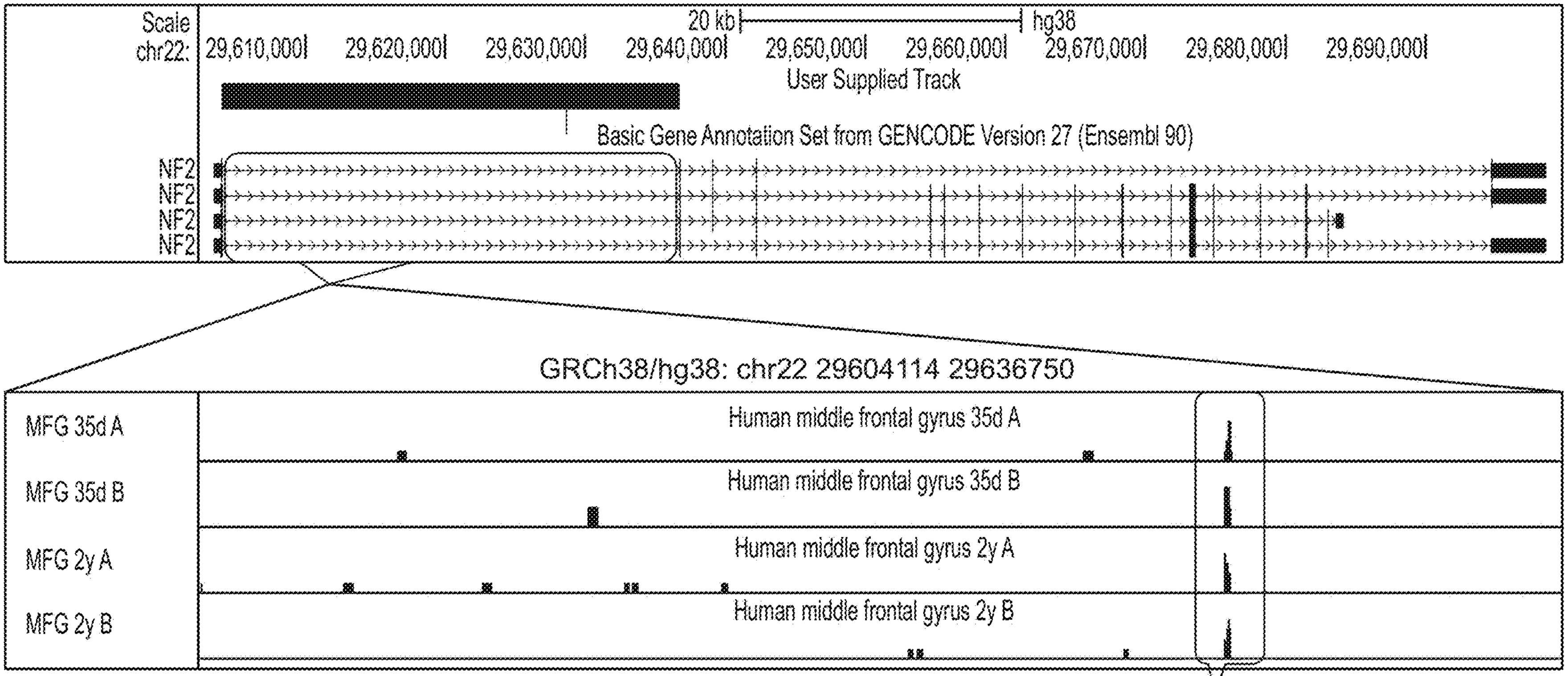

GRCh38/hg38: chr22 29628658 29628773 cagaaactgacagggcaagagattacagttgggatttttgcaaagaggagctttcaagtttgtgacatcttttttttttttttttttttttttgagata
gTCTTGCTCTGTCACCCTAGCTGGAGTGCAGTGGCGTGATCTTGGTTTACTGCAACCTCTGCCTCCCAAGTTCAAGCGATTCTCCTGCCTCAGCTTCCC
AAGTAGCTGGGACTACAGgtatgcgccaccacgcccaactagttttgtatttttagtagagacggggtttcaccatgttggccaggctggtctcgaac
tcctgacctcaggtgatcc

FIG. 39

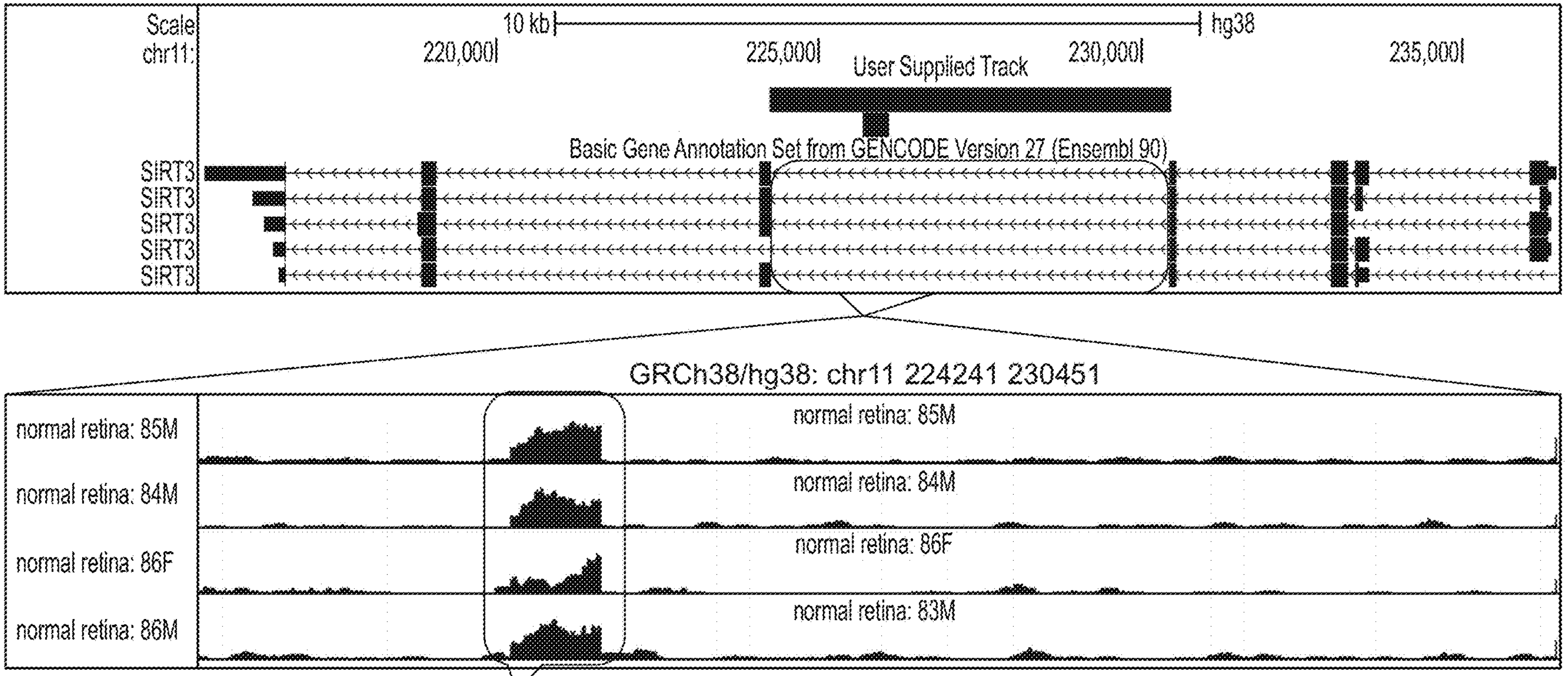

GRCh38/hg38: chr11 225673 226081 cttcccagatacagattaaagacaagatgagattaatggttccttcacccttccctgagaggtctgcttagttctcttcctctgtttccttctatctta
gGTAAAATGTACATTTACTGGGCACTTACTGAAGTCTCACAAGTACGTAACCACTCACCTCACAGCCACCCTCCCTCTTTGAAGGACCACATGTAATTA
CTAAACCTCCTGAGAACCTCTTGGGACAGAAACAAGCACAGATGTGCCGTGACTCATGTTTTTCCTGTGGCACCCTCAGGCTGGCTCAGTAGCCCTCA
CTTGCTTGAGATCCTGAATCTGCGGGTTGGCGTCTTTCATGGTTGCTGGATCATACTCTGCCGTTATCTCTTCGGATATGAGTTGCCCCTAGCCCACTA
TCTGGCCCCTCTCTTTAGGGACCTCTGATTGAACATACATTAGACCTTCTCTCTCCTGCTGTTCCTGATCACTCTTCTGTCCTGTAATTGCTGCTTCTT
GTGCTGCATTCTGGgtaatttcttctggtcttttttccagtttactaatattgtattctgttataaggtccttccattgagtgtttctttctttctttt
ttcccaaacagcaac

FIG. 42 n=2
Taqman qPCR
HEK293 cells
ASO: 80 nM
Transfection: 24 hrs

ANTISENSE OLIGOMERS FOR TREATMENT OF NON-SENSE MEDIATED RNA DECAY BASED CONDITIONS AND DISEASES

CROSS-REFERENCE

This application is a divisional application of U.S. application Ser. No. 16/758,776, filed Apr. 23, 2020, which is a U.S. National Stage entry under 35 U.S.C. § 371 of International Application No. PCT/US2018/057165, filed Oct. 23, 2018, which claims the benefit of U.S. Provisional Application No. 62/575,924, filed on Oct. 23, 2017, and U.S. Provisional Application No. 62/667,200, filed on May 4, 2018, each of which is incorporated herein by reference in its entirety.

SEQUENCE LISTING

The instant application contains a Sequence Listing which has been submitted electronically in XML format and is hereby incorporated by reference in its entirety. Said XML copy, created on Oct. 3, 2023, is named 47991-721401.xml and is 11,788,995 bytes in size.

BACKGROUND

Alternative splicing events in genes can lead to non-productive mRNA transcripts which in turn can lead to aberrant protein expression, and therapeutic agents which can target the alternative splicing events in genes can modulate the expression level of functional proteins in patients and/or inhibit aberrant protein expression. Such therapeutic agents can be used to treat a condition or disease caused by protein deficiency.

SUMMARY

Described herein, in certain embodiments, is a method of modulating expression of a target protein, by a cell having an mRNA that comprises a non-sense mediated RNA decay-inducing exon (NMD exon) and encodes the target protein, the method comprising contacting a therapeutic agent to the cell, whereby the therapeutic agent modulates splicing of the NMD exon from the mRNA, thereby modulating level of processed mRNA encoding the target protein, and modulating the expression of the target protein in the cell, wherein the target protein is selected from the group consisting of: AKT3, CACNA1A, CBS, CD46, CFH, CHD2, CLN3, COL11A2, COL4A3, COL4A4, COL4A4, CR1, CRX, CYP2J2, DHDDS, DNAJC8, EIF2AK3, ERN1, GALE, GUCY2F, GUCY2F, HEXA, HEXA, MAPK3, MBD5, MBD5, MBD5, MUT, MYH14, MYO6, NF1, NF2, NIPBL, NR1H4, NSD1, NSD1, NSD1, NSD1, OPA1, OPA1, PCCA, PKP2, PPARA, PRPF3, PRPF3, SCN2A, SCN8A, SCN8A, SCN9A, SEMA3C, SEMA3D, SIRT3, STK11, STK11, SYNGAP1, TOPORS, and VCAN proteins.

Described herein, in certain embodiments, is a method of treating a disease or condition in a subject in need thereof by modulating expression of a target protein in a cell of the subject, comprising: contacting the cell of the subject with a therapeutic agent that modulates splicing of a non-sense mediated mRNA decay-inducing exon (NMD exon) from an mRNA in the cell, wherein the mRNA comprises the NMD exon and encodes the target protein, thereby modulating level of processed mRNA encoding the target protein, and modulating expression of the target protein in the cell of the subject, wherein the target protein is selected from the group consisting of: AKT3, CACNA1A, CBS, CD46, CFH, CHD2, CLN3, COL11A2, COL4A3, COL4A4, COL4A4, CR1, CRX, CYP2J2, DHDDS, DNAJC8, EIF2AK3, ERN1, GALE, GUCY2F, GUCY2F, HEXA, HEXA, MAPK3, MBD5, MBD5, MBD5, MUT, MYH14, MYO6, NF1, NF2, NIPBL, NR1H4, NSD1, NSD1, NSD1, NSD1, OPA1, OPA1, PCCA, PKP2, PPARA, PRPF3, PRPF3, SCN2A, SCN8A, SCN8A, SCN9A, SEMA3C, SEMA3D, SIRT3, STK11, STK11, SYNGAP1, TOPORS, and VCAN proteins.

In some embodiments, the therapeutic agent: (a) binds to a targeted portion of the mRNA encoding the target protein; (b) modulates binding of a factor involved in splicing of the NMD exon; or (c) a combination of (a) and (b).

In some embodiments, the therapeutic agent interferes with binding of the factor involved in splicing of the NMD exon to a region of the targeted portion. In some embodiments, the targeted portion is proximal to the NMD exon. In some embodiments, the targeted portion is at most about 1500 nucleotides, about 1000 nucleotides, about 800 nucleotides, about 700 nucleotides, about 600 nucleotides, about 500 nucleotides, about 400 nucleotides, about 300 nucleotides, about 200 nucleotides, about 100 nucleotides, about 80 nucleotides, about 70 nucleotides, about 60 nucleotides, about 50 nucleotides upstream of 5' end of the NMD exon. In some embodiments, the targeted portion is at least about 1500 nucleotides, about 1000 nucleotides, about 800 nucleotides, about 700 nucleotides, about 600 nucleotides, about 500 nucleotides, about 400 nucleotides, about 300 nucleotides, about 200 nucleotides, about 100 nucleotides, about 80 nucleotides, about 70 nucleotides, about 60 nucleotides, about 50 nucleotides, about 40 nucleotides, about 30 nucleotides, about 20 nucleotides, about 10 nucleotides, about 5 nucleotides, about 4 nucleotides, about 2 nucleotides, about 1 nucleotides upstream of 5' end of the NMD exon. In some embodiments, the targeted portion is at most about 1500 nucleotides, about 1000 nucleotides, about 800 nucleotides, about 700 nucleotides, about 600 nucleotides, about 500 nucleotides, about 400 nucleotides, about 300 nucleotides, about 200 nucleotides, about 100 nucleotides, about 80 nucleotides, about 70 nucleotides, about 60 nucleotides, about 50 nucleotides downstream of 3' end of the NMD exon. In some embodiments, the targeted portion is at least about 1500 nucleotides, about 1000 nucleotides, about 800 nucleotides, about 700 nucleotides, about 600 nucleotides, about 500 nucleotides, about 400 nucleotides, about 300 nucleotides, about 200 nucleotides, about 100 nucleotides, about 80 nucleotides, about 70 nucleotides, about 60 nucleotides, about 50 nucleotides, about 40 nucleotides, about 30 nucleotides, about 20 nucleotides, about 10 nucleotides, about 5 nucleotides, about 4 nucleotides, about 2 nucleotides, about 1 nucleotides downstream of 3' end of the NMD exon.

In some embodiments, the targeted portion is at most about 1500 nucleotides, about 1000 nucleotides, about 800 nucleotides, about 700 nucleotides, about 600 nucleotides, about 500 nucleotides, about 400 nucleotides, about 300 nucleotides, about 200 nucleotides, about 100 nucleotides, about 80 nucleotides, about 70 nucleotides, about 60 nucleotides, about 50 nucleotides upstream of genomic site selected from the group consisting of: GRCh38/hg38: chr1 243564388; GRCh38/hg38: chr19 13236618; GRCh38/hg38: chr21 43060012; GRCh38/hg38: chr1 207775610; GRCh38/hg38: chr1 196675450; GRCh38/hg38: chr15 92998149; GRCh38/hg38: chr16 28479765; GRCh38/hg38: chr6 33183698; GRCh38/hg38: chr2 227296487; GRCh38/hg38: chr2 227144833; GRCh38/hg38: chr2 227015360;

GRCh38/hg38: chr1 207637688; GRCh38/hg38: chr19 47835403; GRCh38/hg38: chr1 59904516; GRCh38/hg38: chr1 26442335; GRCh38/hg38: chr1 28230252; GRCh38/hg38: chr2 88582824; GRCh38/hg38: chr17 64102804; GRCh38/hg38: chr1 23798484; GRCh38/hg38: chrX 109383446; GRCh38/hg38: chrX 109439175; GRCh38/hg38: chr15 72362466; GRCh38/hg38: chr15 72345776; GRCh38/hg38: chr16 30115645; GRCh38/hg38: chr2 148460219; GRCh38/hg38: chr2 148490695; GRCh38/hg38: chr2 148505761; GRCh38/hg38: chr6 49436597; GRCh38/hg38: chr19 50230825; GRCh38/hg38: chr6 75867431; GRCh38/hg38: chr17 31249955; GRCh38/hg38: chr22 29628658; GRCh38/hg38: chr5 37048127; GRCh38/hg38: chr12 100499841; GRCh38/hg38: chr5 177169394; GRCh38/hg38: chr5 177200761; GRCh38/hg38: chr5 177247924; GRCh38/hg38: chr5 177275947; GRCh38/hg38: chr3 193628509; GRCh38/hg38: chr3 193603500; GRCh38/hg38: chr13 100305751; GRCh38/hg38: chr12 32894778; GRCh38/hg38: chr22 46203575; GRCh38/hg38: chr150327557; GRCh38/hg38: chr1 150330401; GRCh38/hg38: chr2 165327155; GRCh38/hg38: chr12 51688758; GRCh38/hg38: chr12 51780202; GRCh38/hg38: chr2 166304329; GRCh38/hg38: chr7 80794957; GRCh38/hg38: chr7 85059541; GRCh38/hg38: chr11 226081; GRCh38/hg38: chr19 1216268; GRCh38/hg38: chr19 1221621; GRCh38/hg38: chr6 33448789; GRCh38/hg38: chr9 32551469; and GRCh38/hg38: chr5 83544965.

In some embodiments, the targeted portion is about 1500 nucleotides, about 1000 nucleotides, about 800 nucleotides, about 700 nucleotides, about 600 nucleotides, about 500 nucleotides, about 400 nucleotides, about 300 nucleotides, about 200 nucleotides, about 100 nucleotides, about 80 nucleotides, about 70 nucleotides, about 60 nucleotides, about 50 nucleotides upstream of genomic site selected from the group consisting of: GRCh38/hg38: chr1 243564388; GRCh38/hg38: chr19 13236618; GRCh38/hg38: chr21 43060012; GRCh38/hg38: chr1 207775610; GRCh38/hg38: chr1 196675450; GRCh38/hg38: chr15 92998149; GRCh38/hg38: chr16 28479765; GRCh38/hg38: chr6 33183698; GRCh38/hg38: chr2 227296487; GRCh38/hg38: chr2 227144833; GRCh38/hg38: chr2 227015360; GRCh38/hg38: chr1 207637688; GRCh38/hg38: chr19 47835403; GRCh38/hg38: chr1 59904516; GRCh38/hg38: chr1 26442335; GRCh38/hg38: chr1 28230252; GRCh38/hg38: chr2 88582824; GRCh38/hg38: chr17 64102804; GRCh38/hg38: chr1 23798484; GRCh38/hg38: chrX 109383446; GRCh38/hg38: chrX 109439175; GRCh38/hg38: chr15 72362466; GRCh38/hg38: chr15 72345776; GRCh38/hg38: chr16 30115645; GRCh38/hg38: chr2 148460219; GRCh38/hg38: chr2 148490695; GRCh38/hg38: chr2 148505761; GRCh38/hg38: chr6 49436597; GRCh38/hg38: chr19 50230825; GRCh38/hg38: chr6 75867431; GRCh38/hg38: chr17 31249955; GRCh38/hg38: chr22 29628658; GRCh38/hg38: chr5 37048127; GRCh38/hg38: chr12 100499841; GRCh38/hg38: chr5 177169394; GRCh38/hg38: chr5 177200761; GRCh38/hg38: chr5 177247924; GRCh38/hg38: chr5 177275947; GRCh38/hg38: chr3 193628509; GRCh38/hg38: chr3 193603500; GRCh38/hg38: chr13 100305751; GRCh38/hg38: chr12 32894778; GRCh38/hg38: chr22 46203575; GRCh38/hg38: chr1 150327557; GRCh38/hg38: chr1 150330401; GRCh38/hg38: chr2 165327155; GRCh38/hg38: chr12 51688758; GRCh38/hg38: chr12 51780202; GRCh38/hg38: chr2 166304329; GRCh38/hg38: chr7 80794957; GRCh38/hg38: chr7 85059541; GRCh38/hg38: chr11 226081; GRCh38/hg38: chr19 1216268; GRCh38/hg38: chr19 1221621; GRCh38/hg38: chr6 33448789; GRCh38/hg38: chr9 32551469; and GRCh38/hg38: chr5 83544965.

In some embodiments, the targeted portion is at most about 1500 nucleotides, about 1000 nucleotides, about 800 nucleotides, about 700 nucleotides, about 600 nucleotides, about 500 nucleotides, about 400 nucleotides, about 300 nucleotides, about 200 nucleotides, about 100 nucleotides, about 80 nucleotides, about 70 nucleotides, about 60 nucleotides, about 50 nucleotides downstream of genomic site selected from the group consisting of: GRCh38/hg38: chr1 243564285; GRCh38/hg38: chr19 13236449; GRCh38/hg38: chr21 43059730; GRCh38/hg38: chr1 207775745; GRCh38/hg38: chr1 196675529; GRCh38/hg38: chr15 92998261; GRCh38/hg38: chr16 28479644; GRCh38/hg38: chr6 33183634; GRCh38/hg38: chr2 227296526; GRCh38/hg38: chr2 227144653; GRCh38/hg38: chr2 227015283; GRCh38/hg38: chr1 207637848; GRCh38/hg38: chr19 47835579; GRCh38/hg38: chr1 59904366; GRCh38/hg38: chr1 26442372; GRCh38/hg38: chr1 28230131; GRCh38/hg38: chr2 88582755; GRCh38/hg38: chr17 64102673; GRCh38/hg38: chr1 23798311; GRCh38/hg38: chrX 109383365; GRCh38/hg38: chrX 109439038; GRCh38/hg38: chr15 72362376; GRCh38/hg38: chr15 72345677; GRCh38/hg38: chr16 30115595; GRCh38/hg38: chr2 148460304; GRCh38/hg38: chr2 148490787; GRCh38/hg38: chr2 148505830; GRCh38/hg38: chr6 49436522; GRCh38/hg38: chr19 50230999; GRCh38/hg38: chr6 75867523; GRCh38/hg38: chr17 31250125; GRCh38/hg38: chr22 29628773; GRCh38/hg38: chr5 37048354; GRCh38/hg38: chr12 100500024; GRCh38/hg38: chr5 177169559; GRCh38/hg38: chr5 177200783; GRCh38/hg38: chr5 177248079; GRCh38/hg38: chr5 177276101; GRCh38/hg38: chr3 193628616; GRCh38/hg38: chr3 193603557; GRCh38/hg38: chr13 100305834; GRCh38/hg38: chr12 32894516; GRCh38/hg38: chr22 46203752; GRCh38/hg38: chr1 150327652; GRCh38/hg38: chr1 150330498; GRCh38/hg38: chr2 165327202; GRCh38/hg38: chr12 51688849; GRCh38/hg38: chr12 51780271; GRCh38/hg38: chr2 166304238; GRCh38/hg38: chr7 80794854; GRCh38/hg38: chr7 85059498; GRCh38/hg38: chr11 225673; GRCh38/hg38: chr19 1216398; GRCh38/hg38: chr19 1221846; GRCh38/hg38: chr6 33448868; GRCh38/hg38: chr9 32551365; and GRCh38/hg38: chr5 83545070.

In some embodiments, the targeted portion is about 1500 nucleotides, about 1000 nucleotides, about 800 nucleotides, about 700 nucleotides, about 600 nucleotides, about 500 nucleotides, about 400 nucleotides, about 300 nucleotides, about 200 nucleotides, about 100 nucleotides, about 80 nucleotides, about 70 nucleotides, about 60 nucleotides, about 50 nucleotides downstream of genomic site selected from the group consisting of: GRCh38/hg38: chr1 243564285; GRCh38/hg38: chr19 13236449; GRCh38/hg38: chr21 43059730; GRCh38/hg38: chr1 207775745; GRCh38/hg38: chr1 196675529; GRCh38/hg38: chr15 92998261; GRCh38/hg38: chr16 28479644; GRCh38/hg38: chr6 33183634; GRCh38/hg38: chr2 227296526; GRCh38/hg38: chr2 227144653; GRCh38/hg38: chr2 227015283; GRCh38/hg38: chr1 207637848; GRCh38/hg38: chr19 47835579; GRCh38/hg38: chr1 59904366; GRCh38/hg38: chr1 26442372; GRCh38/hg38: chr1 28230131; GRCh38/hg38: chr2 88582755; GRCh38/hg38: chr17 64102673; GRCh38/hg38: chr1 23798311; GRCh38/hg38: chrX 109383365; GRCh38/hg38: chrX 109439038; GRCh38/hg38: chr15 72362376; GRCh38/hg38: chr15 72345677; GRCh38/hg38: chr16 30115595; GRCh38/hg38: chr2 148460304; GRCh38/hg38: chr2 148490787; GRCh38/hg38: chr2 148505830; GRCh38/hg38: chr6 49436522;

GRCh38/hg38: chr19 50230999; GRCh38/hg38: chr6 75867523; GRCh38/hg38: chr17 31250125; GRCh38/hg38: chr22 29628773; GRCh38/hg38: chr5 37048354; GRCh38/hg38: chr12 100500024; GRCh38/hg38: chr5 177169559; GRCh38/hg38: chr5 177200783; GRCh38/hg38: chr5 177248079; GRCh38/hg38: chr5 177276101; GRCh38/hg38: chr3 193628616; GRCh38/hg38: chr3 193603557; GRCh38/hg38: chr13 100305834; GRCh38/hg38: chr12 32894516; GRCh38/hg38: chr22 46203752; GRCh38/hg38: chr1 150327652; GRCh38/hg38: chr1 150330498; GRCh38/hg38: chr2 165327202; GRCh38/hg38: chr12 51688849; GRCh38/hg38: chr12 51780271; GRCh38/hg38: chr2 166304238; GRCh38/hg38: chr7 80794854; GRCh38/hg38: chr7 85059498; GRCh38/hg38: chr11 225673; GRCh38/hg38: chr19 1216398; GRCh38/hg38: chr19 1221846; GRCh38/hg38: chr6 33448868; GRCh38/hg38: chr9 32551365; and GRCh38/hg38: chr5 83545070.

In some embodiments, the targeted portion is located in an intronic region between two canonical exonic regions of the mRNA encoding the target protein, and wherein the intronic region contains the NMD exon. In some embodiments, the targeted portion at least partially overlaps with the NMD exon. In some embodiments, the targeted portion at least partially overlaps with an intron upstream or downstream of the NMD exon. In some embodiments, the targeted portion comprises 5' NMD exon-intron junction or 3' NMD exon-intron junction. In some embodiments, the targeted portion is within the NMD exon. In some embodiments, the targeted portion comprises about 5, 6, 7, 8, 9, 10, 11, 12, 13, 14, 15, 16, 17, 18, 19, 20, 21, 22, 23, 24, 25, 26, 27, 28, 29, 30, or more consecutive nucleotides of the NMD exon.

In some embodiments, the mRNA encoding the target protein comprises a sequence with at least about 80%, 85%, 90%, 95%, 97%, or 100% sequence identity to a sequence selected from the group consisting of SEQ ID NOs: 135-191. In some embodiments, the mRNA encoding the target protein is encoded by a genetic sequence with at least about 80%, 85%, 90%, 95%, 97%, or 100% sequence identity to a sequence selected from the group consisting of SEQ ID NOs: 1-5, 12, 19-21, 25, 26, 28, 30, 33, 35, 38, 40, 41, 44, 45, 51, 53, 55-57, and 192-211. In some embodiments, the targeted portion of the mRNA comprises a sequence with at least 80%, 85%, 90%, 95%, 97%, or 100% sequence identity to a region comprising at least 8 contiguous nucleic acids of a sequence selected from the group consisting of SEQ ID NOs: 135-191. In some embodiments, the agent is an antisense oligomer (ASO) and wherein the ASO comprises a sequence that is at least about 80%, 85%, 90%, 95%, 97%, or 100% complementary to at least 8 contiguous nucleic acids of a sequence selected from the group consisting of SEQ ID NOs: 135-191.

In some embodiments, the targeted portion of the mRNA is within the non-sense mediated RNA decay-inducing exon selected from the group consisting of: GRCh38/hg38: chr1 243564285 243564388; GRCh38/hg38: chr19 13236449 13236618; GRCh38/hg38: chr21 43059730 43060012; GRCh38/hg38: chr1 207775610 207775745; GRCh38/hg38: chr1 196675450 196675529; GRCh38/hg38: chr15 92998149 92998261; GRCh38/hg38: chr16 28479644 28479765; GRCh38/hg38: chr6 33183634 33183698; GRCh38/hg38: chr2 227296487 227296526; GRCh38/hg38: chr2 227144653 227144833; GRCh38/hg38: chr2 227015283 227015360; GRCh38/hg38: chr1 207637688 207637848; GRCh38/hg38: chr19 47835403 47835579; GRCh38/hg38: chr1 59904366 59904516; GRCh38/hg38: chr1 26442335 26442372; GRCh38/hg38: chr1 28230131 28230252; GRCh38/hg38: chr2 88582755 88582824; GRCh38/hg38: chr17 64102673 64102804; GRCh38/hg38: chr1 23798311 23798484; GRCh38/hg38: chrX 109383365 109383446; GRCh38/hg38: chrX 109439038 109439175; GRCh38/hg38: chr15 72362376 72362466; GRCh38/hg38: chr15 72345677 72345776; GRCh38/hg38: chr16 30115595 30115645; GRCh38/hg38: chr2 148460219 148460304; GRCh38/hg38: chr2 148490695 148490787; GRCh38/hg38: chr2 148505761 148505830; GRCh38/hg38: chr6 49436522 49436597; GRCh38/hg38: chr19 50230825 50230999; GRCh38/hg38: chr6 75867431 75867523; GRCh38/hg38: chr17 31249955 31250125; GRCh38/hg38: chr22 29628658 29628773; GRCh38/hg38: chr5 37048127 37048354; GRCh38/hg38: chr12 100499841 100500024; GRCh38/hg38: chr5 177169394 177169559; GRCh38/hg38: chr5 177200761 177200783; GRCh38/hg38: chr5 177247924 177248079; GRCh38/hg38: chr5 177275947 177276101; GRCh38/hg38: chr3 193628509 193628616; GRCh38/hg38: chr3 193603500 193603557; GRCh38/hg38: chr13 100305751 100305834; GRCh38/hg38: chr12 32894516 32894778; GRCh38/hg38: chr22 46203575 46203752; GRCh38/hg38: chr1 150327557 150327652; GRCh38/hg38: chr1 150330401 150330498; GRCh38/hg38: chr2 165327155 165327202; GRCh38/hg38: chr12 51688758 51688849; GRCh38/hg38: chr12 51780202 51780271; GRCh38/hg38: chr2 166304238 166304329; GRCh38/hg38: chr7 80794854 80794957; GRCh38/hg38: chr7 85059498 85059541; GRCh38/hg38: chr11 225673 226081; GRCh38/hg38: chr19 1216268 1216398; GRCh38/hg38: chr19 1221621 1221846; GRCh38/hg38: chr6 33448789 33448868; GRCh38/hg38: chr9 32551365 32551469; and GRCh38/hg38: chr5 83544965 83545070.

In some embodiments, the targeted portion of the mRNA is upstream or downstream of the non-sense mediated RNA decay-inducing exon selected from the group consisting of: GRCh38/hg38: chr1 243564285 243564388; GRCh38/hg38: chr19 13236449 13236618; GRCh38/hg38: chr21 43059730 43060012; GRCh38/hg38: chr1 207775610 207775745; GRCh38/hg38: chr1 196675450 196675529; GRCh38/hg38: chr15 92998149 92998261; GRCh38/hg38: chr16 28479644 28479765; GRCh38/hg38: chr6 33183634 33183698; GRCh38/hg38: chr2 227296487 227296526; GRCh38/hg38: chr2 227144653 227144833; GRCh38/hg38: chr2 227015283 227015360; GRCh38/hg38: chr1 207637688 207637848; GRCh38/hg38: chr19 47835403 47835579; GRCh38/hg38: chr1 59904366 59904516; GRCh38/hg38: chr1 26442335 26442372; GRCh38/hg38: chr1 28230131 28230252; GRCh38/hg38: chr2 88582755 88582824; GRCh38/hg38: chr17 64102673 64102804; GRCh38/hg38: chr1 23798311 23798484; GRCh38/hg38: chrX 109383365 109383446; GRCh38/hg38: chrX 109439038 109439175; GRCh38/hg38: chr15 72362376 72362466; GRCh38/hg38: chr15 72345677 72345776; GRCh38/hg38: chr16 30115595 30115645; GRCh38/hg38: chr2 148460219 148460304; GRCh38/hg38: chr2 148490695 148490787; GRCh38/hg38: chr2 148505761 148505830; GRCh38/hg38: chr6 49436522 49436597; GRCh38/hg38: chr19 50230825 50230999; GRCh38/hg38: chr6 75867431 75867523; GRCh38/hg38: chr17 31249955 31250125; GRCh38/hg38: chr22 29628658 29628773; GRCh38/hg38: chr5 37048127 37048354; GRCh38/hg38: chr12 100499841 100500024; GRCh38/hg38: chr5 177169394 177169559; GRCh38/hg38: chr5 177200761 177200783; GRCh38/hg38: chr5 177247924 177248079; GRCh38/hg38: chr5 177275947 177276101; GRCh38/hg38: chr3 193628509 193628616; GRCh38/hg38: chr3 193603500 193603557; GRCh38/hg38: chr13 100305751 100305834; GRCh38/hg38: chr12 32894516 32894778;

GRCh38/hg38: chr22 46203575 46203752; GRCh38/hg38: chr1 150327557 150327652; GRCh38/hg38: chr1 150330401 150330498; GRCh38/hg38: chr2 165327155 165327202; GRCh38/hg38: chr12 51688758 51688849; GRCh38/hg38: chr12 51780202 51780271; GRCh38/hg38: chr2 166304238 166304329; GRCh38/hg38: chr7 80794854 80794957; GRCh38/hg38: chr7 85059498 85059541; GRCh38/hg38: chr11 225673 226081; GRCh38/hg38: chr19 1216268 1216398; GRCh38/hg38: chr19 1221621 1221846; GRCh38/hg38: chr6 33448789 33448868; GRCh38/hg38: chr9 32551365 32551469; and GRCh38/hg38: chr5 83544965 83545070.

In some embodiments, the targeted portion of the mRNA comprises an exon-intron junction of exon selected from the group consisting of: GRCh38/hg38: chr1 243564285 243564388; GRCh38/hg38: chr19 13236449 13236618; GRCh38/hg38: chr21 43059730 43060012; GRCh38/hg38: chr1 207775610 207775745; GRCh38/hg38: chr1 196675450 196675529; GRCh38/hg38: chr15 92998149 92998261; GRCh38/hg38: chr16 28479644 28479765; GRCh38/hg38: chr6 33183634 33183698; GRCh38/hg38: chr2 227296487 227296526; GRCh38/hg38: chr2 227144653 227144833; GRCh38/hg38: chr2 227015283 227015360; GRCh38/hg38: chr1 207637688 207637848; GRCh38/hg38: chr19 47835403 47835579; GRCh38/hg38: chr1 59904366 59904516; GRCh38/hg38: chr1 26442335 26442372; GRCh38/hg38: chr1 28230131 28230252; GRCh38/hg38: chr2 88582755 88582824; GRCh38/hg38: chr17 64102673 64102804; GRCh38/hg38: chr1 23798311 23798484; GRCh38/hg38: chrX 109383365 109383446; GRCh38/hg38: chrX 109439038 109439175; GRCh38/hg38: chr15 72362376 72362466; GRCh38/hg38: chr15 72345677 72345776; GRCh38/hg38: chr16 30115595 30115645; GRCh38/hg38: chr2 148460219 148460304; GRCh38/hg38: chr2 148490695 148490787; GRCh38/hg38: chr2 148505761 148505830; GRCh38/hg38: chr6 49436522 49436597; GRCh38/hg38: chr19 50230825 50230999; GRCh38/hg38: chr6 75867431 75867523; GRCh38/hg38: chr17 31249955 31250125; GRCh38/hg38: chr22 29628658 29628773; GRCh38/hg38: chr5 37048127 37048354; GRCh38/hg38: chr12 100499841 100500024; GRCh38/hg38: chr5 177169394 177169559; GRCh38/hg38: chr5 177200761 177200783; GRCh38/hg38: chr5 177247924 177248079; GRCh38/hg38: chr5 177275947 177276101; GRCh38/hg38: chr3 193628509 193628616; GRCh38/hg38: chr3 193603500 193603557; GRCh38/hg38: chr13 100305751 100305834; GRCh38/hg38: chr12 32894516 32894778; GRCh38/hg38: chr22 46203575 46203752; GRCh38/hg38: chr1 150327557 150327652; GRCh38/hg38: chr1 150330401 150330498; GRCh38/hg38: chr2 165327155 165327202; GRCh38/hg38: chr12 51688758 51688849; GRCh38/hg38: chr12 51780202 51780271; GRCh38/hg38: chr2 166304238 166304329; GRCh38/hg38: chr7 80794854 80794957; GRCh38/hg38: chr7 85059498 85059541; GRCh38/hg38: chr11 225673 226081; GRCh38/hg38: chr19 1216268 1216398; GRCh38/hg38: chr19 1221621 1221846; GRCh38/hg38: chr6 33448789 33448868; GRCh38/hg38: chr9 32551365 32551469; and GRCh38/hg38: chr5 83544965 83545070.

In some embodiments, the target protein produced is a full-length protein or a wild-type protein.

In some embodiments, the therapeutic agent promotes exclusion of the NMD exon from the processed mRNA encoding the target protein. In some embodiments, exclusion of the NMD exon from the processed mRNA encoding the target protein in the cell contacted with the therapeutic agent is increased by about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold, compared to exclusion of the NMD exon from the processed mRNA encoding the target protein in a control cell. In some embodiments, the therapeutic agent increases the level of the processed mRNA encoding the target protein in the cell. In some embodiments, the level of the processed mRNA encoding the target protein produced in the cell contacted with the therapeutic agent is increased by about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold, compared to a level of the processed mRNA encoding the target protein in a control cell. In some embodiments, the therapeutic agent increases the expression of the target protein in the cell. In some embodiments, a level of the target protein produced in the cell contacted with the therapeutic agent is increased by about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold, compared to a level of the target protein produced in a control cell.

In some embodiments, the disease or condition is induced by a loss-of-function mutation in the target protein.

In some embodiments, the disease or condition is associated with haploinsufficiency of a gene encoding the target protein, and wherein the subject has a first allele encoding a functional target protein, and a second allele from which the target protein is not produced or produced at a reduced level, or a second allele encoding a nonfunctional target protein or a partially functional target protein. In some embodiments, the disease or condition is selected from the group consisting of. Sotos syndrome 1; Beckwith-Wiedemann syndrome; Migraine, familial hemiplegic, 1; Episodic ataxia, type 2; Epileptic encephalopathy, childhood-onset; Wagner syndrome 1; Optic atrophy type 1; Alport syndrome; Arrhythmogenic right ventricular dysplasia 9; Neurofibromatosis type 1; Epileptic encephalopathy, early infantile, 11;

Seizures, benign familial infantile, 3; Cognitive impairment with or without cerebellar ataxia; Epileptic encephalopathy, early infantile, 13; Seizures, benign familial infantile, 5; Pathway (CNS); 16p11.2 deletion syndrome?; Mental retardation, autosomal dominant 1; Retinitis pigmentosa 18; Retinitis pigmentosa 31; Deafness, autosomal dominant 13; Cone-rod retinal dystrophy-2; Deafness, autosomal dominant 4A; Peripheral neuropathy, myopathy, hoarseness, and hearing loss; Deafness, autosomal dominant 22; Neurofibromatosis type 2; Mental retardation, autosomal dominant 5; Epilepsy, generalized, with febrile seizures plus, type 7; and Febrile seizures, familial, 3B.

In some embodiments, the disease or condition is associated with an autosomal recessive mutation of a gene encoding the target protein, wherein the subject has a first allele encoding from which: (i) the target protein is not produced or produced at a reduced level compared to a wild-type allele; or (ii) the target protein produced is non-functional or partially functional compared to a wild-type allele, and a second allele from which: (iii) the target protein is produced at a reduced level compared to a wild-type allele and the target protein produced is at least partially functional compared to a wild-type allele; or (iv) the target protein produced is partially functional compared to a wild-type allele. In some embodiments, the disease or condition is selected from the group consisting of: Alport syndrome; Ceroid lipofuscinosis, neuronal, 3; Galactose epimerase deficiency; Homocystinuria, B6-responsive and nonresponsive types; Methyl Malonic Aciduria; Propionic acidemia; Retinitis pigmentosa 59; Tay-Sachs disease; Insensitivity to pain, congenital; and HSAN2D, autosomal recessive.

In some embodiments, the therapeutic agent promotes exclusion of the NMD exon from the processed mRNA encoding the target protein and increases the expression of the target protein in the cell. In some embodiments, the therapeutic agent inhibits exclusion of the NMD exon from the processed mRNA encoding the target protein. In some embodiments, exclusion of the NMD exon from the processed mRNA encoding the target protein in the cell contacted with the therapeutic agent is decreased by about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold, compared to exclusion of the NMD exon from the processed mRNA encoding the target protein in a control cell. In some embodiments, the therapeutic agent decreases the level of the processed mRNA encoding the target protein in the cell. In some embodiments, the level of the processed mRNA encoding the target protein in the cell contacted with the therapeutic agent is decreased by about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold, compared to a level of the processed mRNA encoding the target protein in a control cell.

In some embodiments, the therapeutic agent decreases the expression of the target protein in the cell. In some embodiments, a level of the target protein produced in the cell contacted with the therapeutic agent is decreased by about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold, compared to a level of the target protein produced in a control cell.

In some embodiments, the disease or condition is induced by a gain-of-function mutation in the target protein. In some embodiments, the subject has an allele from which the target protein is produced at an increased level, or an allele encoding a mutant target protein that exhibits increased activity in the cell.

In some embodiments, the therapeutic agent inhibits exclusion of the NMD exon from the processed mRNA encoding the target protein and decreases the expression of the target protein in the cell. In some embodiments, the target protein comprises SCN8A. In some embodiments, the disease or condition comprises a central nervous system disease. In some embodiments, the disease or condition comprises epilepsy. In some embodiments, the disease or condition comprises Dravet syndrome.

In some embodiments, the therapeutic agent is an antisense oligomer (ASO) and wherein the antisense oligomer comprises a backbone modification comprising a phosphorothioate linkage or a phosphorodiamidate linkage. In some embodiments, the therapeutic agent is an antisense oligomer (ASO) and wherein the antisense oligomer comprises a phosphorodiamidate morpholino, a locked nucleic acid, a peptide nucleic acid, a 2'-O-methyl, a 2'-Fluoro, or a 2'-O-methoxyethyl moiety.

In some embodiments, the therapeutic agent is an antisense oligomer (ASO) and wherein the antisense oligomer comprises at least one modified sugar moiety. In some embodiments, each sugar moiety is a modified sugar moiety.

In some embodiments, the therapeutic agent is an antisense oligomer (ASO) and wherein the antisense oligomer consists of from 8 to 50 nucleobases, 8 to 40 nucleobases, 8 to 35 nucleobases, 8 to 30 nucleobases, 8 to 25 nucleobases, 8 to 20 nucleobases, 8 to 15 nucleobases, 9 to 50 nucleobases, 9 to 40 nucleobases, 9 to 35 nucleobases, 9 to 30 nucleobases, 9 to 25 nucleobases, 9 to 20 nucleobases, 9 to 15 nucleobases, 10 to 50 nucleobases, 10 to 40 nucleobases, 10 to 35 nucleobases, 10 to 30 nucleobases, 10 to 25 nucleobases, 10 to 20 nucleobases, 10 to 15 nucleobases, 11 to 50 nucleobases, 11 to 40 nucleobases, 11 to 35 nucleobases, 11 to 30 nucleobases, 11 to 25 nucleobases, 11 to 20 nucleobases, 11 to 15 nucleobases, 12 to 50 nucleobases, 12 to 40 nucleobases, 12 to 35 nucleobases, 12 to 30 nucleobases, 12 to 25 nucleobases, 12 to 20 nucleobases, or 12 to 15 nucleobases.

In some embodiments, the therapeutic agent is an antisense oligomer (ASO) and wherein the antisense oligomer is at least 80%, at least 85%, at least 90%, at least 95%, at least 98%, at least 99%, or 100%, complementary to the targeted portion of the mRNA.

In some embodiments, the method further comprises assessing mRNA level or expression level of the target protein.

In some embodiments, the subject is a human. In some embodiments, the subject is a non-human animal. In some embodiments, the subject is a fetus, an embryo, or a child. In some embodiments, the cells are ex vivo. In some embodiments, the therapeutic agent is administered by intrathecal injection, intracerebroventricular injection, intraperitoneal injection, intramuscular injection, subcutaneous injection, intravitreal, or intravenous injection of the subject. In some embodiments, the method further comprises administering a second therapeutic agent to the subject.

In some embodiments, the second therapeutic agent is a small molecule. In some embodiments, the second therapeutic agent is an antisense oligomer. In some embodiments, the second therapeutic agent corrects intron retention.

In some embodiments, the disease or condition is selected from the group consisting of: 16p11.2 deletion syndrome; Alport syndrome; Arrhythmogenic right ventricular dysplasia 9; Ceroid lipofuscinosis, neuronal, 3; Cognitive impairment with or without cerebellar ataxia; Epileptic encephalopathy, early infantile, 13; Seizures, benign familial infantile, 5; Cone-rod retinal dystrophy-2; Cornelia de Lange; Deafness, autosomal dominant 13; Deafness, autosomal dominant 4A; Peripheral neuropathy, myopathy, hoarseness, and hearing loss; Epilepsy, generalized, with febrile seizures plus, type 7; Febrile seizures, familial, 3B; Insensitivity to pain, congenital; HSAN2D, autosomal recessive; Epileptic encephalopathy, childhood-onset; Epileptic encephalopathy, early infantile, 11; Seizures, benign familial infantile, 3; Galactose epimerase deficiency; Homocystinuria, B6-responsive and nonresponsive types; Mental retardation, autosomal dominant 1; Mental retardation, autosomal dominant 5; Methyl Malonic Aciduria; Migraine, familial hemiplegic, 1; Episodic ataxia, type 2; NASH; Neurofibromatosis type 1; Neurofibromatosis type 2; Optic atrophy type 1; Propionic acidemia; Retinitis pigmentosa 18; Sotos syndrome 1; Beckwith-Wiedemann syndrome; Tay-Sachs disease; and Wagner syndrome 1.

INCORPORATION BY REFERENCE

All publications, patents, and patent applications mentioned in this specification are herein incorporated by reference to the same extent as if each individual publication, patent, or patent application was specifically and individually indicated to be incorporated by reference.

BRIEF DESCRIPTION OF THE DRAWINGS

The novel features of the disclosure are set forth with particularity in the appended claims. A better understanding of the features and advantages of the present disclosure will be obtained by reference to the following detailed description that sets forth illustrative embodiments, in which the principles of the disclosure are utilized, and the accompanying drawings of which:

FIG. 1 depicts a schematic representation of a target mRNA that contains a non-sense mediated mRNA decay-inducing exon (NMD exon mRNA) and therapeutic agent-mediated exclusion of the nonsense-mediated mRNA decay-inducing exon to increase expression of the full-length target protein or functional RNA.

FIG. 2 discloses SEQ ID NO: 212.

FIG. 3 discloses SEQ ID NO: 213.

FIG. 4 discloses SEQ ID NO: 214.

FIG. 5 discloses SEQ ID NO: 215.

FIG. 6 discloses SEQ ID NO: 216.

FIG. 7 discloses SEQ ID NO: 217.

FIG. 8 discloses SEQ ID NO: 218.

FIG. 9 discloses SEQ ID NO: 219.

FIG. 10 discloses SEQ ID NO: 220.

FIG. 11 discloses SEQ ID NO: 221.

FIG. 12 discloses SEQ ID NO: 222.

FIG. 13 discloses SEQ ID NO: 223.

FIG. 14 discloses SEQ ID NO: 224.

FIG. 15 discloses SEQ ID NO: 225.

FIG. 16 discloses SEQ ID NO: 226.

FIG. 17 discloses SEQ ID NO: 227.

FIG. 18 discloses SEQ ID NO: 228.

FIG. 19 discloses SEQ ID NO: 229.

FIG. 20 discloses SEQ ID NO: 230.

FIG. 21 discloses SEQ ID NO: 231.

FIG. 22 discloses SEQ ID NO: 232.

FIG. 23 discloses SEQ ID NO: 233.

FIG. 24 discloses SEQ ID NO: 234.

FIG. 25 discloses SEQ ID NO: 235.

FIG. 26 discloses SEQ ID NO: 236.

FIG. 27 discloses SEQ ID NO: 237.

FIG. 28 discloses SEQ ID NO: 238.

FIG. 29 discloses SEQ ID NO: 239.

FIG. 30 discloses SEQ ID NO: 240.

FIG. 31 discloses SEQ ID NO: 241.

FIG. 32 discloses SEQ ID NO: 242.

FIG. 33 discloses SEQ ID NO: 243.

FIG. 34 discloses SEQ ID NO: 244.

FIG. 35 discloses SEQ ID NO: 245.

FIG. 36 discloses SEQ ID NO: 246.

FIG. 37 discloses SEQ ID NO: 247.

FIG. 38 discloses SEQ ID NO: 248.

FIG. 39 depicts identification of an exemplary nonsense-mediated mRNA decay (NMD)-inducing exon in the NF2 gene. The identification of the NMD-inducing exon in the NF2 gene using RNA sequencing is shown, visualized in the UCSC genome browser. The upper panel shows a graphic representation of the NF2 gene to scale. Peaks corresponding to RNA sequencing reads were identified in intron GRCh38/hg38: chr22 29604114 29636750, shown in the middle panel. Bioinformatic analysis identified an exon-like sequence (bottom panel, sequence highlighted in uppercase) flanked by 3' and 5' splice sites. Inclusion of this exon leads to the introduction of a premature termination codon rendering the transcript a target of NMD. FIG. 39 discloses SEQ ID NO: 249.

FIG. 40 discloses SEQ ID NO: 250.

FIG. 41 discloses SEQ ID NO: 251.

FIG. 42 depicts identification of an exemplary nonsense-mediated mRNA decay (NMD)-inducing exon in the SIRT3 gene. The identification of the NMD-inducing exon in the SIRT3 gene using RNA sequencing is shown, visualized in the UCSC genome browser. The upper panel shows a graphic representation of the SIRT3 gene to scale. Peaks corresponding to RNA sequencing reads were identified in intron GRCh38/hg38: chr11 224241 230451, shown in the middle panel. Bioinformatic analysis identified an exon-like sequence (bottom panel, sequence highlighted in uppercase) flanked by 3' and 5' splice sites. Inclusion of this exon leads to the introduction of a premature termination codon rendering the transcript a target of NMD. FIG. 42 discloses SEQ ID NO: 252.

FIG. 43 discloses SEQ ID NO: 253.

FIG. 44 discloses SEQ ID NO: 254.

FIG. 45 discloses SEQ ID NO: 255.

FIG. 46 discloses SEQ ID NO: 256.

FIG. 47 discloses SEQ ID NO: 257.

FIG. 48 discloses SEQ ID NO: 258.

FIG. 49 discloses SEQ ID NO: 259.

FIG. 50 discloses SEQ ID NO: 260.

FIG. 51 discloses SEQ ID NO: 261.

FIG. 52 discloses SEQ ID NO: 262.

FIG. 53 discloses SEQ ID NO: 263.

FIG. 54 discloses SEQ ID NO: 264.

FIG. 55 discloses SEQ ID NO: 265.

FIG. 56 discloses SEQ ID NO: 266.

FIG. 57 discloses SEQ ID NO: 267.

FIG. 58 discloses SEQ ID NO: 268.

FIG. 60 discloses SEQ ID NOS 269-271, respectively, in order of appearance.

FIG. 63 discloses SEQ ID NOS 272-273, respectively, in order of appearance.

FIG. 66 discloses SEQ ID NOS 274-276, respectively, in order of appearance.

FIG. 70 discloses SEQ ID NOS 277-279, respectively, in order of appearance.

FIG. 73 discloses SEQ ID NOS 280-282, respectively, in order of appearance.

FIG. 76 discloses SEQ ID NOS 283-286, respectively, in order of appearance.

DETAILED DESCRIPTION

Figure 1A:
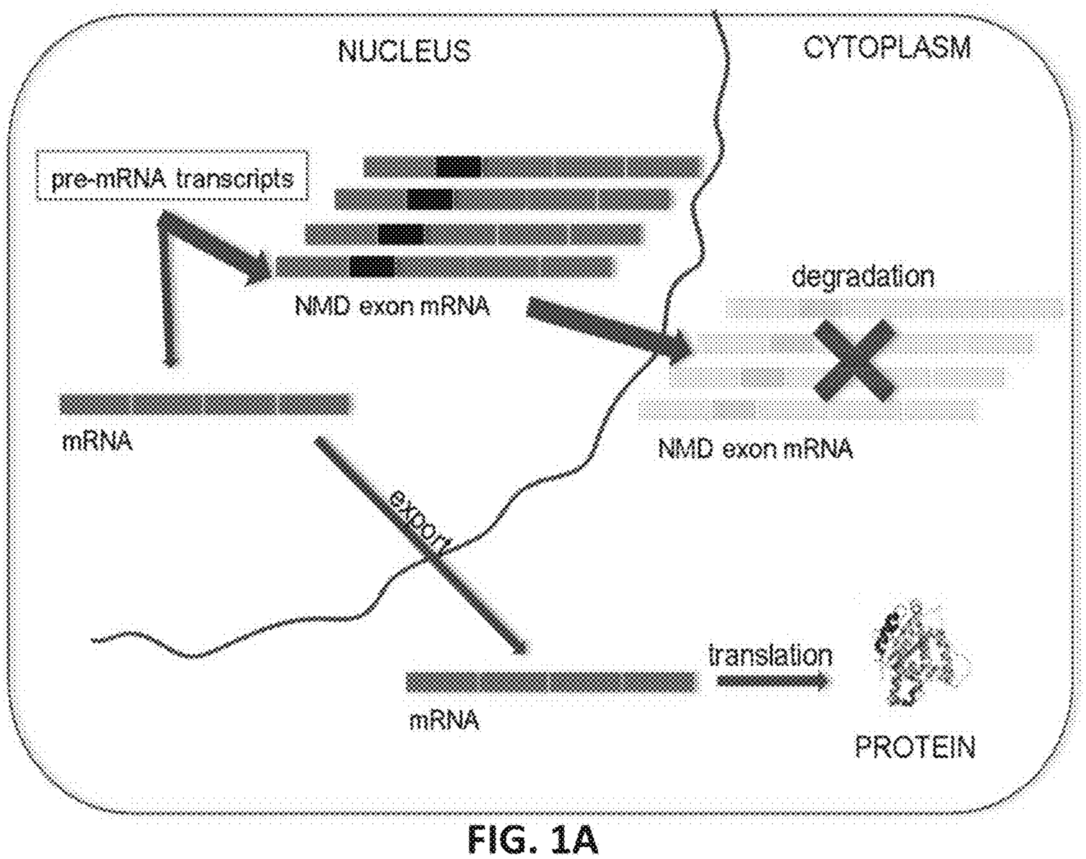
FIG. 1A shows a cell divided into nuclear and cytoplasmic compartments. In the nucleus, a pre-mRNA transcript of a target gene undergoes splicing to generate mRNA, and this mRNA is exported to the cytoplasm and translated into target protein. For this target gene, some fraction of the mRNA contains a nonsense-mediated mRNA decay-inducing exon (NMD exon mRNA) that is degraded in the cytoplasm, thus leading to no target protein production.
Figure 1B:
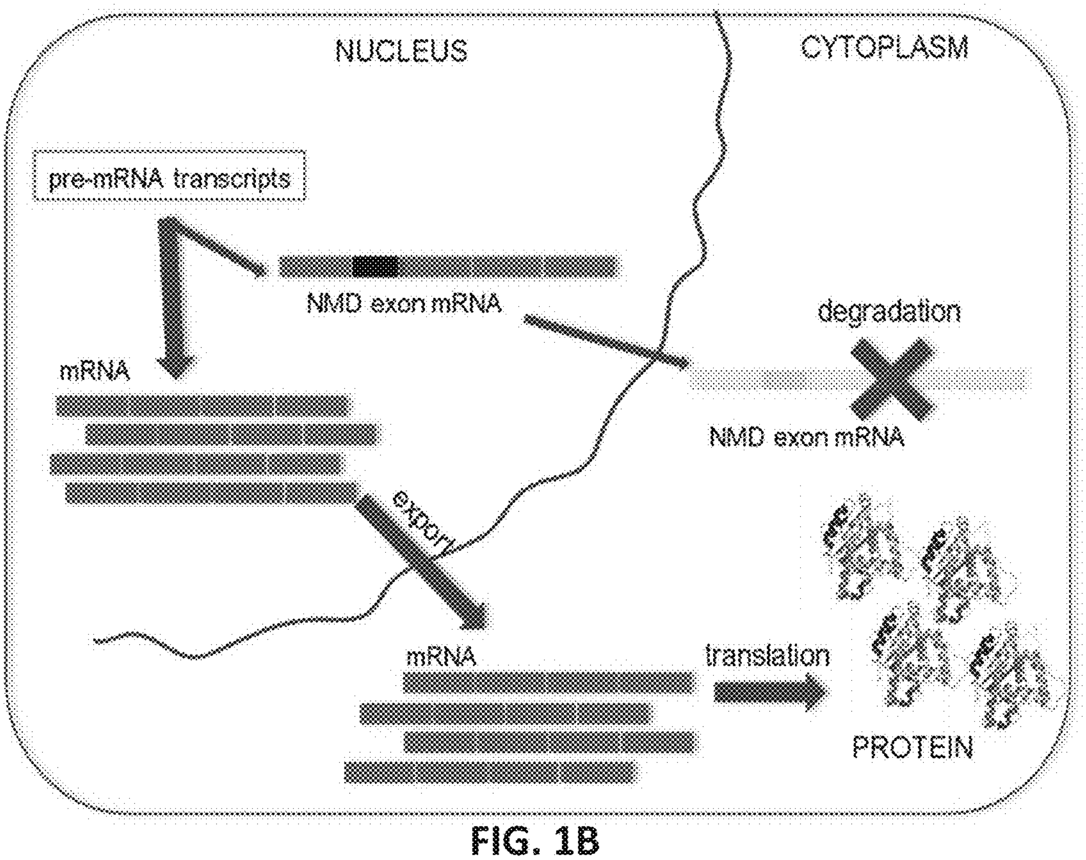
FIG. 1B shows an example of the same cell divided into nuclear and cytoplasmic compartments. Treatment with a therapeutic agent, such as an antisense oligomer (ASO), promotes the exclusion of the nonsense-mediated mRNA decay-inducing exon and results in an increase in mRNA, which is in turn translated into higher levels of target protein

Alternative splicing events in ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6AJ, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 gene can lead to non-productive mRNA transcripts which in turn can lead to aberrant protein expression, and therapeutic agents which can target the alternative splicing events in ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 gene can modulate the expression level of functional proteins in DS patients and/or inhibit aberrant protein expression. Such therapeutic agents can be used to treat a condition caused by ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein deficiency.

One of the alternative splicing events that can lead to non-productive mRNA transcripts is the inclusion of an extra exon in the mRNA transcript that can induce non-sense mediated mRNA decay. The present disclosure provides compositions and methods for modulating alternative splicing of ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6AJ, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 to increase the production of protein-coding mature mRNA, and thus, translated functional ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein. These compositions and methods include antisense oligomers (ASOs) that can cause exon skipping, e.g., pseudoexon skipping, and promote constitutive splicing of ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 pre-mRNA. In various embodiments, functional ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein can be increased using the methods of the disclosure to treat a condition caused by ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein deficiency.

Splicing and Nonsense-Mediated mRNA Decay

Intervening sequences or introns are removed by a large and highly dynamic RNA-protein complex termed the spliceosome, which orchestrates complex interactions between primary transcripts, small nuclear RNAs (snRNAs) and a large number of proteins. Spliceosomes assemble ad hoc on each intron in an ordered manner, starting with recognition of the 5' splice site (5' ss) by U1 snRNA or the 3' splice site (3'ss) by the U2 pathway, which involves binding of the U2 auxiliary factor (U2AF) to the 3'ss region to facilitate U2 binding to the branch point sequence (BPS). U2AF is a stable heterodimer composed of a U2AF2-encoded 65-kD subunit (U2AF65), which binds the polypyrimidine tract (PPT), and a U2AF1-encoded 35-kD subunit (U2AF35), which interacts with highly conserved AG dinucleotides at 3'ss and stabilizes U2AF65 binding. In addition to the BPS/PPT unit and 3'ss/5'ss, accurate splicing requires auxiliary sequences or structures that activate or repress splice site recognition, known as intronic or exonic splicing enhancers or silencers. These elements allow genuine splice sites to be recognized among a vast excess of cryptic or pseudo-sites in the genome of higher eukaryotes, which have the same sequences but outnumber authentic sites by an order of magnitude. Although they often have a regulatory function, the exact mechanisms of their activation or repression are poorly understood.

The decision of whether to splice or not to splice can be typically modeled as a stochastic rather than deterministic process, such that even the most defined splicing signals can sometimes splice incorrectly. However, under normal conditions, pre-mRNA splicing proceeds at surprisingly high fidelity. This is attributed in part to the activity of adjacent cis-acting auxiliary exonic and intronic splicing regulatory elements (ESRs or ISRs). Typically, these functional elements are classified as either exonic or intronic splicing enhancers (ESEs or ISEs) or silencers (ESSs or ISSs) based on their ability to stimulate or inhibit splicing, respectively. Although there is now evidence that some auxiliary cis-acting elements may act by influencing the kinetics of spliceosome assembly, such as the arrangement of the complex between U1 snRNP and the 5'ss, it seems very likely that many elements function in concert with trans-acting RNA-binding proteins (RBPs). For example, the serine- and arginine-rich family of RBPs (SR proteins) is a conserved family of proteins that have a key role in defining exons. SR proteins promote exon recognition by recruiting components of the pre-spliceosome to adjacent splice sites or by antagonizing the effects of ESSs in the vicinity. The repressive effects of ESSs can be mediated by members of the heterogeneous nuclear ribonucleoprotein (hnRNP) family and can alter recruitment of core splicing factors to adjacent splice sites. In addition to their roles in splicing regulation, silencer elements are suggested to have a role in repression of pseudo-exons, sets of decoy intronic splice sites with the typical spacing of an exon but without a functional open reading frame. ESEs and ESSs, in cooperation with their cognate trans-acting RBPs, represent important components in a set of splicing controls that specify how, where and when mRNAs are assembled from their precursors.

The sequences marking the exon-intron boundaries are degenerate signals of varying strengths that can occur at high frequency within human genes. In multi-exon genes, different pairs of splice sites can be linked together in many different combinations, creating a diverse array of transcripts from a single gene. This is commonly referred to as alternative pre-mRNA splicing. Although most mRNA isoforms produced by alternative splicing can be exported from the nucleus and translated into functional polypeptides, different mRNA isoforms from a single gene can vary greatly in their translation efficiency. Those mRNA isoforms with premature termination codons (PTCs) at least 50 bp upstream of an exon junction complex are likely to be targeted for degradation by the nonsense-mediated mRNA decay (NMD) pathway. Mutations in traditional (BPS/PPT/3'ss/5'ss) and auxiliary splicing motifs can cause aberrant splicing, such as exon skipping or cryptic (or pseudo-) exon inclusion or splice-site activation, and contribute significantly to human morbidity and mortality. Both aberrant and alternative splicing patterns can be influenced by natural DNA variants in exons and introns.

Given that exon-intron boundaries can occur at any of the three positions of a codon, it is clear that only a subset of alternative splicing events can maintain the canonical open reading frame. For example, only exons that are evenly divisible by 3 can be skipped or included in the mRNA without any alteration of reading frame. Splicing events that do not have compatible phases will induce a frame-shift. Unless reversed by downstream events, frame-shifts can certainly lead to one or more PTCs, probably resulting in subsequent degradation by NMD. NMD is a translation-coupled mechanism that eliminates mRNAs containing PTCs. NMD can function as a surveillance pathway that exists in all eukaryotes. NMD can reduce errors in gene expression by eliminating mRNA transcripts that contain premature stop codons. Translation of these aberrant mRNAs could, in some cases, lead to deleterious gain-of-function or dominant-negative activity of the resulting proteins. NMD targets not only transcripts with PTCs but also a broad array of mRNA isoforms expressed from many endogenous genes, suggesting that NMD is a master regulator that drives both fine and coarse adjustments in steady-state RNA levels in the cell.

A NMD-inducing exon (NIE) is an exon or a pseudo-exon that is a region within an intron and can activate the NMD pathway if included in a mature RNA transcript. In constitutive splicing events, the intron containing an NIE is usually spliced out, but the intron or a portion thereof (e.g. NIE) may be retained during alternative or aberrant splicing events. Mature mRNA transcripts containing such an NIE may be non-productive due to frame shifts which induce the NMD pathway. Inclusion of a NIE in mature RNA transcripts may downregulate gene expression. mRNA transcripts containing an NIE may be referred to as “NIE containing mRNA” or “NMD exon mRNA” in the current disclosure.

Cryptic (or pseudo-splice sites) have the same splicing recognition sequences as genuine splice sites but are not used in splicing reactions. They outnumber genuine splice sites in the human genome by an order of a magnitude and are normally repressed by thus far poorly understood molecular mechanisms. Cryptic 5' splice sites have the consensus NNN/GUNNNN or NNN/GCNNNN where N is any nucleotide and/is the exon-intron boundary. Cryptic 3' splice sites have the consensus NAG/N. Their activation is positively influenced by surrounding nucleotides that make them more similar to the optimal consensus of authentic splice sites, namely MAG/GURAGU and YAG/G, respectively, where M is C or A, R is G or A, and Y is C or U.

Splice sites and their regulatory sequences can be readily identified by a skilled person using suitable algorithms publicly available, listed for example in Kralovicova, J. and Vorechovsky, I. (2007) Global control of aberrant splice site activation by auxiliary splicing sequences: evidence for a gradient in exon and intron definition. *Nucleic Acids Res.*, 35, 6399-6413, (http://www.ncbi.nlm.nih.gov/pmc/articles/PMC2095810/pdf/gkm680.pdf)

The cryptic splice sites or splicing regulatory sequences may compete for RNA-binding proteins, such as U2AF, with a splice site of the NIE. In some embodiments, an agent may bind to a cryptic splice site or splicing regulatory sequence to prevent binding of RNA-binding proteins and thereby favor binding of RNA-binding proteins to the NIE splice sites.

In some embodiments, the cryptic splice site may not comprise the 5' or 3' splice site of the NIE. In some embodiments, the cryptic splice site may be at least 10 nucleotides, at least 20 nucleotides, at least 50 nucleotides, at least 100 nucleotides or at least 200 nucleotides upstream of the NIE 5' splice site. In some embodiments, the cryptic splice site may be at least 10 nucleotides, at least 20 nucleotides, at least 50 nucleotides, at least 100 nucleotides, at least 200 nucleotides downstream of the NIE 3' splice site.

Target Transcripts

In some embodiments, the methods of the present disclosure exploit the presence of NIE in the pre-mRNA transcribed from ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 genes. Splicing of the identified ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 NIE pre-mRNA species to produce functional mature ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 mRNA may be induced using a therapeutic agent such as an ASO that stimulates exon skipping of an NIE. Induction of exon skipping may result in inhibition of an NMD pathway. The resulting mature ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6AJ, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 mRNA can be translated normally without activating NMD pathway, thereby increasing the amount of ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein in the patient's cells and alleviating symptoms of a condition or disease associated with ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 deficiency, such as Alport syndrome; Amyotrophic lateral sclerosis (ALS); Angelman syndrome; Aphasia, primary progressive; Arrhythmogenic right ventricular dysplasia 9; Autism spectrum disorder; Cardiomyopathy, dilated, 1HH; Myopathy, myofibrillar 6; Ceriod lipofuscinosis, neuronal, 3; Cholestasis, intrahepatic, of pregnancy, 3; Cholestasis, progressive familial intrahepatic 1; Citrullinemia Type II; Citrullinemia, Type 1; Cognitive impairment with or without cerebral ataxia; Cornelia de Lange; Early-onset epileptic encephalopathy; Epilepsy-aphasia spectrum; Epilepsy, generalized, with febrile seizures plus, type 7; Epileptic encephalopathy, childhood-onset; Epileptic encephalopathy, early infantile, 11; Epileptic encephalopathy, early infantile, 12; Epileptic encephalopathy, early infantile, 13; Epileptic encephalopathy, early infantile, 2; Episodic ataxia, type 2; Familial focal epilepsy; Febrile seizures, familial, 3B; Friedreich ataxia; Friedreich ataxia with retained reflexes; Galactose epimerase deficiency; Glaucoma 3, primary congenital, E; Glycogen storage disease IV; GRN-related frontotemporal dementia; Homocystinuria, B6-responsive and nonresponsive types; HSAN2D, autosomal recessive; Insensitivity to pain, congenital; Kabuki syndrome; Koolen-De Vries syndrome; Mental retardation, autosomal dominant 1; Methyl malonic aciduria; Migraine, Myoclonic-atonic epilepsy; familial hemiplegic, 1; Neurofibromatosis type 1; Opioid addiction; Optic atrophy type 1; Phelan-McDermid syndrome; Propionic acidemia; Primary open angle glaucoma; Propionic academia; Retinitis pigmentosa 11; Retinitis pigmentosa 18; Retinitis pigmentosa 31; Retinitis pigmentosa 59; Rett syndrome; Seizures, benign familial infantile, 3; Seizures, benign familial infantile, 5; Smith-Magenis syndrome; Sotos syndrome 1; Beckwith-Wiedemann syndrome; Stargardt disease 3; Tay-Sachs disease; Tuberous sclerosis; Tyrosinemia, type I; Wagner syndrome 1; West syndrome; Wolfram syndrome 2/NAFLD; 15q13.3 microdeletion; 16p11.2 deletion syndrome; Deafness, autosomal dominant 13; Cone-rod retinal dystrophy-2; Deafness, autosomal dominant 4A; Peripheral neuropathy, myopathy, hoarseness, and hearing loss; Deafness, autosomal dominant 22; Neurofibromatosis type 2; NASH; or Mental retardation, autosomal dominant 5.

In some embodiments, the diseases or conditions that can be treated or ameliorated using the method or composition disclosed herein are not directly associated with the target protein (gene) that the therapeutic agent targets. In some embodiments, a therapeutic agent provided herein can target a protein (gene) that is not directly associated with a disease or condition, but the modulation of expression of the target protein (gene) can treat or ameliorate the disease or condition. For instance, targeting genes like CD46, CFH, CR1, DNAJC8, EIF2AK3, ERN1, GUCY2F, GUCY2F, SEMA3C, SEMA3D, SIRT3, or AKT3 by a therapeutic agent provided herein can treat or ameliorate eye diseases or conditions. In some embodiments, the targeting genes CD46, CFH, CR1, DNAJC8, EIF2AK3, ERN1, GUCY2F, GUCY2F, SEMA3C, SEMA43D, SIRT3, or AKT3 are said to be indicated for Pathway (eye). In some embodiments, targeting gene like SCN8A can treat or ameliorate central nervous system diseases, e.g., epilepsy, e.g., Dravet syndrome. In some embodiments, such target genes like SCN8A are said to be indicated for Pathway (central nervous system) or Pathway (central nervous system, epilepsy).

In various embodiments, the present disclosure provides a therapeutic agent which can target ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 mRNA transcripts to modulate splicing or protein expression level. The therapeutic agent can be a small molecule, polynucleotide, or polypeptide. In some embodiments, the therapeutic agent is an ASO. Various regions or sequences on the ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 pre-mRNA can be targeted by a therapeutic agent, such as an ASO. In some embodiments, the ASO targets a ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 pre-mRNA transcript containing an NIE. In some embodiments, the ASO targets a sequence within an NIE of a ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 pre-mRNA transcript. In some embodiments, the ASO targets a sequence upstream (or 5') from the 5' end of an NIE (3'ss) of a ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 pre-mRNA transcript. In some embodiments, the ASO targets a sequence downstream (or 3') from the 3' end of an NIE (5'ss) of a ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 pre-mRNA transcript. In some embodiments, the ASO targets a sequence that is within an intron flanking on the 5' end of the NIE of a ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 pre-mRNA transcript. In some embodiments, the ASO targets a sequence that is within an intron flanking the 3' end of the NIE of a ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 pre-mRNA transcript. In some embodiments, the ASO targets a sequence comprising an NIE-intron boundary of a ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 pre-mRNA transcript. An NIE-intron boundary can refer to the junction of an intron sequence and an NIE region. The intron sequence can flank the 5' end of the NIE, or the 3' end of the NIE. In some embodiments, the ASO targets a sequence within an exon of a ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 pre-mRNA transcript. In some embodiments, the ASO targets a sequence within an intron of a ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 pre-mRNA transcript. In some embodiments, the ASO targets a sequence comprising both a portion of an intron and a portion of an exon of a ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 pre-mRNA transcript.

In some embodiments, the ASO targets a sequence about 4 to about 300 nucleotides upstream (or 5') from the 5' end of the NIE. In some embodiments, the ASO targets a sequence about 1 to about 20 nucleotides, about 20 to about 50 nucleotides, about 50 to about 100 nucleotides, about 100 to about 150 nucleotides, about 150 to about 200 nucleotides, about 200 to about 250 nucleotides, or about 250 to about 300 nucleotides upstream (or 5') from the 5' end of the NIE region. In some embodiments, the ASO may target a sequence more than 300 nucleotides upstream from the 5' end of the NIE. In some embodiments, the ASO targets a sequence about 4 to about 300 nucleotides downstream (or 3') from the 3' end of the NIE. In some embodiments, the ASO targets a sequence about 1 to about 20 nucleotides, about 20 to about 50 nucleotides, about 50 to about 100 nucleotides, about 100 to about 150 nucleotides, about 150 to about 200 nucleotides, about 200 to about 250 nucleotides, or about 250 to about 300 nucleotides downstream from the 3' end of the NIE. In some embodiments, the ASO targets a sequence more than 300 nucleotides downstream from the 3' end of the NIE.

In some embodiments, the ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6AJ, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 NIE containing pre-mRNA transcript is encoded by a genetic sequence with at least about 80%, 85%, 90%, 95%, 96%, 97%, 98%, 99% or 100% sequence identity to any one of SEQ ID NO. 1-59 or 192-211. In some embodiments, the ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 NIE pre-mRNA transcript comprises a sequence with at least about 80%, 85%, 90%, 95%, 96%, 97%, 98%, 99% or 100% sequence identity to any one of SEQ ID NOs: 60-191.

In some embodiments, the ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6AJ, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 NIE containing pre-mRNA transcript (or NMD exon mRNA) comprises a sequence with at least about 80%, 85%, 90%, 95%, 97%, or 100% sequence identity to any one of SEQ ID NOs: 60-191. In some embodiments, ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 NIE containing pre-mRNA transcript (or NMD exon mRNA) is encoded by a sequence with at least about 80%, 85%, 90%, 95%, 97%, or 100% sequence identity to any one of SEQ ID NOs: 60-191. In some embodiments, the targeted portion of the NMD exon mRNA comprises a sequence with at least 80%, 85%, 90%, 95%, 97%, or 100% sequence identity to a region comprising at least 8 contiguous nucleic acids of any one of SEQ ID NOs: 60-191.

In some embodiments, the ASO targets exon 8× of a ABCB4 NIE containing pre-mRNA comprising NIE exon 8, exon 9× of a ASS1 NIE containing pre-mRNA comprising NIE exon 9, exon 16× of a ATP8B1 NIE containing pre-mRNA comprising NIE exon 16, exon 1× of a BAG3 NIE containing pre-mRNA comprising NIE exon 1, exon 31× of a CACNA1A NIE containing pre-mRNA comprising NIE exon 31, exon 36× of a CACNA1A NIE containing pre-mRNA comprising NIE exon 36, exon 37× of a CACNA1A NIE containing pre-mRNA comprising NIE exon 37, exon 3× of a CBS NIE containing pre-mRNA comprising NIE exon 3, exon 12× of a CBS NIE containing pre-mRNA comprising NIE exon 12, exon 1× of a CD55 NIE containing pre-mRNA comprising NIE exon 1, exon 16× of a CDKL5 NIE containing pre-mRNA comprising NIE exon 16, exon 3× of CFH NIE containing pre-mRNA comprising NIE exon 3, exon 30× of a CHD2 NIE containing pre-mRNA comprising NIE exon 30, exon 4× of CHRNA7 NIE containing pre-mRNA comprising NIE exon 4, exon 1× of CISD2 NIE containing pre-mRNA comprising NIE exon 1, exon 15× of CLN3 NIE containing pre-mRNA comprising NIE exon 15, exon 11× of a COL4A3 NIE containing pre-mRNA comprising NIE exon 11, exon 41× of a COL4A3 NIE containing pre-mRNA comprising NIE exon 41, exon 22× of a COL4A4 NIE containing pre-mRNA comprising NIE exon 22, exon 44× of a COL4A4 NIE containing pre-mRNA comprising NIE exon 44, exon 20× of DEPDC5 NIE containing pre-mRNA comprising NIE exon 20, exon 2× of a DHDDS NIE containing pre-mRNA comprising NIE exon 2, exon 3× of a ELOVL4 NIE containing pre-mRNA comprising NIE exon 3, exon 5× of a FAH NIE containing pre-mRNA comprising NIE exon 5, exon 4× of FXN NIE containing pre-mRNA comprising NIE exon 4, exon 4× of a GALE NIE containing pre-mRNA comprising NIE exon 4, exon 3× of a GBE1 NIE containing pre-mRNA comprising NIE exon 3, exon 11× of GRIN2A NIE containing pre-mRNA comprising NIE exon 11, exon 1× of GRN NIE containing pre-mRNA comprising NIE exon 1, exon 2× of a HEXA NIE containing pre-mRNA comprising NIE exon 2, exon 2× of a KANSL1 NIE containing pre-mRNA comprising NIE exon 2, exon 1× of a KCNQ2 NIE containing pre-mRNA comprising NIE exon 1, exon 50× of a KMT2D NIE containing pre-mRNA comprising NIE exon 50, exon 8× of MAPK3 NIE containing pre-mRNA comprising NIE exon 8, exon 13× of MBD5 NIE containing pre-mRNA comprising NIE exon 13, exon 2× of a MECP2 NIE containing pre-mRNA comprising NIE exon 2, exon 11× of MUT NIE containing pre-mRNA comprising NIE exon 11, exon 31× of NF1 NIE containing pre-mRNA comprising NIE exon 31, exon 7× of a NIPBL NIE containing pre-mRNA comprising NIE exon 7, exon 38× of a NIPBL NIE containing pre-mRNA comprising NIE exon 38, exon 11× of a NSD1 NIE containing pre-mRNA comprising NIE exon 11, exon 6× of a OPA1 NIE containing pre-mRNA comprising NIE exon 6, exon 28× of a OPA1 NIE containing pre-mRNA comprising NIE exon 28, exon 1× of OPTN NIE containing pre-mRNA comprising NIE exon 1, exon 1× of PCCA NIE containing pre-mRNA comprising NIE exon 1, exon 5× of a PCCB NIE containing pre-mRNA comprising NIE exon 5, exon 6× of a PCCB NIE containing pre-mRNA comprising NIE exon 6, exon 4× of a PKP2 NIE containing pre-mRNA comprising NIE exon 4, exon 23× of a PLCB1 NIE containing pre-mRNA comprising NIE exon 23, exon 3× of PRPF3 NIE containing pre-mRNA comprising NIE exon 3, exon 9× of PRPF31 NIE containing pre-mRNA comprising NIE exon 9, exon 1× of a RAI1 NIE containing pre-mRNA comprising NIE exon 1, exon 5× of RBFOX2 NIE containing pre-mRNA comprising NIE exon 5, exon 13× of SCN2A NIE containing pre-mRNA comprising NIE exon 13, exon 6× of SCN3A NIE containing pre-mRNA comprising NIE exon 6, exon 7× of SCN3A NIE containing pre-mRNA comprising NIE exon 7, exon 4× of SCN8A NIE containing pre-mRNA comprising NIE exon 4, exon 6× of SCN8A NIE containing pre-mRNA comprising NIE exon 6, exon 20× of SCN8A NIE containing pre-mRNA comprising NIE exon 20, exon 6× of SCN9A NIE containing pre-mRNA comprising NIE exon 6, exon 24× of SHANK3 NIE containing pre-mRNA comprising NIE exon 24, exon 3× of a SLC25A13 NIE containing pre-mRNA comprising NIE exon 3, exon 6× of a SLC25A13 NIE containing pre-mRNA comprising NIE exon 6, exon 9× of a SLC25A13 NIE containing pre-mRNA comprising NIE exon 9, exon 11× of a SLC25A13 NIE containing pre-mRNA comprising NIE exon 11, exon 13× of a SLC25A13 NIE containing pre-mRNA comprising NIE exon 13, exon 1× of SLC6A1 NIE containing pre-mRNA comprising NIE exon 1, exon 12× of a SPTAN1 NIE containing pre-mRNA comprising NIE exon 12, exon 10× of a TEK NIE containing pre-mRNA comprising NIE exon 10, exon 15× of a TEK NIE containing pre-mRNA comprising NIE exon 15, exon 1× of TOPORS NIE containing pre-mRNA comprising NIE exon 1, exon 11× of a TSC2 NIE containing pre-mRNA comprising NIE exon 11, exon 30× of a TSC2 NIE containing pre-mRNA comprising NIE exon 30, exon 1× of UBE3A NIE containing pre-mRNA comprising NIE exon 1, or exon 7× of a VCAN NIE containing pre-mRNA comprising NIE exon 7. In some embodiments, the ASO targets exon (GRCh38/hg38: chr1 243564285 243564388) of AKT3; exon (GRCh38/hg38: chr19 13236449 13236618) of CACNA1A; exon (GRCh38/hg38: chr21 43059730 43060012) of CBS; exon (GRCh38/hg38: chr1 207775610 207775745) of CD46; exon (GRCh38/hg38: chr1 196675450 196675529) of CFH; exon (GRCh38/hg38: chr15 92998149 92998261) of CHD2; exon (GRCh38/hg38: chr16 28479644 28479765) of CLN3; exon (GRCh38/hg38: chr6 33183634 33183698) of COL11A2; exon (GRCh38/hg38: chr2 227296487 227296526) of COL4A3; exon (GRCh38/hg38: chr2 227144653 227144833) of COL4A4; exon (GRCh38/hg38: chr2 227015283 227015360) of COL4A4; exon (GRCh38/hg38: chr1 207637688 207637848) of CR1; exon (GRCh38/hg38: chr19 47835403 47835579) of CRX; exon (GRCh38/hg38: chr1 59904366 59904516) of CYP2J2; exon (GRCh38/hg38: chr1 26442335 26442372) of DHDDS; exon (GRCh38/hg38: chr1 28230131 28230252) of DNAJC8; exon (GRCh38/hg38: chr2 88582755 88582824) of EIF2AK3; exon (GRCh38/hg38: chr17 64102673 64102804) of ERN1; exon (GRCh38/hg38: chr1 23798311 23798484) of GALE; exon (GRCh38/hg38: chrX 109383365 109383446) of GUCY2F; exon (GRCh38/hg38: chrX 109439038 109439175) of GUCY2F; exon (GRCh38/hg38: chr15 72362376 72362466) of HEXA; exon (GRCh38/hg38: chr15 72345677 72345776) of HEXA; exon (GRCh38/hg38: chr16 30115595 30115645) of MAPK3; exon (GRCh38/hg38: chr2 148460219 148460304) of MBD5; exon (GRCh38/hg38: chr2 148490695 148490787) of MBD5; exon (GRCh38/hg38: chr2 148505761 148505830) of MBD5; exon (GRCh38/hg38: chr6 49436522 49436597) of MUT; exon (GRCh38/hg38: chr19 50230825 50230999) of MYH14; exon (GRCh38/hg38: chr6 75867431 75867523) of MYO6; exon (GRCh38/hg38: chr17 31249955 31250125) of NF1; exon (GRCh38/hg38: chr22 29628658 29628773) of NF2; exon (GRCh38/hg38: chr5 37048127 37048354) of NIPBL; exon (GRCh38/hg38: chr12 100499841 100500024) of NR1H4; exon (GRCh38/hg38: chr5 177169394 177169559) of NSD1; exon (GRCh38/hg38: chr5 177200761 177200783) of NSD1; exon (GRCh38/hg38: chr5 177247924 177248079) of NSD1; exon (GRCh38/hg38: chr5 177275947 177276101) of NSD1; exon (GRCh38/hg38: chr3 193628509 193628616) of OPA1; exon (GRCh38/hg38: chr3 193603500 193603557) of OPA1; exon (GRCh38/hg38: chr13 100305751 100305834) of PCCA; exon (GRCh38/hg38: chr12 32894516 32894778) of PKP2; exon (GRCh38/hg38: chr22 46203575 46203752) of PPARA; exon (GRCh38/hg38: chr1 150327557 150327652) of PRPF3; exon (GRCh38/hg38: chr1 150330401 150330498) of PRPF3; exon (GRCh38/hg38: chr2 165327155 165327202) of SCN2A; exon (GRCh38/hg38: chr12 51688758 51688849) of SCN8A; exon (GRCh38/hg38: chr12 51780202 51780271) of SCN8A; exon (GRCh38/hg38: chr2 166304238 166304329) of SCN9A; exon (GRCh38/hg38: chr7 80794854 80794957) of SEMA3C; exon (GRCh38/hg38: chr7 85059498 85059541) of SEMA3D; exon (GRCh38/hg38: chr11 225673 226081) of SIRT3; exon (GRCh38/hg38: chr19 1216268 1216398) of STK11; exon (GRCh38/hg38: chr19 1221621 1221846) of STK11; exon (GRCh38/hg38: chr6 33448789 33448868) of SYNGAP1; exon (GRCh38/hg38: chr9 32551365

32551469) of TOPORS; exon (GRCh38/hg38: chr5 83544965 83545070) of VCAN.

In some embodiments, the ASO targets a sequence about 1500 nucleotides, about 1000 nucleotides, about 800 nucleotides, about 700 nucleotides, about 600 nucleotides, about 500 nucleotides, about 400 nucleotides, about 300 nucleotides, about 200 nucleotides, about 100 nucleotides, about 80 nucleotides, about 70 nucleotides, about 60 nucleotides, about 50 nucleotides upstream (or 5') from the 5' end of exon 8× of ABCB4, exon 9× of ASS1, exon 16× of ATP8B1, exon 1× of BAG3, exon 31× of CACNA1A, exon 36× of CACNA1A, exon 37× of CACNA1A, exon 3× of CBS, exon 12× of CBS, exon 1× of CD55, exon 16× of CDKL5, exon 3× of CFH, exon 30× of CHD2, exon 4× of CHRNA7, exon 1× of CISD2, exon 15× of CLN3, exon 11× of COL4A3, exon 41× of COL4A3, exon 22× of COL4A4, exon 44× of COL4A4, exon 20× of DEPDC5, exon 2× of DHDDS, exon 3× of ELOVL4, exon 5× of FAH, exon 4× of FXN, exon 4× of GALE, exon 3× of GBE1, exon 11× of GRIN2A, exon 1× of GRN, exon 2× of HEXA, exon 2× of KANSL1, exon 1× of KCNQ2, exon 50× of KMT2D, exon 8× of MAPK3, exon 13× of MBD5, exon 2× of MECP2, exon 11× of MUT, exon 31× of NF1, exon 7× of NIPBL, exon 38× of NIPBL, exon 11× of NSD1, exon 6× of OPA1, exon 28× of OPA1, exon 1× of OPTN, exon 1× of PCCA, exon 5× of PCCB, exon 6× of PCCB, exon 4× of PKP2, exon 23× of PLCB1, exon 3× of PRPF3, exon 9× of PRPF31, exon 1× of RAI1, exon 5× of RBFOX2, exon 13× of SCN2A, exon 6× of SCN3A, exon 7× of SCN3A, exon 4× of SCN8A, exon 6× of SCN8A, exon 20× of SCN8A, exon 6× of SCN9A, exon 24× of SHANK3, exon 3× of SLC25A13, exon 6× of SLC25A13, exon 9× of SLC25A13, exon 11× of SLC25A13, exon 13× of SLC25A13, exon 1× of SLC6A1, exon 12× of SPTAN1, exon 10× of TEK, exon 15× of TEK, exon 1× of TOPORS, exon 11× of TSC2, exon 30× of TSC2, exon 1× of UBE3A, or exon 7× of VCAN. In some embodiments, the ASO targets a sequence about 1500 nucleotides, about 1000 nucleotides, about 800 nucleotides, about 700 nucleotides, about 600 nucleotides, about 500 nucleotides, about 400 nucleotides, about 300 nucleotides, about 200 nucleotides, about 100 nucleotides, about 80 nucleotides, about 70 nucleotides, about 60 nucleotides, about 50 nucleotides upstream (or 5') from GRCh38/hg38: chr1 243564388 of AKT3; GRCh38/hg38: chr19 13236618 of CACNA1A; GRCh38/hg38: chr21 43060012 of CBS; GRCh38/hg38: chr1 207775610 of CD46; GRCh38/hg38: chr1 196675450 of CFH; GRCh38/hg38: chr15 92998149 of CHD2; GRCh38/hg38: chr16 28479765 of CLN3; GRCh38/hg38: chr6 33183698 of COL11A2; GRCh38/hg38: chr2 227296487 of COL4A3; GRCh38/hg38: chr2 227144833 of COL4A4; GRCh38/hg38: chr2 227015360 of COL4A4; GRCh38/hg38: chr1 207637688 of CR1; GRCh38/hg38: chr19 47835403 of CRX; GRCh38/hg38: chr1 59904516 of CYP2J2; GRCh38/hg38: chr1 26442335 of DHDDS; GRCh38/hg38: chr1 28230252 of DNAJC8; GRCh38/hg38: chr2 88582824 of EIF2AK3; GRCh38/hg38: chr17 64102804 of ERN1; GRCh38/hg38: chr1 23798484 of GALE; GRCh38/hg38: chrX 109383446 of GUCY2F; GRCh38/hg38: chrX 109439175 of GUCY2F; GRCh38/hg38: chr15 72362466 of HEXA; GRCh38/hg38: chr15 72345776 of HEXA; GRCh38/hg38: chr16 30115645 of MAPK3; GRCh38/hg38: chr2 148460219 of MBD5; GRCh38/hg38: chr2 148490695 of MBD5; GRCh38/hg38: chr2 148505761 of MBD5; GRCh38/hg38: chr6 49436597 of MUT; GRCh38/hg38: chr19 50230825 of MYH14; GRCh38/hg38: chr6 75867431 of MYO6; GRCh38/hg38: chr17 31249955 of NF1; GRCh38/hg38: chr22 29628658 of NF2; GRCh38/hg38: chr5 37048127 of NIPBL; GRCh38/hg38: chr12 100499841 of NR1H4; GRCh38/hg38: chr5 177169394 of NSD1; GRCh38/hg38: chr5 177200761 of NSD1; GRCh38/hg38: chr5 177247924 of NSD1; GRCh38/hg38: chr5 177275947 of NSD1; GRCh38/hg38: chr3 193628509 of OPA1; GRCh38/hg38: chr3 193603500 of OPA1; GRCh38/hg38: chr13 100305751 of PCCA; GRCh38/hg38: chr12 32894778 of PKP2; GRCh38/hg38: chr22 46203575 of PPARA; GRCh38/hg38: chr1 150327557 of PRPF3; GRCh38/hg38: chr1 150330401 of PRPF3; GRCh38/hg38: chr2 165327155 of SCN2A; GRCh38/hg38: chr12 51688758 of SCN8A; GRCh38/hg38: chr12 51780202 of SCN8A; GRCh38/hg38: chr2 166304329 of SCN9A; GRCh38/hg38: chr7 80794957 of SEMA3C; GRCh38/hg38: chr7 85059541 of SEMA3D; GRCh38/hg38: chr11 226081 of SIRT3; GRCh38/hg38: chr19 1216268 of STK11; GRCh38/hg38: chr19 1221621 of STK11; GRCh38/hg38: chr6 33448789 of SYNGAP1; GRCh38/hg38: chr9 32551469 of TOPORS; or GRCh38/hg38: chr5 83544965 of VCAN.

In some embodiments, the ASO targets a sequence at most about 1500 nucleotides, about 1000 nucleotides, about 800 nucleotides, about 700 nucleotides, about 600 nucleotides, about 500 nucleotides, about 400 nucleotides, about 300 nucleotides, about 200 nucleotides, about 100 nucleotides, about 80 nucleotides, about 70 nucleotides, about 60 nucleotides, about 50 nucleotides upstream (or 5') from the 5' end of exon 8× of ABCB4, exon 9× of ASS1, exon 16× of ATP8B1, exon 1× of BAG3, exon 31× of CACNA1A, exon 36× of CACNA1A, exon 37× of CACNA1A, exon 3× of CBS, exon 12× of CBS, exon 1× of CD55, exon 16× of CDKL5, exon 3× of CFH, exon 30× of CHD2, exon 4× of CHRNA7, exon 1× of CISD2, exon 15× of CLN3, exon 11× of COL4A3, exon 41× of COL4A3, exon 22× of COL4A4, exon 44× of COL4A4, exon 20× of DEPDC5, exon 2× of DHDDS, exon 3× of ELOVL4, exon 5× of FAH, exon 4× of FXN, exon 4× of GALE, exon 3× of GBE1, exon 11× of GRIN2A, exon 1× of GRN, exon 2× of HEXA, exon 2× of KANSL1, exon 1× of KCNQ2, exon 50× of KMT2D, exon 8× of MAPK3, exon 13× of MBD5, exon 2× of MECP2, exon 11× of MUT, exon 31× of NF1, exon 7× of NIPBL, exon 38× of NIPBL, exon 11× of NSD1, exon 6× of OPA1, exon 28× of OPA1, exon 1× of OPTN, exon 1× of PCCA, exon 5× of PCCB, exon 6× of PCCB, exon 4× of PKP2, exon 23× of PLCB1, exon 3× of PRPF3, exon 9× of PRPF31, exon 1× of RAI1, exon 5× of RBFOX2, exon 13× of SCN2A, exon 6× of SCN3A, exon 7× of SCN3A, exon 4× of SCN8A, exon 6× of SCN8A, exon 20× of SCN8A, exon 6× of SCN9A, exon 24× of SHANK3, exon 3× of SLC25A13, exon 6× of SLC25A13, exon 9× of SLC25A13, exon 11× of SLC25A13, exon 13× of SLC25A13, exon 1× of SLC6A1, exon 12× of SPTAN1, exon 10× of TEK, exon 15× of TEK, exon 1× of TOPORS, exon 11× of TSC2, exon 30× of TSC2, exon 1× of UBE3A, or exon 7× of VCAN. In some embodiments, the ASO targets a sequence at most about 1500 nucleotides, about 1000 nucleotides, about 800 nucleotides, about 700 nucleotides, about 600 nucleotides, about 500 nucleotides, about 400 nucleotides, about 300 nucleotides, about 200 nucleotides, about 100 nucleotides, about 80 nucleotides, about 70 nucleotides, about 60 nucleotides, about 50 nucleotides upstream (or 5') from GRCh38/hg38: chr1 243564388 of AKT3; GRCh38/hg38: chr19 13236618 of CACNA1A; GRCh38/hg38: chr21 43060012 of CBS; GRCh38/hg38: chr1 207775610 of CD46; GRCh38/hg38: chr1 196675450 of CFH; GRCh38/hg38: chr15 92998149 of CHD2; GRCh38/hg38: chr16 28479765 of CLN3; GRCh38/hg38: chr6 33183698 of COL11A2;

GRCh38/hg38: chr2 227296487 of COL4A3; GRCh38/hg38: chr2 227144833 of COL4A4; GRCh38/hg38: chr2 227015360 of COL4A4; GRCh38/hg38: chr1 207637688 of CR1; GRCh38/hg38: chr19 47835403 of CRX; GRCh38/hg38: chr1 59904516 of CYP2J2; GRCh38/hg38: chr1 26442335 of DHDDS; GRCh38/hg38: chr1 28230252 of DNAJC8; GRCh38/hg38: chr2 88582824 of EIF2AK3; GRCh38/hg38: chr17 64102804 of ERN1; GRCh38/hg38: chr1 23798484 of GALE; GRCh38/hg38: chrX 109383446 of GUCY2F; GRCh38/hg38: chrX 109439175 of GUCY2F; GRCh38/hg38: chr15 72362466 of HEXA; GRCh38/hg38: chr15 72345776 of HEXA; GRCh38/hg38: chr16 30115645 of MAPK3; GRCh38/hg38: chr2 148460219 of MBD5; GRCh38/hg38: chr2 148490695 of MBD5; GRCh38/hg38: chr2 148505761 of MBD5; GRCh38/hg38: chr6 49436597 of MUT; GRCh38/hg38: chr19 50230825 of MYH14; GRCh38/hg38: chr6 75867431 of MYO6; GRCh38/hg38: chr17 31249955 of NF1; GRCh38/hg38: chr22 29628658 of NF2; GRCh38/hg38: chr5 37048127 of NIPBL; GRCh38/hg38: chr12 100499841 of NR1H4; GRCh38/hg38: chr5 177169394 of NSD1; GRCh38/hg38: chr5 177200761 of NSD1; GRCh38/hg38: chr5 177247924 of NSD1; GRCh38/hg38: chr5 177275947 of NSD1; GRCh38/hg38: chr3 193628509 of OPA1; GRCh38/hg38: chr3 193603500 of OPA1; GRCh38/hg38: chr13 100305751 of PCCA; GRCh38/hg38: chr12 32894778 of PKP2; GRCh38/hg38: chr22 46203575 of PPARA; GRCh38/hg38: chr1 150327557 of PRPF3; GRCh38/hg38: chr1 150330401 of PRPF3; GRCh38/hg38: chr2 165327155 of SCN2A; GRCh38/hg38: chr12 51688758 of SCN8A; GRCh38/hg38: chr12 51780202 of SCN8A; GRCh38/hg38: chr2 166304329 of SCN9A; GRCh38/hg38: chr7 80794957 of SEMA3C; GRCh38/hg38: chr7 85059541 of SEMA3D; GRCh38/hg38: chr11 226081 of SIRT3; GRCh38/hg38: chr19 1216268 of STK11; GRCh38/hg38: chr19 1221621 of STK11; GRCh38/hg38: chr6 33448789 of SYNGAP1; GRCh38/hg38: chr9 32551469 of TOPORS; or GRCh38/hg38: chr5 83544965 of VCAN.

In some embodiments, the ASO targets a sequence about 1500 nucleotides, about 1000 nucleotides, about 800 nucleotides, about 700 nucleotides, about 600 nucleotides, about 500 nucleotides, about 400 nucleotides, about 300 nucleotides, about 200 nucleotides, about 100 nucleotides, about 80 nucleotides, about 70 nucleotides, about 60 nucleotides, about 50 nucleotides downstream (or 3') from the 3' end of exon 8× of ABCB4, exon 9× of ASS1, exon 16× of ATP8B1, exon 1× of BAG3, exon 31× of CACNA1A, exon 36× of CACNA1A, exon 37× of CACNA1A, exon 3× of CBS, exon 12× of CBS, exon 1× of CD55, exon 16× of CDKL5, exon 3× of CFH, exon 30× of CHD2, exon 4× of CHRNA7, exon 1× of CISD2, exon 15× of CLN3, exon 11× of COL4A3, exon 41× of COL4A3, exon 22× of COL4A4, exon 44× of COL4A4, exon 20× of DEPDC5, exon 2× of DHDDS, exon 3× of ELOVL4, exon 5× of FAH, exon 4× of FXN, exon 4× of GALE, exon 3× of GBE1, exon 11× of GRIN2A, exon 1× of GRN, exon 2× of HEXA, exon 2× of KANSL1, exon 1× of KCNQ2, exon 50× of KMT2D, exon 8× of MAPK3, exon 13× of MBD5, exon 2× of MECP2, exon 11× of MUT, exon 31× of NF1, exon 7× of NIPBL, exon 38× of NIPBL, exon 11× of NSD1, exon 6× of OPA1, exon 28× of OPA1, exon 1× of OPTN, exon 1× of PCCA, exon 5× of PCCB, exon 6× of PCCB, exon 4× of PKP2, exon 23× of PLCB1, exon 3× of PRPF3, exon 9× of PRPF31, exon 1× of RAI1, exon 5× of RBFOX2, exon 13× of SCN2A, exon 6× of SCN3A, exon 7× of SCN3A, exon 4× of SCN8A, exon 6× of SCN8A, exon 20× of SCN8A, exon 6× of SCN9A, exon 24× of SHANK3, exon 3× of SLC25A13, exon 6× of SLC25A13, exon 9× of SLC25A13, exon 11× of SLC25A13, exon 13× of SLC25A13, exon 1× of SLC6A1, exon 12× of SPTAN1, exon 10× of TEK, exon 15× of TEK, exon 1× of TOPORS, exon 11× of TSC2, exon 30× of TSC2, exon 1× of UBE3A, or exon 7× of VCAN. In some embodiments, the ASO targets a sequence about 1500 nucleotides, about 1000 nucleotides, about 800 nucleotides, about 700 nucleotides, about 600 nucleotides, about 500 nucleotides, about 400 nucleotides, about 300 nucleotides, about 200 nucleotides, about 100 nucleotides, about 80 nucleotides, about 70 nucleotides, about 60 nucleotides, about 50 nucleotides downstream (or 3') from GRCh38/hg38: chr1 243564285 of AKT3; GRCh38/hg38: chr19 13236449 of CACNA1A; GRCh38/hg38: chr21 43059730 of CBS; GRCh38/hg38: chr1 207775745 of CD46; GRCh38/hg38: chr1 196675529 of CFH; GRCh38/hg38: chr15 92998261 of CHD2; GRCh38/hg38: chr16 28479644 of CLN3; GRCh38/hg38: chr6 33183634 of COL11A2; GRCh38/hg38: chr2 227296526 of COL4A3; GRCh38/hg38: chr2 227144653 of COL4A4; GRCh38/hg38: chr2 227015283 of COL4A4; GRCh38/hg38: chr1 207637848 of CR1; GRCh38/hg38: chr19 47835579 of CRX; GRCh38/hg38: chr1 59904366 of CYP2J2; GRCh38/hg38: chr1 26442372 of DHDDS; GRCh38/hg38: chr1 28230131 of DNAJC8; GRCh38/hg38: chr2 88582755 of EIF2AK3; GRCh38/hg38: chr17 64102673 of ERN1; GRCh38/hg38: chr1 23798311 of GALE; GRCh38/hg38: chrX 109383365 of GUCY2F; GRCh38/hg38: chrX 109439038 of GUCY2F; GRCh38/hg38: chr15 72362376 of HEXA; GRCh38/hg38: chr15 72345677 of HEXA; GRCh38/hg38: chr16 30115595 of MAPK3; GRCh38/hg38: chr2 148460304 of MBD5; GRCh38/hg38: chr2 148490787 of MBD5; GRCh38/hg38: chr2 148505830 of MBD5; GRCh38/hg38: chr6 49436522 of MUT; GRCh38/hg38: chr19 50230999 of MYH14; GRCh38/hg38: chr6 75867523 of MYO6; GRCh38/hg38: chr17 31250125 of NF1; GRCh38/hg38: chr22 29628773 of NF2; GRCh38/hg38: chr5 37048354 of NIPBL; GRCh38/hg38: chr12 100500024 of NR1H4; GRCh38/hg38: chr5 177169559 of NSD1; GRCh38/hg38: chr5 177200783 of NSD1; GRCh38/hg38: chr5 177248079 of NSD1; GRCh38/hg38: chr5 177276101 of NSD1; GRCh38/hg38: chr3 193628616 of OPA1; GRCh38/hg38: chr3 193603557 of OPA1; GRCh38/hg38: chr13 100305834 of PCCA; GRCh38/hg38: chr12 32894516 of PKP2; GRCh38/hg38: chr22 46203752 of PPARA; GRCh38/hg38: chr1 150327652 of PRPF3; GRCh38/hg38: chr1 150330498 of PRPF3; GRCh38/hg38: chr2 165327202 of SCN2A; GRCh38/hg38: chr12 51688849 of SCN8A; GRCh38/hg38: chr12 51780271 of SCN8A; GRCh38/hg38: chr2 166304238 of SCN9A; GRCh38/hg38: chr7 80794854 of SEMA3C; GRCh38/hg38: chr7 85059498 of SEMA3D; GRCh38/hg38: chr11 225673 of SIRT3; GRCh38/hg38: chr19 1216398 of STK11; GRCh38/hg38: chr19 1221846 of STK11; GRCh38/hg38: chr6 33448868 of SYNGAP1; GRCh38/hg38: chr9 32551365 of TOPORS; or GRCh38/hg38: chr5 83545070 of VCAN.

In some embodiments, the ASO targets a sequence at most about 1500 nucleotides, about 1000 nucleotides, about 800 nucleotides, about 700 nucleotides, about 600 nucleotides, about 500 nucleotides, about 400 nucleotides, about 300 nucleotides, about 200 nucleotides, about 100 nucleotides, about 80 nucleotides, about 70 nucleotides, about 60 nucleotides, about 50 nucleotides downstream (or 3') from the 3' end of exon 8× of ABCB4, exon 9× of ASS1, exon 16× of ATP8B1, exon 1× of BAG3, exon 31× of CACNA1A, exon 36× of CACNA1A, exon 37× of CACNA1A, exon 3× of CBS, exon 12× of CBS, exon 1× of CD55, exon 16× of CDKL5, exon 3× of CFH, exon 30× of CHD2, exon 4× of CHRNA7, exon 1× of CISD2, exon 15× of CLN3, exon 11× of COL4A3, exon 41× of COL4A3, exon 22× of COL4A4, exon 44× of COL4A4, exon 20× of DEPDC5, exon 2× of DHDDS, exon 3× of ELOVL4, exon 5× of FAH, exon 4× of FXN, exon 4× of GALE, exon 3× of GBE1, exon 11× of GRIN2A, exon 1× of GRN, exon 2× of HEXA, exon 2× of KANSL1, exon 1× of KCNQ2, exon 50× of KMT2D, exon 8× of MAPK3, exon 13× of MBD5, exon 2× of MECP2, exon 11× of MUT, exon 31× of NF1, exon 7× of NIPBL, exon 38× of NIPBL, exon 11× of NSD1, exon 6× of OPA1, exon 28× of OPA1, exon 1× of OPTN, exon 1× of PCCA, exon 5× of PCCB, exon 6× of PCCB, exon 4× of PKP2, exon 23× of PLCB1, exon 3× of PRPF3, exon 9× of PRPF31, exon 1× of RAI1, exon 5× of RBFOX2, exon 13× of SCN2A, exon 6× of SCN3A, exon 7× of SCN3A, exon 4× of SCN8A, exon 6× of SCN8A, exon 20× of SCN8A, exon 6× of SCN9A, exon 24× of SHANK3, exon 3× of SLC25A13, exon 6× of SLC25A13, exon 9× of SLC25A13, exon 11× of SLC25A13, exon 13× of SLC25A13, exon 1× of SLC6A1, exon 12× of SPTAN1, exon 10× of TEK, exon 15× of TEK, exon 1× of TOPORS, exon 11× of TSC2, exon 30× of TSC2, exon 1× of UBE3A, or exon 7× of VCAN. In some embodiments, the ASO targets a sequence at most about 1500 nucleotides, about 1000 nucleotides, about 800 nucleotides, about 700 nucleotides, about 600 nucleotides, about 500 nucleotides, about 400 nucleotides, about 300 nucleotides, about 200 nucleotides, about 100 nucleotides, about 80 nucleotides, about 70 nucleotides, about 60 nucleotides, about 50 nucleotides downstream (or 3') from GRCh38/hg38: chr1 243564285 of AKT3; GRCh38/hg38: chr19 13236449 of CACNA1A; GRCh38/hg38: chr21 43059730 of CBS; GRCh38/hg38: chr1 207775745 of CD46; GRCh38/hg38: chr1 196675529 of CFH; GRCh38/hg38: chr15 92998261 of CHD2; GRCh38/hg38: chr16 28479644 of CLN3; GRCh38/hg38: chr6 33183634 of COL11A2; GRCh38/hg38: chr2 227296526 of COL4A3; GRCh38/hg38: chr2 227144653 of COL4A4; GRCh38/hg38: chr2 227015283 of COL4A4; GRCh38/hg38: chr1 207637848 of CR1; GRCh38/hg38: chr19 47835579 of CRX; GRCh38/hg38: chr1 59904366 of CYP2J2; GRCh38/hg38: chr1 26442372 of DHDDS; GRCh38/hg38: chr1 28230131 of DNAJC8; GRCh38/hg38: chr2 88582755 of EIF2AK3; GRCh38/hg38: chr17 64102673 of ERN1; GRCh38/hg38: chr1 23798311 of GALE; GRCh38/hg38: chrX 109383365 of GUCY2F; GRCh38/hg38: chrX 109439038 of GUCY2F; GRCh38/hg38: chr15 72362376 of HEXA; GRCh38/hg38: chr15 72345677 of HEXA; GRCh38/hg38: chr16 30115595 of MAPK3; GRCh38/hg38: chr2 148460304 of MBD5; GRCh38/hg38: chr2 148490787 of MBD5; GRCh38/hg38: chr2 148505830 of MBD5; GRCh38/hg38: chr6 49436522 of MUT; GRCh38/hg38: chr19 50230999 of MYH14; GRCh38/hg38: chr6 75867523 of MYO6; GRCh38/hg38: chr17 31250125 of NF1; GRCh38/hg38: chr22 29628773 of NF2; GRCh38/hg38: chr5 37048354 of NIPBL; GRCh38/hg38: chr12 100500024 of NR1H4; GRCh38/hg38: chr5 177169559 of NSD1; GRCh38/hg38: chr5 177200783 of NSD1; GRCh38/hg38: chr5 177248079 of NSD1; GRCh38/hg38: chr5 177276101 of NSD1; GRCh38/hg38: chr3 193628616 of OPA1; GRCh38/hg38: chr3 193603557 of OPA1; GRCh38/hg38: chr13 100305834 of PCCA; GRCh38/hg38: chr12 32894516 of PKP2; GRCh38/hg38: chr22 46203752 of PPARA; GRCh38/hg38: chr1 150327652 of PRPF3; GRCh38/hg38: chr1 150330498 of PRPF3; GRCh38/hg38: chr2 165327202 of SCN2A; GRCh38/hg38: chr12 51688849 of SCN8A; GRCh38/hg38: chr12 51780271 of SCN8A; GRCh38/hg38: chr2 166304238 of SCN9A; GRCh38/hg38: chr7 80794854 of SEMA3C; GRCh38/hg38: chr7 85059498 of SEMA3D; GRCh38/hg38: chr11 225673 of SIRT3; GRCh38/hg38: chr19 1216398 of STK11; GRCh38/hg38: chr19 1221846 of STK11; GRCh38/hg38: chr6 33448868 of SYNGAP1; GRCh38/hg38: chr9 32551365 of TOPORS; or GRCh38/hg38: chr5 83545070 of VCAN.

In some embodiments, the ASO has a sequence complementary to the targeted portion of the NMD exon mRNA according to any one of SEQ ID NOs: 60-191.

In some embodiments, the ASO targets a sequence upstream from the 5' end of an NIE. For example, ASOs targeting a sequence upstream from the 5' end of an NIE (e.g. exon 8× of ABCB4, exon 9× of ASS1, exon 16× of ATP8B1, exon 1× of BAG3, exon 31× of CACNA1A, exon 36× of CACNA1A, exon 37× of CACNA1A, exon 3× of CBS, exon 12× of CBS, exon 1× of CD55, exon 16× of CDKL5, exon 3× of CFH, exon 30× of CHD2, exon 4× of CHRNA7, exon 1× of CISD2, exon 15× of CLN3, exon 11× of COL4A3, exon 41× of COL4A3, exon 22× of COL4A4, exon 44× of COL4A4, exon 20× of DEPDC5, exon 2× of DHDDS, exon 3× of ELOVL4, exon 5× of FAH, exon 4× of FXN, exon 4× of GALE, exon 3× of GBE1, exon 11× of GRIN2A, exon 1× of GRN, exon 2× of HEXA, exon 2× of KANSL1, exon 1× of KCNQ2, exon 50× of KMT2D, exon 8× of MAPK3, exon 13× of MBD5, exon 2× of MECP2, exon 11× of MUT, exon 31× of NF1, exon 7× of NIPBL, exon 38× of NIPBL, exon 11× of NSD1, exon 6× of OPA1, exon 28× of OPA1, exon 1× of OPTN, exon 1× of PCCA, exon 5× of PCCB, exon 6× of PCCB, exon 4× of PKP2, exon 23× of PLCB1, exon 3× of PRPF3, exon 9× of PRPF31, exon 1× of RAI1, exon 5× of RBFOX2, exon 13× of SCN2A, exon 6× of SCN3A, exon 7× of SCN3A, exon 4× of SCN8A, exon 6× of SCN8A, exon 20× of SCN8A, exon 6× of SCN9A, exon 24× of SHANK3, exon 3× of SLC25A13, exon 6× of SLC25A13, exon 9× of SLC25A13, exon 11× of SLC25A13, exon 13× of SLC25A13, exon 1× of SLC6A1, exon 12× of SPTAN1, exon 10× of TEK, exon 15× of TEK, exon 1× of TOPORS, exon 11× of TSC2, exon 30× of TSC2, exon 1× of UBE3A, or exon 7× of VCAN) comprises a sequence that is at least about 80%, 85%, 90%, 95%, 97%, or 100% complimentary to at least 8 contiguous nucleic acids of any one of SEQ ID NOs: 60-134. For example, ASOs targeting a sequence upstream from the 5' end of an NIE (e.g., exon (GRCh38/hg38: chr1 243564285 243564388) of AKT3; exon (GRCh38/hg38: chr19 13236449 13236618) of CACNA1A; exon (GRCh38/hg38: chr21 43059730 43060012) of CBS; exon (GRCh38/hg38: chr1 207775610 207775745) of CD46; exon (GRCh38/hg38: chr1 196675450 196675529) of CFH; exon (GRCh38/hg38: chr15 92998149 92998261) of CHD2; exon (GRCh38/hg38: chr16 28479644 28479765) of CLN3; exon (GRCh38/hg38: chr6 33183634 33183698) of COL11A2; exon (GRCh38/hg38: chr2 227296487 227296526) of COL4A3; exon (GRCh38/hg38: chr2 227144653 227144833) of COL4A4; exon (GRCh38/hg38: chr2 227015283 227015360) of COL4A4; exon (GRCh38/hg38: chr1 207637688 207637848) of CR1; exon (GRCh38/hg38: chr19 47835403 47835579) of CRX; exon (GRCh38/hg38: chr1 59904366 59904516) of CYP2J2; exon (GRCh38/hg38: chr1 26442335 26442372) of DHDDS; exon (GRCh38/hg38: chr1 28230131 28230252) of DNAJC8; exon (GRCh38/hg38: chr2 88582755 88582824) of EIF2AK3; exon (GRCh38/hg38: chr17 64102673 64102804) of ERN1; exon (GRCh38/hg38: chr1 23798311 23798484) of GALE; exon (GRCh38/hg38: chrX 109383365 109383446) of GUCY2F; exon (GRCh38/hg38: chrX 109439038 109439175) of GUCY2F; exon (GRCh38/hg38: chr15 72362376 72362466) of HEXA; exon (GRCh38/hg38: chr15 72345677 72345776) of HEXA; exon (GRCh38/hg38: chr16 30115595 30115645) of MAPK3; exon (GRCh38/hg38: chr2 148460219 148460304) of MBD5; exon (GRCh38/hg38: chr2 148490695 148490787) of MBD5; exon (GRCh38/hg38: chr2 148505761 148505830) of MBD5; exon (GRCh38/hg38: chr6 49436522 49436597) of MUT; exon (GRCh38/hg38: chr19 50230825 50230999) of MYH14; exon (GRCh38/hg38: chr6 75867431 75867523) of MYO6; exon (GRCh38/hg38: chr17 31249955 31250125) of NF1; exon (GRCh38/hg38: chr22 29628658 29628773) of NF2; exon (GRCh38/hg38: chr5 37048127 37048354) of NIPBL; exon (GRCh38/hg38: chr12 100499841 100500024) of NR1H4; exon (GRCh38/hg38: chr5 177169394 177169559) of NSD1; exon (GRCh38/hg38: chr5 177200761 177200783) of NSD1; exon (GRCh38/hg38: chr5 177247924 177248079) of NSD1; exon (GRCh38/hg38: chr5 177275947 177276101) of NSD1; exon (GRCh38/hg38: chr3 193628509 193628616) of OPA1; exon (GRCh38/hg38: chr3 193603500 193603557) of OPA1; exon (GRCh38/hg38: chr13 100305751 100305834) of PCCA; exon (GRCh38/hg38: chr12 32894516 32894778) of PKP2; exon (GRCh38/hg38: chr22 46203575 46203752) of PPARA; exon (GRCh38/hg38: chr1 150327557 150327652) of PRPF3; exon (GRCh38/hg38: chr1 150330401 150330498) of PRPF3; exon (GRCh38/hg38: chr2 165327155 165327202) of SCN2A; exon (GRCh38/hg38: chr12 51688758 51688849) of SCN8A; exon (GRCh38/hg38: chr12 51780202 51780271) of SCN8A; exon (GRCh38/hg38: chr2 166304238 166304329) of SCN9A; exon (GRCh38/hg38: chr7 80794854 80794957) of SEMA3C; exon (GRCh38/hg38: chr7 85059498 85059541) of SEMA3D; exon (GRCh38/hg38: chr11 225673 226081) of SIRT3; exon (GRCh38/hg38: chr19 1216268 1216398) of STK11; exon (GRCh38/hg38: chr19 1221621 1221846) of STK11; exon (GRCh38/hg38: chr6 33448789 33448868) of SYNGAP1; exon (GRCh38/hg38: chr9 32551365 32551469) of TOPORS; exon (GRCh38/hg38: chr5 83544965 83545070) of VCAN) can comprise a sequence with at least 80%, 85%, 90%, 95%, 97%, or 100% sequence identity to any one of SEQ ID NOs: 135-191.

In some embodiments, the ASOs target a sequence containing an exon-intron boundary (or junction). For example, ASOs targeting a sequence containing an exon-intron boundary can comprise a sequence that is at least about 80%, 85%, 90%, 95%, 97%, or 100% complimentary to at least 8 contiguous nucleic acids of any one of SEQ ID NOs: 60-191. In some embodiments, the ASOs target a sequence downstream from the 3' end of an NIE. For example, ASOs targeting a sequence downstream from the 3' end of an NIE (e.g. exon 8× of ABCB4, exon 9× of ASS1, exon 16× of ATP8B1, exon 1× of BAG3, exon 31× of CACNA1A, exon 36× of CACNA1A, exon 37× of CACNA1A, exon 3× of CBS, exon 12× of CBS, exon 1× of CD55, exon 16× of CDKL5, exon 3× of CFH, exon 30× of CHD2, exon 4× of CHRNA7, exon 1× of CISD2, exon 15× of CLN3, exon 11× of COL4A3, exon 41× of COL4A3, exon 22× of COL4A4, exon 44× of COL4A4, exon 20× of DEPDC5, exon 2× of DHDDS, exon 3× of ELOVL4, exon 5× of FAH, exon 4× of FXN, exon 4× of GALE, exon 3× of GBE1, exon 11× of GRIN2A, exon 1× of GRN, exon 2× of HEXA, exon 2× of KANSL1, exon 1× of KCNQ2, exon 50× of KMT2D, exon 8× of MAPK3, exon 13× of MBD5, exon 2× of MECP2, exon 11× of MUT, exon 31× of NF1, exon 7× of NIPBL, exon 38× of NIPBL, exon 11× of NSD1, exon 6× of OPA1, exon 28× of OPA1, exon 1× of OPTN, exon 1× of PCCA, exon 5× of PCCB, exon 6× of PCCB, exon 4× of PKP2, exon 23× of PLCB1, exon 3× of PRPF3, exon 9× of PRPF31, exon 1× of RAI1, exon 5× of RBFOX2, exon 13× of SCN2A, exon 6× of SCN3A, exon 7× of SCN3A, exon 4× of SCN8A, exon 6× of SCN8A, exon 20× of SCN8A, exon 6× of SCN9A, exon 24× of SHANK3, exon 3× of SLC25A13, exon 6× of SLC25A13, exon 9× of SLC25A13, exon 11× of SLC25A13, exon 13× of SLC25A13, exon 1× of SLC6A1, exon 12× of SPTAN1, exon 10× of TEK, exon 15× of TEK, exon 1× of TOPORS, exon 11× of TSC2, exon 30× of TSC2, exon 1× of UBE3A, or exon 7× of VCAN) can comprise a sequence with at least 80%, 85%, 90%, 95%, 97%, or 100% sequence identity to any one of SEQ ID NOs: 60-134. For example, ASOs targeting a sequence downstream from the 3' end of an NIE (e.g., exon (GRCh38/hg38: chr1 243564285 243564388) of AKT3; exon (GRCh38/hg38: chr19 13236449 13236618) of CACNA1A; exon (GRCh38/hg38: chr21 43059730 43060012) of CBS; exon (GRCh38/hg38: chr1 207775610 207775745) of CD46; exon (GRCh38/hg38: chr1 196675450 196675529) of CFH; exon (GRCh38/hg38: chr15 92998149 92998261) of CHD2; exon (GRCh38/hg38: chr16 28479644 28479765) of CLN3; exon (GRCh38/hg38: chr6 33183634 33183698) of COL11A2; exon (GRCh38/hg38: chr2 227296487 227296526) of COL4A3; exon (GRCh38/hg38: chr2 227144653 227144833) of COL4A4; exon (GRCh38/hg38: chr2 227015283 227015360) of COL4A4; exon (GRCh38/hg38: chr1 207637688 207637848) of CR1; exon (GRCh38/hg38: chr19 47835403 47835579) of CRX; exon (GRCh38/hg38: chr1 59904366 59904516) of CYP2J2; exon (GRCh38/hg38: chr1 26442335 26442372) of DHDDS; exon (GRCh38/hg38: chr1 28230131 28230252) of DNAJC8; exon (GRCh38/hg38: chr2 88582755 88582824) of EIF2AK3; exon (GRCh38/hg38: chr17 64102673 64102804) of ERN1; exon (GRCh38/hg38: chr1 23798311 23798484) of GALE; exon (GRCh38/hg38: chrX 109383365 109383446) of GUCY2F; exon (GRCh38/hg38: chrX 109439038 109439175) of GUCY2F; exon (GRCh38/hg38: chr15 72362376 72362466) of HEXA; exon (GRCh38/hg38: chr15 72345677 72345776) of HEXA; exon (GRCh38/hg38: chr16 30115595 30115645) of MAPK3; exon (GRCh38/hg38: chr2 148460219 148460304) of MBD5; exon (GRCh38/hg38: chr2 148490695 148490787) of MBD5; exon (GRCh38/hg38: chr2 148505761 148505830) of MBD5; exon (GRCh38/hg38: chr6 49436522 49436597) of MUT; exon (GRCh38/hg38: chr19 50230825 50230999) of MYH14; exon (GRCh38/hg38: chr6 75867431 75867523) of MYO6; exon (GRCh38/hg38: chr17 31249955 31250125) of NF1; exon (GRCh38/hg38: chr22 29628658 29628773) of NF2; exon (GRCh38/hg38: chr5 37048127 37048354) of NIPBL; exon (GRCh38/hg38: chr12 100499841 100500024) of NR1H4; exon (GRCh38/hg38: chr5 177169394 177169559) of NSD1; exon (GRCh38/hg38: chr5 177200761 177200783) of NSD1; exon (GRCh38/hg38: chr5 177247924 177248079) of NSD1; exon (GRCh38/hg38: chr5 177275947 177276101) of NSD1; exon (GRCh38/hg38: chr3 193628509 193628616) of OPA1; exon (GRCh38/hg38: chr3 193603500 193603557) of OPA1; exon (GRCh38/hg38: chr13 100305751 100305834) of PCCA; exon (GRCh38/hg38: chr12 32894516 32894778) of PKP2; exon (GRCh38/hg38: chr22 46203575 46203752) of PPARA; exon (GRCh38/hg38: chr1 150327557 150327652) of PRPF3; exon (GRCh38/hg38: chr1 150330401 150330498) of PRPF3; exon (GRCh38/hg38: chr2

165327155 165327202) of SCN2A; exon (GRCh38/hg38: chr12 51688758 51688849) of SCN8A; exon (GRCh38/hg38: chr12 51780202 51780271) of SCN8A; exon (GRCh38/hg38: chr2 166304238 166304329) of SCN9A; exon (GRCh38/hg38: chr7 80794854 80794957) of SEMA3C; exon (GRCh38/hg38: chr7 85059498 85059541) of SEMA3D; exon (GRCh38/hg38: chr11 225673 226081) of SIRT3; exon (GRCh38/hg38: chr19 1216268 1216398) of STK11; exon (GRCh38/hg38: chr19 1221846) of STK11; exon (GRCh38/hg38: chr6 33448789 33448868) of SYNGAP1; exon (GRCh38/hg38: chr9 32551365 32551469) of TOPORS; exon (GRCh38/hg38: chr5 83544965 83545070) of VCAN) can comprise a sequence with at least 80%, 85%, 90%, 95%, 97%, or 100% sequence identity to any one of SEQ ID NOs: 135-191. In some embodiments, ASOs target a sequence within an NIE.

In some embodiments, the ASO targets exon 8× of a ABCB4 NIE containing pre-mRNA comprising NIE exon 8, exon 9× of a ASS1 NIE containing pre-mRNA comprising NIE exon 9, exon 16× of a ATP8B1 NIE containing pre-mRNA comprising NIE exon 16, exon 1× of a BAG3 NIE containing pre-mRNA comprising NIE exon 1, exon 31× of a CACNA1A NIE containing pre-mRNA comprising NIE exon 31, exon 36× of a CACNA1A NIE containing pre-mRNA comprising NIE exon 36, exon 37× of a CACNA1A NIE containing pre-mRNA comprising NIE exon 37, exon 3× of a CBS NIE containing pre-mRNA comprising NIE exon 3, exon 12× of a CBS NIE containing pre-mRNA comprising NIE exon 12, exon 1× of a CD55 NIE containing pre-mRNA comprising NIE exon 1, exon 16× of a CDKL5 NIE containing pre-mRNA comprising NIE exon 16, exon 3× of CFH NIE containing pre-mRNA comprising NIE exon 3, exon 30× of a CHD2 NIE containing pre-mRNA comprising NIE exon 30, exon 4× of CHRNA7 NIE containing pre-mRNA comprising NIE exon 4, exon 1× of CISD2 NIE containing pre-mRNA comprising NIE exon 1, exon 15× of CLN3 NIE containing pre-mRNA comprising NIE exon 15, exon 11× of a COL4A3 NIE containing pre-mRNA comprising NIE exon 11, exon 41× of a COL4A3 NIE containing pre-mRNA comprising NIE exon 41, exon 22× of a COL4A4 NIE containing pre-mRNA comprising NIE exon 22, exon 44× of a COL4A4 NIE containing pre-mRNA comprising NIE exon 44, exon 20× of DEPDC5 NIE containing pre-mRNA comprising NIE exon 20, exon 2× of a DHDDS NIE containing pre-mRNA comprising NIE exon 2, exon 3× of a ELOVL4 NIE containing pre-mRNA comprising NIE exon 3, exon 5× of a FAH NIE containing pre-mRNA comprising NIE exon 5, exon 4× of FXN NIE containing pre-mRNA comprising NIE exon 4, exon 4× of a GALE NIE containing pre-mRNA comprising NIE exon 4, exon 3× of a GBE1 NIE containing pre-mRNA comprising NIE exon 3, exon 11× of GRIN2A NIE containing pre-mRNA comprising NIE exon 11, exon 1× of GRN NIE containing pre-mRNA comprising NIE exon 1, exon 2× of a HEXA NIE containing pre-mRNA comprising NIE exon 2, exon 2× of a KANSL1 NIE containing pre-mRNA comprising NIE exon 2, exon 1× of a KCNQ2 NIE containing pre-mRNA comprising NIE exon 1, exon 50× of a KMT2D NIE containing pre-mRNA comprising NIE exon 50, exon 8× of MAPK3 NIE containing pre-mRNA comprising NIE exon 8, exon 13× of MBD5 NIE containing pre-mRNA comprising NIE exon 13, exon 2× of a MECP2 NIE containing pre-mRNA comprising NIE exon 2, exon 11× of MUT NIE containing pre-mRNA comprising NIE exon 11, exon 31× of NF1 NIE containing pre-mRNA comprising NIE exon 31, exon 7× of a NIPBL NIE containing pre-mRNA comprising NIE exon 7, exon 38× of a NIPBL NIE containing pre-mRNA comprising NIE exon 38, exon 11× of a NSD1 NIE containing pre-mRNA comprising NIE exon 11, exon 6× of a OPA1 NIE containing pre-mRNA comprising NIE exon 6, exon 28× of a OPA1 NIE containing pre-mRNA comprising NIE exon 28, exon 1× of OPTN NIE containing pre-mRNA comprising NIE exon 1, exon 1× of PCCA NIE containing pre-mRNA comprising NIE exon 1, exon 5× of a PCCB NIE containing pre-mRNA comprising NIE exon 5, exon 6× of a PCCB NIE containing pre-mRNA comprising NIE exon 6, exon 4× of a PKP2 NIE containing pre-mRNA comprising NIE exon 4, exon 23× of a PLCB1 NIE containing pre-mRNA comprising NIE exon 23, exon 3× of PRPF3 NIE containing pre-mRNA comprising NIE exon 3, exon 9× of PRPF31 NIE containing pre-mRNA comprising NIE exon 9, exon 1× of a RAI1 NIE containing pre-mRNA comprising NIE exon 1, exon 5× of RBFOX2 NIE containing pre-mRNA comprising NIE exon 5, exon 13× of SCN2A NIE containing pre-mRNA comprising NIE exon 13, exon 6× of SCN3A NIE containing pre-mRNA comprising NIE exon 6, exon 7× of SCN3A NIE containing pre-mRNA comprising NIE exon 7, exon 4× of SCN8A NIE containing pre-mRNA comprising NIE exon 4, exon 6× of SCN8A NIE containing pre-mRNA comprising NIE exon 6, exon 20× of SCN8A NIE containing pre-mRNA comprising NIE exon 20, exon 6× of SCN9A NIE containing pre-mRNA comprising NIE exon 6, exon 24× of SHANK3 NIE containing pre-mRNA comprising NIE exon 24, exon 3× of a SLC25A13 NIE containing pre-mRNA comprising NIE exon 3, exon 6× of a SLC25A13 NIE containing pre-mRNA comprising NIE exon 6, exon 9× of a SLC25A13 NIE containing pre-mRNA comprising NIE exon 9, exon 11× of a SLC25A13 NIE containing pre-mRNA comprising NIE exon 11, exon 13× of a SLC25A13 NIE containing pre-mRNA comprising NIE exon 13, exon 1× of SLC6A1 NIE containing pre-mRNA comprising NIE exon 1, exon 12× of a SPTAN1 NIE containing pre-mRNA comprising NIE exon 12, exon 10× of a TEK NIE containing pre-mRNA comprising NIE exon 10, exon 15× of a TEK NIE containing pre-mRNA comprising NIE exon 15, exon 1× of TOPORS NIE containing pre-mRNA comprising NIE exon 1, exon 11× of a TSC2 NIE containing pre-mRNA comprising NIE exon 11, exon 30× of a TSC2 NIE containing pre-mRNA comprising NIE exon 30, exon 1× of UBE3A NIE containing pre-mRNA comprising NIE exon 1, or exon 7× of a VCAN NIE containing pre-mRNA comprising NIE exon 7. In some embodiments, the ASO targets a sequence downstream (or 3') from the 5' end of the exon 8× of ABCB4, exon 9× of ASS1, exon 16× of ATP8B1, exon 1× of BAG3, exon 31× of CACNA1A, exon 36× of CACNA1A, exon 37× of CACNA1A, exon 3× of CBS, exon 12× of CBS, exon 1× of CD55, exon 16× of CDKL5, exon 3× of CFH, exon 30× of CHD2, exon 4× of CHRNA7, exon 1× of CISD2, exon 15× of CLN3, exon 11× of COL4A3, exon 41× of COL4A3, exon 22× of COL4A4, exon 44× of COL4A4, exon 20× of DEPDC5, exon 2× of DHDDS, exon 3× of ELOVL4, exon 5× of FAH, exon 4× of FXN, exon 4× of GALE, exon 3× of GBE1, exon 11× of GRIN2A, exon 1× of GRN, exon 2× of HEXA, exon 2× of KANSL1, exon 1× of KCNQ2, exon 50× of KMT2D, exon 8× of MAPK3, exon 13× of MBD5, exon 2× of MECP2, exon 11× of MUT, exon 31× of NF1, exon 7× of NIPBL, exon 38× of NIPBL, exon 11× of NSD1, exon 6× of OPA1, exon 28× of OPA1, exon 1× of OPTN, exon 1× of PCCA, exon 5× of PCCB, exon 6× of PCCB, exon 4× of PKP2, exon 23× of PLCB1, exon 3× of PRPF3, exon 9× of PRPF31, exon 1× of RAI1, exon 5× of RBFOX2, exon 13× of SCN2A, exon 6× of SCN3A, exon 7× of SCN3A, exon 4× of SCN8A, exon 6× of SCN8A, exon 20× of SCN8A, exon 6× of SCN9A, exon 24× of SHANK3, exon 3× of SLC25A13, exon 6× of SLC25A13, exon 9× of SLC25A13, exon 11× of SLC25A13, exon 13× of SLC25A13, exon 1× of SLC6A1, exon 12× of SPTAN1, exon 10× of TEK, exon 15× of TEK, exon 1× of TOPORS, exon 11× of TSC2, exon 30× of TSC2, exon 1× of UBE3A, or exon 7× of VCAN pre-mRNA. In some embodiments, the ASO targets an exon 20× sequence upstream (or 5') from the 3' end of the exon 8× of ABCB4, exon 9× of ASS1, exon 16× of ATP8B1, exon 1× of BAG3, exon 31× of CACNA1A, exon 36× of CACNA1A, exon 37× of CACNA1A, exon 3× of CBS, exon 12× of CBS, exon 1× of CD55, exon 16× of CDKL5, exon 3× of CFH, exon 30× of CHD2, exon 4× of CHRNA7, exon 1× of CISD2, exon 15× of CLN3, exon 11× of COL4A3, exon 41× of COL4A3, exon 22× of COL4A4, exon 44× of COL4A4, exon 20× of DEPDC5, exon 2× of DHDDS, exon 3× of ELOVL4, exon 5× of FAH, exon 4× of FXN, exon 4× of GALE, exon 3× of GBE1, exon 11× of GRIN2A, exon 1× of GRN, exon 2× of HEXA, exon 2× of KANSL1, exon 1× of KCNQ2, exon 50× of KMT2D, exon 8× of MAPK3, exon 13× of MBD5, exon 2× of MECP2, exon 11× of MUT, exon 31× of NF1, exon 7× of NIPBL, exon 38× of NIPBL, exon 11× of NSD1, exon 6× of OPA1, exon 28× of OPA1, exon 1× of OPTN, exon 1× of PCCA, exon 5× of PCCB, exon 6× of PCCB, exon 4× of PKP2, exon 23× of PLCB1, exon 3× of PRPF3, exon 9× of PRPF31, exon 1× of RAI1, exon 5× of RBFOX2, exon 13× of SCN2A, exon 6× of SCN3A, exon 7× of SCN3A, exon 4× of SCN8A, exon 6× of SCN8A, exon 20× of SCN8A, exon 6× of SCN9A, exon 24× of SHANK3, exon 3× of SLC25A13, exon 6× of SLC25A13, exon 9× of SLC25A13, exon 11× of SLC25A13, exon 13× of SLC25A13, exon 1× of SLC6A1, exon 12× of SPTAN1, exon 10× of TEK, exon 15× of TEK, exon 1× of TOPORS, exon 11× of TSC2, exon 30× of TSC2, exon 1× of UBE3A, or exon 7× of VCAN pre-mRNA.

In some embodiments, the targeted portion of the ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6AJ, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 NIE containing pre-mRNA is in intron 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50. In some embodiments, hybridization of an ASO to the targeted portion of the NIE pre-mRNA results in exon skipping of at least one of NIE within intron 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50, and subsequently increases ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein production. In some embodiments, the targeted portion of the ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6AJ, SPTAN1, TEK, TOPORS, TSC2, UBE3A, or VCAN NIE containing pre-mRNA is in intron 8 of ABCB4, intron 9 of ASS1, intron 16 of ATP8B1, intron 1 of BAG3, intron 31 of CACNA1A, intron 36 of CACNA1A, intron 37 of CACNA1A, intron 3 of CBS, intron 12 of CBS, intron 1 of CD55, intron 16 of CDKL5, intron 3 of CFH, intron 30 of CHD2, intron 4 of CHRNA7, intron 1 of CISD2, intron 15 of CLN3, intron 11 of COL4A3, intron 41 of COL4A3, intron 22 of COL4A4, intron 44 of COL4A4, intron 20 of DEPDC5, intron 2 of DHDDS, intron 3 of ELOVL4, intron 5 of FAH, intron 4 of FN, intron 4 of GALE, intron 3 of GBE1, intron 11 of GRIN2A, intron 1 of GRN, intron 2 of HEA, intron 2 of KANSL1, intron 50 of KMT2D, intron 8 of MAPK3, intron 13 of MBD5, intron 2 of MECP2, intron 11 of MUT, intron 31 of NF1, intron 7 of NIPBL, intron 38 of NIPBL, intron 11 of NSD1, intron 6 of OPA1, intron 28 of OPA1, intron 1 of OPTN, intron 1 of PCCA, intron 5 of PCCB, intron 6 of PCCB, intron 4 of PKP2, intron 23 of PLCB1, intron 3 of PRPF3, intron 9 of PRPF31, intron 1 of RAI1, intron 5 of RBFO2, intron 13 of SCN2A, intron 6 of SCN3A, intron 7 of SCN3A, intron 4 of SCN8A, intron 6 of SCN8A, intron 20 of SCN8A, intron 6 of SCN9A, intron 24 of SHANK3, intron 3 of SLC25A13, intron 6 of SLC25A13, intron 9 of SLC25A13, intron 11 of SLC25A13, intron 13 of SLC25A13, intron 1 of SLC6A1, intron 12 of SPTAN1, intron 10 of TEK, intron 15 of TEK, intron 1 of TOPORS, intron 11 of TSC2, intron 30 of TSC2, intron 1 of UBE3A, or intron 7 of VCAN. In some embodiments, the targeted portion of the AKT3, CACNA1A, CBS, CD46, CFH, CHD2, CLN3, COL11A2, COL4A3, COL4A4, COL4A4, CR1, CRX CYP2J2, DHDDS, DNAJC8, EIF2AK3, ERN1, GALE, GUCY2F, GUCY2F, HEXA, HEXA, MAPK3, MBD5, MBD5, MBD5, MUT, MYH14, MYO6, NF1, NF2, NIPBL, NR1H4, NSD1, NSD1, NSD1, NSD1, OPA1, OPA1, PCCA, PKP2, PPARA, PRPF3, PRPF3, SCN2A, SCN8A, SCN8A, SCN9A, SEMA3C, SEMA3D, SIRT3, STK11, STK11, SYNGAP1, TOPORS, or VCAN NIE containing pre-mRNA is intron (GRCh38/hg38: chr1 243563849 243572925) of AKT3; intron (GRCh38/hg38: chr19 13235731 13241520) of CACNA1A; intron (GRCh38/hg38: chr21 43059304 43060440) of CBS; intron (GRCh38/hg38: chr1 207770363 207783291) of CD46; intron (GRCh38/hg38: chr1 196673963 196675988) of CFH; intron (GRCh38/hg38: chr15 92997404 92998498) of CHD2; intron (GRCh38/hg38: chr16 28477878 28482104) of CLN3; intron (GRCh38/hg38: chr6 33181172 33184144) of COL11A2; intron (GRCh38/hg38: chr2 227295317 227297673) of COL4A3; intron (GRCh38/hg38: chr2 227144559 227147412) of COL4A4; intron (GRCh38/hg38: chr2 227012299 227022047) of COL4A4; intron (GRCh38/hg38: chr1 207630622 207639396) of CR1; intron (GRCh38/hg38: chr19 47834544 47836242) of CRX; intron (GRCh38/hg38: chr1 59901104 59904870) of CYP2J2; intron (GRCh38/hg38: chr1 26438285 26442730) of DHDDS; intron (GRCh38/hg38: chr1 28229025 28232920)

of DNAJC8; intron (GRCh38/hg38: chr2 88579641 88583429) of EIF2AK3; intron (GRCh38/hg38: chr17 64098242 64129975) of ERN1; intron (GRCh38/hg38: chr1 23798231 23798614) of GALE; intron (GRCh38/hg38: chrx 109382213 109385183) of GUCY2F; intron (GRCh38/hg38: chrx 109430397 109441350) of GUCY2F; intron (GRCh38/hg38: chr15 72356651 72375719) of HEXA; intron (GRCh38/hg38: chr15 72345552 72346234) of HEXA; intron (GRCh38/hg38: chr16 30114709 30116635) of MAPK3; intron (GRCh38/hg38: chr2 148458872 148462581) of MBD5; intron (GRCh38/hg38: chr2 148490595 148502435) of MBD5; intron (GRCh38/hg38: chr2 148502510 148510059) of MBD5; intron (GRCh38/hg38: chr6 49435625 49440205) of MUT; intron (GRCh38/hg38: chr19 50230624 50231929) of MYH14; intron (GRCh38/hg38: chr6 75867106 75870646) of MYO6; intron (GRCh38/hg38: chr17 31249120 31252937) of NF1; intron (GRCh38/hg38: chr22 29604113 29636750) of NF2; intron (GRCh38/hg38: chr5 37046200 37048501) of NIPBL; intron (GRCh38/hg38: chr12 100493403 100505574) of NR1H4; intron (GRCh38/hg38: chr5 177136031 177191883) of NSD1; intron (GRCh38/hg38: chr5 177192020 177204119) of NSD1; intron (GRCh38/hg38: chr5 177246797 177248180) of NSD1; intron (GRCh38/hg38: chr5 177273785 177280564) of NSD1; intron (GRCh38/hg38: chr3 193626203 193631611) of OPA1; intron (GRCh38/hg38: chr3 193593374 193614710) of OPA1; intron (GRCh38/hg38: chr13 100302999 100307191) of PCCA; intron (GRCh38/hg38: chr12 32879033 32896508) of PKP2; intron (GRCh38/hg38: chr22 46198592 46215172) of PPARA; intron (GRCh38/hg38: chr1 150325882 150328319) of PRPF3; intron (GRCh38/hg38: chr1 150328467 150332683) of PRPF3; intron (GRCh38/hg38: chr2 165326985 165331329) of SCN2A; intron (GRCh38/hg38: chr12 51687220 51689004) of SCN8A; intron (GRCh38/hg38: chr12 51774363 51786541) of SCN8A; intron (GRCh38/hg38: chr2 166304122 166305791) of SCN9A; intron (GRCh38/hg38: chr7 80789529 80798091) of SEMA3C; intron (GRCh38/hg38: chr7 85055860 85065423) of SEMA3D; intron (GRCh38/hg38: chr1 224241 230451) of SIRT3; intron (GRCh38/hg38: chr19 1207204 1218416) of STK11; intron (GRCh38/hg38: chr19 1221341 1221948) of STK11; intron (GRCh38/hg38: chr6 33447934 33451759) of SYNGAP1; intron (GRCh38/hg38: chr9 32550969 32552433) of TOPORS; or intron (GRCh38/hg38: chr5 83542269 83545536) of VCAN.

In some embodiments, the methods and compositions of the present disclosure are used to increase the expression of ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 by inducing exon skipping of a pseudo-exon of an ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 NIE containing pre-mRNA. In some embodiments, the pseudo-exon is a sequence within any of introns 1-50. In some embodiments, the pseudo-exon is a sequence within any of introns 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50. In some embodiments, the pseudo-exon can be any ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 intron or a portion thereof. In some embodiments, the pseudo-exon is within intron 8 of ABCB4, intron 9 of ASS1, intron 16 of ATP8B1, intron 1 of BAG3, intron 31 of CACNA1A, intron 36 of CACNA1A, intron 37 of CACNA1A, intron 3 of CBS, intron 12 of CBS, intron 1 of CD55, intron 16 of CDKL5, intron 3 of CFH, intron 30 of CHD2, intron 4 of CHRNA7, intron 1 of CISD2, intron 15 of CLN3, intron 11 of COL4A3, intron 41 of COL4A3, intron 22 of COL4A4, intron 44 of COL4A4, intron 20 of DEPDC5, intron 2 of DHDDS, intron 3 of ELOVL4, intron 5 of FAH, intron 4 of FN, intron 4 of GALE, intron 3 of GBE1, intron 11 of GRIN2A, intron 1 of GRN, intron 2 of HEA, intron 2 of KANSL1, intron 50 of KMT2D, intron 8 of MAPK3, intron 13 of MBD5, intron 2 of MECP2, intron 11 of MUT, intron 31 of NF1, intron 7 of NIPBL, intron 38 of NIPBL, intron 11 of NSD1, intron 6 of OPA1, intron 28 of OPA1, intron 1 of OPTN, intron 1 of PCCA, intron 5 of PCCB, intron 6 of PCCB, intron 4 of PKP2, intron 23 of PLCB1, intron 3 of PRPF3, intron 9 of PRPF31, intron 1 of RAI1, intron 5 of RBFO2, intron 13 of SCN2A, intron 6 of SCN3A, intron 7 of SCN3A, intron 4 of SCN8A, intron 6 of SCN8A, intron 20 of SCN8A, intron 6 of SCN9A, intron 24 of SHANK3, intron 3 of SLC25A13, intron 6 of SLC25A13, intron 9 of SLC25A13, intron 11 of SLC25A13, intron 13 of SLC25A13, intron 1 of SLC6A1, intron 12 of SPTAN1, intron 10 of TEK, intron 15 of TEK, intron 1 of TOPORS, intron 11 of TSC2, intron 30 of TSC2, intron 1 of UBE3A, or intron 7 of VCAN. In some embodiments, the pseudo-exon is within intron (GRCh38/hg38: chr1 243563849 243572925) of AKT3; intron (GRCh38/hg38: chr19 13235731 13241520) of CACNA1A; intron (GRCh38/hg38: chr21 43059304 43060440) of CBS; intron (GRCh38/hg38: chr1 207770363 207783291) of CD46; intron (GRCh38/hg38: chr1 196673963 196675988) of CFH; intron (GRCh38/hg38: chr15 92997404 92998498) of CHD2; intron (GRCh38/hg38: chr16 28477878 28482104) of CLN3; intron (GRCh38/hg38: chr6 33181172 33184144) of COL11A2; intron (GRCh38/hg38: chr2 227295317 227297673) of COL4A3; intron (GRCh38/hg38: chr2 227144559 227147412) of COL4A4; intron (GRCh38/hg38: chr2 227012299 227022047) of COL4A4; intron (GRCh38/ hg38: chr1 207630622 207639396) of CR1; intron (GRCh38/hg38: chr19 47834544 47836242) of CRX; intron (GRCh38/hg38: chr1 59901104 59904870) of CYP2J2; intron (GRCh38/hg38: chr1 26438285 26442730) of DHDDS; intron (GRCh38/hg38: chr1 28229025 28232920) of DNAJC8; intron (GRCh38/hg38: chr2 88579641 88583429) of EIF2AK3; intron (GRCh38/hg38: chr17 64098242 64129975) of ERN1; intron (GRCh38/hg38: chr1 23798231 23798614) of GALE; intron (GRCh38/hg38: chrx 109382213 109385183) of GUCY2F; intron (GRCh38/hg38: chrx 109430397 109441350) of GUCY2F; intron (GRCh38/hg38: chr15 72356651 72375719) of HEXA; intron (GRCh38/hg38: chr15 72345552 72346234) of HEXA; intron (GRCh38/hg38: chr16 30114709 30116635) of MAPK3; intron (GRCh38/hg38: chr2 148458872 148462581) of MBD5; intron (GRCh38/hg38: chr2 148490595 148502435) of MBD5; intron (GRCh38/hg38: chr2 148502510 148510059) of MBD5; intron (GRCh38/hg38: chr6 49435625 49440205) of MUT; intron (GRCh38/hg38: chr19 50230624 50231929) of MYH14; intron (GRCh38/hg38: chr6 75867106 75870646) of MYO6; intron (GRCh38/hg38: chr17 31249120 31252937) of NF1; intron (GRCh38/hg38: chr22 29604113 29636750) of NF2; intron (GRCh38/hg38: chr5 37046200 37048501) of NIPBL; intron (GRCh38/hg38: chr12 100493403 100505574) of NR1H4; intron (GRCh38/hg38: chr5 177136031 177191883) of NSD1; intron (GRCh38/hg38: chr5 177192020 177204119) of NSD1; intron (GRCh38/hg38: chr5 177246797 177248180) of NSD1; intron (GRCh38/hg38: chr5 177273785 177280564) of NSD1; intron (GRCh38/hg38: chr3 193626203 193631611) of OPA1; intron (GRCh38/hg38: chr3 193593374 193614710) of OPA1; intron (GRCh38/hg38: chr13 100302999 100307191) of PCCA; intron (GRCh38/hg38: chr12 32879033 32896508) of PKP2; intron (GRCh38/hg38: chr22 46198592 46215172) of PPARA; intron (GRCh38/hg38: chr1 150325882 150328319) of PRPF3; intron (GRCh38/hg38: chr1 150328467 150332683) of PRPF3; intron (GRCh38/hg38: chr2 165326985 165331329) of SCN2A; intron (GRCh38/hg38: chr12 51687220 51689004) of SCN8A; intron (GRCh38/hg38: chr12 51774363 51786541) of SCN8A; intron (GRCh38/hg38: chr2 166304122 166305791) of SCN9A; intron (GRCh38/hg38: chr7 80789529 80798091) of SEMA3C; intron (GRCh38/hg38: chr7 85055860 85065423) of SEMA3D; intron (GRCh38/hg38: chr11 224241 230451) of SIRT3; intron (GRCh38/hg38: chr19 1207204 1218416) of STK11; intron (GRCh38/hg38: chr19 1221341 1221948) of STK11; intron (GRCh38/hg38: chr6 33447934 33451759) of SYNGAP1; intron (GRCh38/hg38: chr9 32550969 32552433) of TOPORS; or intron (GRCh38/hg38: chr5 83542269 83545536) of VCAN.

Protein Expression

In some embodiments, the methods described herein are used to increase the production of a functional ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein or RNA. As used herein, the term "functional" refers to the amount of activity or function of a ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein or RNA that is necessary to eliminate any one or more symptoms of a treated condition or disease, e.g., Alport syndrome; Amyotrophic lateral sclerosis (ALS); Angelman syndrome; Aphasia, primary progressive; Arrhythmogenic right ventricular dysplasia 9; Autism spectrum disorder; Cardiomyopathy, dilated, 1HH; Myopathy, myofibrillar 6; Ceriod lipofuscinosis, neuronal, 3; Cholestasis, intrahepatic, of pregnancy, 3; Cholestasis, progressive familial intrahepatic 1; Citrullinemia Type II; Citrullinemia, Type 1; Cognitive impairment with or without cerebral ataxia; Cornelia de Lange; Early-onset epileptic encephalopathy; Epilepsy-aphasia spectrum; Epilepsy, generalized, with febrile seizures plus, type 7; Epileptic encephalopathy, childhood-onset; Epileptic encephalopathy, early infantile, 11; Epileptic encephalopathy, early infantile, 12; Epileptic encephalopathy, early infantile, 13; Epileptic encephalopathy, early infantile, 2; Episodic ataxia, type 2; Familial focal epilepsy; Febrile seizures, familial, 3B; Friedreich ataxia; Friedreich ataxia with retained reflexes; Galactose epimerase deficiency; Glaucoma 3, primary congenital, E; Glycogen storage disease IV; GRN-related frontotemporal dementia; Homocystinuria, B6-responsive and nonresponsive types; HSAN2D, autosomal recessive; Insensitivity to pain, congenital; Kabuki syndrome; Koolen-De Vries syndrome; Mental retardation, autosomal dominant 1; Methyl malonic aciduria; Migraine, Myoclonic-atonic epilepsy; familial hemiplegic, 1; Neurofibromatosis type 1; Opioid addiction; Optic atrophy type 1; Phelan-McDermid syndrome; Propionic acidemia; Primary open angle glaucoma; Propionic academia; Retinitis pigmentosa 11; Retinitis pigmentosa 18; Retinitis pigmentosa 31; Retinitis pigmentosa 59; Rett syndrome; Seizures, benign familial infantile, 3; Seizures, benign familial infantile, 5; Smith-Magenis syndrome; Sotos syndrome 1; Beckwith-Wiedemann syndrome; Stargardt disease 3; Tay-Sachs disease; Tuberous sclerosis; Tyrosinemia, type I; Wagner syndrome 1; West syndrome; Wolfram syndrome 2/NAFLD; 15q13.3 microdeletion; 16p11.2 deletion syndrome; Deafness, autosomal dominant 13; Cone-rod retinal dystrophy-2; Deafness, autosomal dominant 4A; Peripheral neuropathy, myopathy, hoarseness, and hearing loss; Deafness, autosomal dominant 22; Neurofibromatosis type 2; NASH; or Mental retardation, autosomal dominant 5. In some embodiments, the methods are used to increase the production of a partially functional ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein or RNA. As used herein, the term "partially functional" refers to any amount of activity or function of the ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein or RNA that is less than the amount of activity or function that is necessary to eliminate or prevent any one or more symptoms of a disease or condition. In some embodiments, a partially functional protein or RNA will have at least 10%, at least 20%, at least 30%, at least 40%, at least 50%, at least 60%, at least 70%, at least 75%, at least 80%, at least 85%, at least 90%, or at least 95% less activity relative to the fully functional protein or RNA.

In some embodiments, the method is a method of increasing the expression of the ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein by cells of a subject having a NIE containing pre-mRNA encoding the ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein, wherein the subject has Alport syndrome; Amyotrophic lateral sclerosis (ALS); Angelman syndrome; Aphasia, primary progressive; Arrhythmogenic right ventricular dysplasia 9; Autism spectrum disorder; Cardiomyopathy, dilated, 1HH; Myopathy, myofibrillar 6; Ceriod lipofuscinosis, neuronal, 3; Cholestasis, intrahepatic, of pregnancy, 3; Cholestasis, progressive familial intrahepatic 1; Citrullinemia Type II; Citrullinemia, Type 1; Cognitive impairment with or without cerebral ataxia; Cornelia de Lange; Early-onset epileptic encephalopathy; Epilepsy-aphasia spectrum; Epilepsy, generalized, with febrile seizures plus, type 7; Epileptic encephalopathy, childhood-onset; Epileptic encephalopathy, early infantile, 11; Epileptic encephalopathy, early infantile, 12; Epileptic encephalopathy, early infantile, 13; Epileptic encephalopathy, early infantile, 2; Episodic ataxia, type 2; Familial focal epilepsy; Febrile seizures, familial, 3B; Friedreich ataxia; Friedreich ataxia with retained reflexes; Galactose epimerase deficiency; Glaucoma 3, primary congenital, E; Glycogen storage disease IV; GRN-related frontotemporal dementia; Homocystinuria, B6-responsive and nonresponsive types; HSAN2D, autosomal recessive; Insensitivity to pain, congenital; Kabuki syndrome; Koolen-De Vries syndrome; Mental retardation, autosomal dominant 1; Methyl malonic aciduria; Migraine, Myoclonic-atonic epilepsy; familial hemiplegic, 1; Neurofibromatosis type 1; Opioid addiction; Optic atrophy type 1; Phelan-McDermid syndrome; Propionicacidemia; Primary open angle glaucoma; Propionic academia; Retinitis pigmentosa 11; Retinitis pigmentosa 18; Retinitis pigmentosa 31; Retinitis pigmentosa 59; Rett syndrome; Seizures, benign familial infantile, 3; Seizures, benign familial infantile, 5; Smith-Magenis syndrome; Sotos syndrome 1; Beckwith-Wiedemann syndrome; Stargardt disease 3; Tay-Sachs disease; Tuberous sclerosis; Tyrosinemia, type I; Wagner syndrome 1; West syndrome; Wolfram syndrome 2/NAFLD; 15q13.3 microdeletion; 16p11.2 deletion syndrome; Deafness, autosomal dominant 13; Cone-rod retinal dystrophy-2; Deafness, autosomal dominant 4A; Peripheral neuropathy, myopathy, hoarseness, and hearing loss; Deafness, autosomal dominant 22; Neurofibromatosis type 2; NASH; or Mental retardation, autosomal dominant 5 caused by a deficient amount of activity of ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein, and wherein the deficient amount of the ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPAL, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein is caused by haploinsufficiency of the ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPAL, OPTN, PCCA, PCCB, PKP2, PLCB1, PRPF3, PRPF31, RAIL, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein. In such an embodiment, the subject has a first allele encoding a functional ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPAL, OPTN, PCCA, PCCB, PKP2, PLCB1, PRPF3, PRPF31, RAIL, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein, and a second allele from which the ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein is not produced. In another such embodiment, the subject has a first allele encoding a functional ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein, and a second allele encoding a nonfunctional ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein. In another such embodiment, the subject has a first allele encoding a functional ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein, and a second allele encoding a partially functional ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein. In any of these embodiments, the antisense oligomer binds to a targeted portion of the NIE containing pre-mRNA transcribed from the second allele, thereby inducing exon skipping of the pseudo-exon from the pre-mRNA, and causing an increase in the level of mature mRNA encoding functional ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein, and an increase in the expression of the ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein in the cells of the subject.

In some embodiments, the method is a method of increasing the expression of the ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein by cells of a subject having a NIE containing pre-mRNA encoding the ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein, wherein the subject has Alport syndrome; Amyotrophic lateral sclerosis (ALS); Angelman syndrome; Aphasia, primary progressive; Arrhythmogenic right ventricular dysplasia 9; Autism spectrum disorder; Cardiomyopathy, dilated, 1HH; Myopathy, myofibrillar 6; Ceriod lipofuscinosis, neuronal, 3; Cholestasis, intrahepatic, of pregnancy, 3; Cholestasis, progressive familial intrahepatic 1; Citrullinemia Type II; Citrullinemia, Type 1; Cognitive impairment with or without cerebral ataxia; Cornelia de Lange; Early-onset epileptic encephalopathy; Epilepsy-aphasia spectrum; Epilepsy, generalized, with febrile seizures plus, type 7; Epileptic encephalopathy, childhood-onset; Epileptic encephalopathy, early infantile, 11; Epileptic encephalopathy, early infantile, 12; Epileptic encephalopathy, early infantile, 13; Epileptic encephalopathy, early infantile, 2; Episodic ataxia, type 2; Familial focal epilepsy; Febrile seizures, familial, 3B; Friedreich ataxia; Friedreich ataxia with retained reflexes; Galactose epimerase deficiency; Glaucoma 3, primary congenital, E; Glycogen storage disease IV; GRN-related frontotemporal dementia; Homocystinuria, B6-responsive and nonresponsive types; HSAN2D, autosomal recessive; Insensitivity to pain, congenital; Kabuki syndrome; Koolen-De Vries syndrome; Mental retardation, autosomal dominant 1; Methyl malonic aciduria; Migraine, Myoclonic-atonic epilepsy; familial hemiplegic, 1; Neurofibromatosis type 1; Opioid addiction; Optic atrophy type 1; Phelan-McDermid syndrome; Propionicacidemia; Primary open angle glaucoma; Propionic academia; Retinitis pigmentosa 11; Retinitis pigmentosa 18; Retinitis pigmentosa 31; Retinitis pigmentosa 59; Rett syndrome; Seizures, benign familial infantile, 3; Seizures, benign familial infantile, 5; Smith-Magenis syndrome; Sotos syndrome 1; Beckwith-Wiedemann syndrome; Stargardt disease 3; Tay-Sachs disease; Tuberous sclerosis; Tyrosinemia, type I; Wagner syndrome 1; West syndrome; Wolfram syndrome 2/NAFLD; 15q13.3 microdeletion; 16p11.2 deletion syndrome; Deafness, autosomal dominant 13; Cone-rod retinal dystrophy-2; Deafness, autosomal dominant 4A; Peripheral neuropathy, myopathy, hoarseness, and hearing loss; Deafness, autosomal dominant 22; Neurofibromatosis type 2; NASH; or Mental retardation, autosomal dominant 5 caused by a deficient amount of activity of ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1protein, and wherein the deficient amount of the ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein is caused by autosomal recessive inheritance.

In some embodiments, the method is a method of increasing the expression of the ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein by cells of a subject having a NIE containing pre-mRNA encoding the ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein, wherein the subject has Alport syndrome; Amyotrophic lateral sclerosis (ALS); Angelman syndrome; Aphasia, primary progressive; Arrhythmogenic right ventricular dysplasia 9; Autism spectrum disorder; Cardiomyopathy, dilated, 1HH; Myopathy, myofibrillar 6; Ceriod lipofuscinosis, neuronal, 3; Cholestasis, intrahepatic, of pregnancy, 3; Cholestasis, progressive familial intrahepatic 1; Citrullinemia Type II; Citrullinemia, Type 1; Cognitive impairment with or without cerebral ataxia; Cornelia de Lange; Early-onset epileptic encephalopathy; Epilepsy-aphasia spectrum; Epilepsy, generalized, with febrile seizures plus, type 7; Epileptic encephalopathy, childhood-onset; Epileptic encephalopathy, early infantile, 11; Epileptic encephalopathy, early infantile, 12; Epileptic encephalopathy, early infantile, 13; Epileptic encephalopathy, early infantile, 2; Episodic ataxia, type 2; Familial focal epilepsy; Febrile seizures, familial, 3B; Friedreich ataxia; Friedreich ataxia with retained reflexes; Galactose epimerase deficiency; Glaucoma 3, primary congenital, E; Glycogen storage disease IV; GRN-related frontotemporal dementia; Homocystinuria, B6-responsive and nonresponsive types; HSAN2D, autosomal recessive; Insensitivity to pain, congenital; Kabuki syndrome; Koolen-De Vries syndrome; Mental retardation, autosomal dominant 1; Methyl malonic aciduria; Migraine, Myoclonic-atonic epilepsy; familial hemiplegic, 1; Neurofibromatosis type 1; Opioid addiction; Optic atrophy type 1; Phelan-McDermid syndrome; Propionicacidemia; Primary open angle glaucoma; Propionic academia; Retinitis pigmentosa 11; Retinitis pigmentosa 18; Retinitis pigmentosa 31; Retinitis pigmentosa 59; Rett syndrome; Seizures, benign familial infantile, 3; Seizures, benign familial infantile, 5; Smith-Magenis syndrome; Sotos syndrome 1; Beckwith-Wiedemann syndrome; Stargardt disease 3; Tay-Sachs disease; Tuberous sclerosis; Tyrosinemia, type I; Wagner syndrome 1; West syndrome; Wolfram syndrome 2/NAFLD; 15q13.3 microdeletion; 16p11.2 deletion syndrome; Deafness, autosomal dominant 13; Cone-rod retinal dystrophy-2;

Deafness, autosomal dominant 4A; Peripheral neuropathy, myopathy, hoarseness, and hearing loss; Deafness, autosomal dominant 22; Neurofibromatosis type 2; NASH; or Mental retardation, autosomal dominant 5 caused by a deficient amount of activity of ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein, and wherein the deficient amount of the ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein is caused by autosomal dominant inheritance.

In some embodiments, the method is a method of increasing the expression of the ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein by cells of a subject having a NIE containing pre-mRNA encoding the ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein, wherein the subject has Alport syndrome; Amyotrophic lateral sclerosis (ALS); Angelman syndrome; Aphasia, primary progressive; Arrhythmogenic right ventricular dysplasia 9; Autism spectrum disorder; Cardiomyopathy, dilated, 1HH; Myopathy, myofibrillar 6; Ceriod lipofuscinosis, neuronal, 3; Cholestasis, intrahepatic, of pregnancy, 3; Cholestasis, progressive familial intrahepatic 1; Citrullinemia Type II; Citrullinemia, Type 1; Cognitive impairment with or without cerebral ataxia; Cornelia de Lange; Early-onset epileptic encephalopathy; Epilepsy-aphasia spectrum; Epilepsy, generalized, with febrile seizures plus, type 7; Epileptic encephalopathy, childhood-onset; Epileptic encephalopathy, early infantile, 11; Epileptic encephalopathy, early infantile, 12; Epileptic encephalopathy, early infantile, 13; Epileptic encephalopathy, early infantile, 2; Episodic ataxia, type 2; Familial focal epilepsy; Febrile seizures, familial, 3B; Friedreich ataxia; Friedreich ataxia with retained reflexes; Galactose epimerase deficiency; Glaucoma 3, primary congenital, E; Glycogen storage disease IV; GRN-related frontotemporal dementia; Homocystinuria, B6-responsive and nonresponsive types; HSAN2D, autosomal recessive; Insensitivity to pain, congenital; Kabuki syndrome; Koolen-De Vries syndrome; Mental retardation, autosomal dominant 1; Methyl malonic aciduria; Migraine, Myoclonic-atonic epilepsy; familial hemiplegic, 1; Neurofibromatosis type 1; Opioid addiction; Optic atrophy type 1; Phelan-McDermid syndrome; Propionicacidemia; Primary open angle glaucoma; Propionic academia; Retinitis pigmentosa 11; Retinitis pigmentosa 18; Retinitis pigmentosa 31; Retinitis pigmentosa 59; Rett syndrome; Seizures, benign familial infantile, 3; Seizures, benign familial infantile, 5; Smith-Magenis syndrome; Sotos syndrome 1; Beckwith-Wiedemann syndrome; Stargardt disease 3; Tay-Sachs disease; Tuberous sclerosis; Tyrosinemia, type I; Wagner syndrome 1; West syndrome; Wolfram syndrome 2/NAFLD; 15q13.3 microdeletion; 16p11.2 deletion syndrome; Deafness, autosomal dominant 13; Cone-rod retinal dystrophy-2; Deafness, autosomal dominant 4A; Peripheral neuropathy, myopathy, hoarseness, and hearing loss; Deafness, autosomal dominant 22; Neurofibromatosis type 2; NASH; or Mental retardation, autosomal dominant 5 caused by a deficient amount of activity of ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein, and wherein the deficient amount of the ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein is caused by X-linked dominant inheritance.

In related embodiments, the method is a method of using an ASO to increase the expression of a protein or functional RNA. In some embodiments, an ASO may be used to increase the expression of ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein in cells of a subject having a NIE containing pre-mRNA encoding ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein, wherein the subject has a deficiency, e.g., Alport syndrome; Amyotrophic lateral sclerosis (ALS); Angelman syndrome; Aphasia, primary progressive; Arrhythmogenic right ventricular dysplasia 9; Autism spectrum disorder; Cardiomyopathy, dilated, 1HH; Myopathy, myofibrillar 6; Ceriod lipofuscinosis, neuronal, 3; Cholestasis, intrahepatic, of pregnancy, 3; Cholestasis, progressive familial intrahepatic 1; Citrullinemia Type II; Citrullinemia, Type 1; Cognitive impairment with or without cerebral ataxia; Cornelia de Lange; Early-onset epileptic encephalopathy; Epilepsy-aphasia spectrum; Epilepsy, generalized, with febrile seizures plus, type 7; Epileptic encephalopathy, childhood-onset; Epileptic encephalopathy, early infantile, 11; Epileptic encephalopathy, early infantile, 12; Epileptic encephalopathy, early infantile, 13; Epileptic encephalopathy, early infantile, 2; Episodic ataxia, type 2; Familial focal epilepsy; Febrile seizures, familial, 3B; Friedreich ataxia; Friedreich ataxia with retained reflexes; Galactose epimerase deficiency; Glaucoma 3, primary congenital, E; Glycogen storage disease IV; GRN-related frontotemporal dementia; Homocystinuria, B6-responsive and nonresponsive types; HSAN2D, autosomal recessive; Insensitivity to pain, congenital; Kabuki syndrome; Koolen-De Vries syndrome; Mental retardation, autosomal dominant 1; Methyl malonic aciduria; Migraine, Myoclonic-atonic epilepsy; familial hemiplegic, 1; Neurofibromatosis type 1; Opioid addiction; Optic atrophy type 1; Phelan-McDermid syndrome; Propionicacidemia; Primary open angle glaucoma; Propionic academia; Retinitis pigmentosa 11; Retinitis pigmentosa 18; Retinitis pigmentosa 31; Retinitis pigmentosa 59; Rett syndrome; Seizures, benign familial infantile, 3; Seizures, benign familial infantile, 5; Smith-Magenis syndrome; Sotos syndrome 1; Beckwith-Wiedemann syndrome; Stargardt disease 3; Tay-Sachs disease; Tuberous sclerosis; Tyrosinemia, type I; Wagner syndrome 1; West syndrome; Wolfram syndrome 2/NAFLD; 15q13.3 microdeletion; 16p11.2 deletion syndrome; Deafness, autosomal dominant 13; Cone-rod retinal dystrophy-2; Deafness, autosomal dominant 4A; Peripheral neuropathy, myopathy, hoarseness, and hearing loss; Deafness, autosomal dominant 22; Neurofibromatosis type 2; NASH; or Mental retardation, autosomal dominant 5, in the amount or function of a ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein.

In some embodiments, the NIE containing pre-mRNA transcript that encodes the protein that is causative of the disease or condition is targeted by the ASOs described herein. In some embodiments, a NIE containing pre-mRNA transcript that encodes a protein that is not causative of the disease is targeted by the ASOs. For example, a disease that is the result of a mutation or deficiency of a first protein in a particular pathway may be ameliorated by targeting a NIE containing pre-mRNA that encodes a second protein, thereby increasing production of the second protein. In some embodiments, the function of the second protein is able to compensate for the mutation or deficiency of the first protein (which is causative of the disease or condition).

In some embodiments, the subject has:

(a) a first mutant allele from which (i) the ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein is produced at a reduced level compared to production from a wild-type allele, (ii) the ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein is produced in a form having reduced function compared to an equivalent wild-type protein, or (iii) the ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein or functional RNA is not produced; and (b) a second mutant allele from which (i) the ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein is produced at a reduced level compared to production from a wild-type allele, (ii) the ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein is produced in a form having reduced function compared to an equivalent wild-type protein, or (iii) the ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein is not produced, and wherein the NIE containing pre-mRNA is transcribed from the first allele and/or the second allele. In these embodiments, the ASO binds to a targeted portion of the NIE containing pre-mRNA transcribed from the first allele or the second allele, thereby inducing exon skipping of the pseudo-exon from the NIE containing pre-mRNA, and causing an increase in the level of mRNA encoding ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein and an increase in the expression of the target protein or functional RNA in the cells of the subject. In these embodiments, the target protein or functional RNA having an increase in expression level resulting from the exon skipping of the pseudo-exon from the NIE containing pre-mRNA may be either in a form having reduced function compared to the equivalent wild-type protein (partially-functional), or having full function compared to the equivalent wild-type protein (fully-functional).

In some embodiments, the level of mRNA encoding ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein is increased 1.1 to 10-fold, when compared to the amount of mRNA encoding ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein that is produced in a control cell, e.g., one that is not treated with the antisense oligomer or one that is treated with an antisense oligomer that does not bind to the targeted portion of the ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6AJ, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 NIE containing pre-mRNA.

In some embodiments, a subject treated using the methods of the present disclosure expresses a partially functional ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein from one allele, wherein the partially functional ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein may be caused by a frameshift mutation, a nonsense mutation, a missense mutation, or a partial gene deletion. In some embodiments, a subject treated using the methods of the disclosure expresses a nonfunctional ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein from one allele, wherein the nonfunctional ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein may be caused by a frameshift mutation, a nonsense mutation, a missense mutation, a partial gene deletion, in one allele. In some embodiments, a subject treated using the methods of the disclosure has a ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6AJ, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 whole gene deletion, in one allele.

Exon Inclusion

As used herein, a "NIE containing pre-mRNA" is a pre-mRNA transcript that contains at least one pseudo-exon. Alternative or aberrant splicing can result in inclusion of the at least one pseudo-exon in the mature mRNA transcripts. The terms "mature mRNA," and "fully-spliced mRNA," are used interchangeably herein to describe a fully processed mRNA. Inclusion of the at least one pseudo-exon can be non-productive mRNA and lead to NMD of the mature mRNA. NIE containing mature mRNA may sometimes lead to aberrant protein expression.

In some embodiments, the included pseudo-exon is the most abundant pseudo-exon in a population of NIE containing pre-mRNAs transcribed from the gene encoding the target protein in a cell. In some embodiments, the included pseudo-exon is the most abundant pseudo-exon in a population of NIE containing pre-mRNAs transcribed from the gene encoding the target protein in a cell, wherein the population of NIE containing pre-mRNAs comprises two or more included pseudo-exons. In some embodiments, an antisense oligomer targeted to the most abundant pseudo-exon in the population of NIE containing pre-mRNAs encoding the target protein induces exon skipping of one or two or more pseudo-exons in the population, including the pseudo-exon to which the antisense oligomer is targeted or binds. In some embodiments, the targeted region is in a pseudo-exon that is the most abundant pseudo-exon in a NIE containing pre-mRNA encoding the ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein.

The degree of exon inclusion can be expressed as percent exon inclusion, e.g., the percentage of transcripts in which a given pseudo-exon is included. In brief, percent exon inclusion can be calculated as the percentage of the amount of RNA transcripts with the exon inclusion, over the sum of the average of the amount of RNA transcripts with exon inclusion plus the average of the amount of RNA transcripts with exon exclusion.

In some embodiments, an included pseudo-exon is an exon that is identified as an included pseudo-exon based on a determination of at least about 5%, at least about 10%, at least about 15%, at least about 20%, at least about 25%, at least about 30%, at least about 35%, at least about 40%, at least about 45%, or at least about 50%, inclusion. In embodiments, a included pseudo-exon is an exon that is identified as a included pseudo-exon based on a determination of about 5% to about 100%, about 5% to about 95%, about 5% to about 90%, about 5% to about 85%, about 5% to about 80%, about 5% to about 75%, about 5% to about 70%, about 5% to about 65%, about 5% to about 60%, about 5% to about 55%, about 5% to about 50%, about 5% to about 45%, about 5% to about 40%, about 5% to about 35%, about 5% to about 30%, about 5% to about 25%, about 5% to about 20%, about 5% to about 15%, about 10% to about 100%, about 10% to about 95%, about 10% to about 90%, about 10% to about 85%, about 10% to about 80%, about 10% to about 75%, about 10% to about 70%, about 10% to about 65%, about 10% to about 60%, about 10% to about 55%, about 10% to about 50%, about 10% to about 45%, about 10% to about 40%, about 10% to about 35%, about 10% to about 30%, about 10% to about 25%, about 10% to about 20%, about 15% to about 100%, about 15% to about 95%, about 15% to about 90%, about 15% to about 85%, about 15% to about 80%, about 15% to about 75%, about 15% to about 70%, about 15% to about 65%, about 15% to about 60%, about 15% to about 55%, about 15% to about 50%, about 15% to about 45%, about 15% to about 40%, about 15% to about 35%, about 15% to about 30%, about 15% to about 25%, about 20% to about 100%, about 20% to about 95%, about 20% to about 90%, about 20% to about 85%, about 20% to about 80%, about 20% to about 75%, about 20% to about 70%, about 20% to about 65%, about 20% to about 60%, about 20% to about 55%, about 20% to about 50%, about 20% to about 45%, about 20% to about 40%, about 20% to about 35%, about 20% to about 30%, about 25% to about 100%, about 25% to about 95%, about 25% to about 90%, about 25% to about 85%, about 25% to about 80%, about 25% to about 75%, about 25% to about 70%, about 25% to about 65%, about 25% to about 60%, about 25% to about 55%, about 25% to about 50%, about 25% to about 45%, about 25% to about 40%, or about 25% to about 35%, inclusion. ENCODE data (described by, e.g., Tilgner, et al., 2012, "Deep sequencing of subcellular RNA fractions shows splicing to be predominantly co-transcriptional in the human genome but inefficient for IncRNAs," Genome Research 22(9):1616-25) can be used to aid in identifying exon inclusion.

In some embodiments, contacting cells with an ASO that is complementary to a targeted portion of a ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6AJ, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 pre-mRNA transcript results in an increase in the amount of ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein produced by at least 10, 20, 30, 40, 50, 60, 80, 100, 150, 200, 250, 300, 350, 400, 450, 500, or 1000%, compared to the amount of the protein produced by a cell in the absence of the ASO/absence of treatment. In some embodiments, the total amount of ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein produced by the cell to which the antisense oligomer is contacted is increased about 20% to about 300%, about 50% to about 300%, about 100% to about 300%, about 150% to about 300%, about 20% to about 50%, about 20% to about 100%, about 20% to about 150%, about 20% to about 200%, about 20% to about 250%, about 50% to about 100%, about 50% to about 150%, about 50% to about 200%, about 50% to about 250%, about 100% to about 150%, about 100% to about 200%, about 100% to about 250%, about 150% to about 200%, about 150% to about 250%, about 200% to about 250%, at least about 10%, at least about 20%, at least about 50%, at least about 100%, at least about 150%, at least about 200%, at least about 250%, or at least about 300%, compared to the amount of target protein produced by a control compound. In some embodiments, the total amount of ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein produced by the cell to which the antisense oligomer is contacted is increased about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold, compared to the amount of target protein produced by a control compound. A control compound can be, for example, an oligonucleotide that is not complementary to a targeted portion of the pre-mRNA.

In some embodiments, contacting cells with an ASO that is complementary to a targeted portion of a ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6AJ, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 pre-mRNA transcript results in an increase in the amount of mRNA encoding ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1, including the mature mRNA encoding the target protein. In some embodiments, the amount of mRNA encoding ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein, or the mature mRNA encoding the ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein, is increased by at least 10, 20, 30, 40, 50, 60, 80, 100, 150, 200, 250, 300, 350, 400, 450, 500, or 1000%, compared to the amount of the protein produced by a cell in the absence of the ASO/absence of treatment. In some embodiments, the total amount of the mRNA encoding ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein, or the mature mRNA encoding ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein produced in the cell to which the antisense oligomer is contacted is increased about 20% to about 300%, about 50% to about 300%, about 100% to about 300%, about 150% to about 300%, about 20% to about 50%, about 20% to about 100%, about 20% to about 150%, about 20% to about 200%, about 20% to about 250%, about 50% to about 100%, about 50% to about 150%, about 50% to about 200%, about 50% to about 250%, about 100% to about 150%, about 100% to about 200%, about 100% to about 250%, about 150% to about 200%, about 150% to about 250%, about 200% to about 250%, at least about 10%, at least about 20%, at least about 50%, at least about 100%, at least about 150%, at least about 200%, at least about 250%, or at least about 300%, compared to the amount of mature RNA produced in an untreated cell, e.g., an untreated cell or a cell treated with a control compound. In some embodiments, the total amount of the mRNA encoding ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein, or the mature mRNA encoding ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein produced in the cell to which the antisense oligomer is contacted is increased about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold compared to the amount of mature RNA produced in an untreated cell, e.g., an untreated cell or a cell treated with a control compound. A control compound can be, for example, an oligonucleotide that is not complementary to a targeted portion of the ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 NIE containing pre-mRNA.

The NIE can be in any length. In some embodiments, the NIE comprises a full sequence of an intron, in which case, it can be referred to as intron retention. In some embodiments, the NIE can be a portion of the intron. In some embodiments, the NIE can be a 5' end portion of an intron including a 5'ss sequence. In some embodiments, the NIE can be a 3' end portion of an intron including a 3'ss sequence. In some embodiments, the NIE can be a portion within an intron without inclusion of a 5'ss sequence. In some embodiments, the NIE can be a portion within an intron without inclusion of a 3'ss sequence. In some embodiments, the NIE can be a portion within an intron without inclusion of either a 5'ss or a 3'ss sequence. In some embodiments, the NIE can be from 5 nucleotides to 10 nucleotides in length, from 10 nucleotides to 15 nucleotides in length, from 15 nucleotides to 20 nucleotides in length, from 20 nucleotides to 25 nucleotides in length, from 25 nucleotides to 30 nucleotides in length, from 30 nucleotides to 35 nucleotides in length, from 35 nucleotides to 40 nucleotides in length, from 40 nucleotides to 45 nucleotides in length, from 45 nucleotides to 50 nucleotides in length, from 50 nucleotides to 55 nucleotides in length, from 55 nucleotides to 60 nucleotides in length, from 60 nucleotides to 65 nucleotides in length, from 65 nucleotides to 70 nucleotides in length, from 70 nucleotides to 75 nucleotides in length, from 75 nucleotides to 80 nucleotides in length, from 80 nucleotides to 85 nucleotides in length, from 85 nucleotides to 90 nucleotides in length, from 90 nucleotides to 95 nucleotides in length, or from 95 nucleotides to 100 nucleotides in length. In some embodiments, the NIE can be at least 10 nucleotides, at least 20 nucleotides, at least 30 nucleotides, at least 40 nucleotides, at least 50 nucleotides, at least 60 nucleoids, at least 70 nucleotides, at least 80 nucleotides in length, at least 90 nucleotides, or at least 100 nucleotides in length. In some embodiments, the NIE can be from 100 to 200 nucleotides in length, from 200 to 300 nucleotides in length, from 300 to 400 nucleotides in length, from 400 to 500 nucleotides in length, from 500 to 600 nucleotides in length, from 600 to 700 nucleotides in length, from 700 to 800 nucleotides in length, from 800 to 900 nucleotides in length, from 900 to 1,000 nucleotides in length. In some embodiments, the NIE may be longer than 1,000 nucleotides in length.

Inclusion of a pseudo-exon can lead to a frameshift and the introduction of a premature termination codon (PIC) in the mature mRNA transcript rendering the transcript a target of NMD. Mature mRNA transcript containing NIE can be non-productive mRNA transcript which does not lead to protein expression. The PIC can be present in any position downstream of an NIE. In some embodiments, the PIC can be present in any exon downstream of an NIE. In some embodiments, the PIC can be present within the NIE. For example, inclusion of exon 8× of ABCB4, exon 9× of ASS1, exon 16× of ATP8B1, exon 1× of BAG3, exon 31× of CACNA1A, exon 36× of CACNA1A, exon 37× of CACNA1A, exon 3× of CBS, exon 12× of CBS, exon 1× of CD55, exon 16× of CDKL5, exon 3× of CFH, exon 30× of CHD2, exon 4× of CHRNA7, exon 1× of CISD2, exon 15× of CLN3, exon 11× of COL4A3, exon 41× of COL4A3, exon 22× of COL4A4, exon 44× of COL4A4, exon 20× of DEPDC5, exon 2× of DHDDS, exon 3× of ELOVL4, exon 5× of FAH, exon 4× of FXN, exon 4× of GALE, exon 3× of GBE1, exon 11× of GRIN2A, exon 1× of GRN, exon 2× of HEXA, exon 2× of KANSL1, exon 1× of KCNQ2, exon 50× of KMT2D, exon 8× of MAPK3, exon 13× of MBD5, exon 2× of MECP2, exon 11× of MUT, exon 31× of NF1, exon 7× of NIPBL, exon 38× of NIPBL, exon 11× of NSD1, exon 6× of OPA1, exon 28× of OPA1, exon 1× of OPTN, exon 1× of PCCA, exon 5× of PCCB, exon 6× of PCCB, exon 4× of PKP2, exon 23× of PLCB1, exon 3× of PRPF3, exon 9× of PRPF31, exon 1× of RAI1, exon 5× of RBFOX2, exon 13× of SCN2A, exon 6× of SCN3A, exon 7× of SCN3A, exon 4× of SCN8A, exon 6× of SCN8A, exon 20× of SCN8A, exon 6× of SCN9A, exon 24× of SHANK3, exon 3× of SLC25A13, exon 6× of SLC25A13, exon 9× of SLC25A13, exon 11× of SLC25A13, exon 13× of SLC25A13, exon 1× of SLC6A1, exon 12× of SPTAN1, exon 10× of TEK, exon 15× of TEK, exon 1× of TOPORS, exon 11× of TSC2, exon 30× of TSC2, exon 1× of UBE3A, or exon 7× of VCAN in an mRNA transcript encoded by the ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, or VCAN gene can induce a PIC in the mRNA transcript. For example, inclusion of exon (GRCh38/hg38: chr1 243564285 243564388) of AKT3; exon (GRCh38/hg38: chr19 13236449 13236618) of CACNA1A; exon (GRCh38/hg38: chr21 43059730 43060012) of CBS; exon (GRCh38/hg38: chr1 207775610 207775745) of CD46; exon (GRCh38/hg38: chr1 196675450 196675529) of CFH; exon (GRCh38/hg38: chr15 92998149 92998261) of CHD2; exon (GRCh38/hg38: chr16 28479644 28479765) of CLN3; exon (GRCh38/hg38: chr6 33183634 33183698) of COL11A2; exon (GRCh38/hg38: chr2 227296487 227296526) of COL4A3; exon (GRCh38/hg38: chr2 227144653 227144833) of COL4A4; exon (GRCh38/hg38: chr2 227015283 227015360) of COL4A4; exon (GRCh38/hg38: chr1 207637688 207637848) of CR1; exon (GRCh38/hg38: chr19 47835403 47835579) of CRX; exon (GRCh38/hg38: chr1 59904366 59904516) of CYP2J2; exon (GRCh38/hg38: chr1 26442335 26442372) of DHDDS; exon (GRCh38/hg38: chr1 28230131 28230252) of DNAJC8; exon (GRCh38/hg38: chr2 88582755 88582824) of EIF2AK3; exon (GRCh38/hg38: chr17 64102673 64102804) of ERN1; exon (GRCh38/hg38: chr1 23798311 23798484) of GALE; exon (GRCh38/hg38: chrX 109383365 109383446) of GUCY2F; exon (GRCh38/hg38: chrX 109439038 109439175) of GUCY2F; exon (GRCh38/hg38: chr15 72362376 72362466) of HEXA; exon (GRCh38/hg38: chr15 72345677 72345776) of HEXA; exon (GRCh38/hg38: chr16 30115595 30115645) of MAPK3; exon (GRCh38/hg38: chr2 148460219 148460304) of MBD5; exon (GRCh38/hg38: chr2 148490695 148490787) of MBD5; exon (GRCh38/hg38: chr2 148505761 148505830) of MBD5; exon (GRCh38/hg38: chr6 49436522 49436597) of MUT; exon (GRCh38/hg38: chr19 50230825 50230999) of MYH14; exon (GRCh38/hg38: chr6 75867431 75867523) of MYO6; exon (GRCh38/hg38: chr17 31249955 31250125) of NF1; exon (GRCh38/hg38: chr22 29628658 29628773) of NF2; exon (GRCh38/hg38: chr5 37048127 37048354) of NIPBL; exon (GRCh38/hg38: chr12 100499841 100500024) of NR1H4; exon (GRCh38/hg38: chr5 177169394 177169559) of NSD1; exon (GRCh38/hg38: chr5 177200761 177200783) of NSD1; exon (GRCh38/hg38: chr5 177247924 177248079) of NSD1; exon (GRCh38/hg38: chr5 177275947 177276101) of NSD1; exon (GRCh38/hg38: chr3 193628509 193628616)

of OPA1; exon (GRCh38/hg38: chr3 193603500 193603557) of OPA1; exon (GRCh38/hg38: chr13 100305751 100305834) of PCCA; exon (GRCh38/hg38: chr12 32894516 32894778) of PKP2; exon (GRCh38/hg38: chr22 46203575 46203752) of PPARA; exon (GRCh38/hg38: chr1 150327557 150327652) of PRPF3; exon (GRCh38/hg38: chr1 150330401 150330498) of PRPF3; exon (GRCh38/hg38: chr2 165327155 165327202) of SCN2A; exon (GRCh38/hg38: chr12 51688758 51688849) of SCN8A; exon (GRCh38/hg38: chr12 51780202 51780271) of SCN8A; exon (GRCh38/hg38: chr2 166304238 166304329) of SCN9A; exon (GRCh38/hg38: chr7 80794854 80794957) of SEMA3C; exon (GRCh38/hg38: chr7 85059498 85059541) of SEMA3D; exon (GRCh38/hg38: chr11 225673 226081) of SIRT3; exon (GRCh38/hg38: chr19 1216268 1216398) of STK11; exon (GRCh38/hg38: chr19 1221621 1221846) of STK11; exon (GRCh38/hg38: chr6 33448789 33448868) of SYNGAP1; exon (GRCh38/hg38: chr9 32551365 32551469) of TOPORS; exon (GRCh38/hg38: chr5 83544965 83545070) of VCAN in an mRNA transcript encoded by the AKT3, CACNA1A, CBS, CD46, CFH, CHD2, CLN3, COL11A2, COL4A3, COL4A4, COL4A4, CR1, CRX, CYP2J2, DHDDS, DNAJC8, EIF2AK3, ERN1, GALE, GUCY2F, GUCY2F, HEXA, HEXA, MAPK3, MBD5, MBD5, MBD5, MUT, MYH14, MYO6, NF1, NF2, NIPBL, NR1H4, NSD1, NSD1, NSD1, NSD1, OPA1, OPA1, PCCA, PKP2, PPARA, PRPF3, PRPF3, SCN2A, SCN8A, SCN8A, SCN9A, SEMA3C, SEMA3D, SIRT3, STK11, STK11, SYNGAP1, TOPORS, or VCAN.

Therapeutic Agents

In various embodiments of the present disclosure, compositions and methods comprising a therapeutic agent are provided to modulate protein expression level of ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1. In some embodiments, provided herein are compositions and methods to modulate alternative splicing of ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 pre-mRNA. In some embodiments, provided herein are compositions and methods to induce exon skipping in the splicing of ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 pre-mRNA, e.g., to induce skipping of a pseudo-exon during splicing of ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6AJ, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 pre-mRNA. In other embodiments, therapeutic agents may be used to induce the inclusion of an exon in order to decrease the protein expression level.

A therapeutic agent disclosed herein can be a NIE repressor agent. A therapeutic agent may comprise a polynucleic acid polymer.

According to one aspect of the present disclosure, provided herein is a method of treatment or prevention of a condition or disease associated with a functional ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein deficiency, comprising administering a NIE repressor agent to a subject to increase levels of functional ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein, wherein the agent binds to a region of the pre-mRNA transcript to decrease inclusion of the NIE in the mature transcript. For example, provided herein is a method of treatment or prevention of a condition associated with a functional ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, or VCAN protein deficiency, comprising administering a NIE repressor agent to a subject to increase levels of functional ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, or VCAN protein, wherein the agent binds to a region of an intron containing an NIE (e.g., exon 8× of ABCB4, exon 9× of ASS1, exon 16× of ATP8B1, exon 1× of BAG3, exon 31× of CACNA1A, exon 36× of CACNA1A, exon 37× of CACNA1A, exon 3× of CBS, exon 12× of CBS, exon 1× of CD55, exon 16× of CDKL5, exon 3× of CFH, exon 30× of CHD2, exon 4× of CHRNA7, exon 1× of CISD2, exon 15× of CLN3, exon 11× of COL4A3, exon 41× of COL4A3, exon 22× of COL4A4, exon 44× of COL4A4, exon 20× of DEPDC5, exon 2× of DHDDS, exon 3× of ELOVL4, exon 5× of FAH, exon 4× of FXN, exon 4× of GALE, exon 3× of GBE1, exon 11× of GRIN2A, exon 1× of GRN, exon 2× of HEXA, exon 2× of KANSL1, exon 1× of KCNQ2, exon 50× of KMT2D, exon 8× of MAPK3, exon 13× of MBD5, exon 2× of MECP2, exon 11× of MUT, exon 31× of NF1, exon 7× of NIPBL, exon 38× of NIPBL, exon 11× of NSD1, exon 6× of OPA1, exon 28× of OPA1, exon 1× of OPTN, exon 1× of PCCA, exon 5× of PCCB, exon 6× of PCCB, exon 4× of PKP2, exon 23× of PLCB1, exon 3× of PRPF3, exon 9× of PRPF31, exon 1× of RAI1, exon 5× of RBFOX2, exon 13× of SCN2A, exon 6× of SCN3A, exon 7× of SCN3A, exon 4× of SCN8A, exon 6× of SCN8A, exon 20× of SCN8A, exon 6× of SCN9A, exon 24× of SHANK3, exon 3× of SLC25A13, exon 6× of SLC25A13, exon 9× of SLC25A13, exon 11× of SLC25A13, exon 13× of SLC25A13, exon 1× of SLC6A1, exon 12× of SPTAN1, exon 10× of TEK, exon 15× of TEK, exon 1× of TOPORS, exon 11× of TSC2, exon 30× of TSC2, exon 1× of UBE3A, or exon 7× of VCAN) of the pre-mRNA transcript or to a NIE-activating regulatory sequence in the same intron. For example, provided herein is a method of treatment or prevention of a condition associated with a functional AKT3, CACNA1A, CBS, CD46, CFH, CHD2, CLN3, COL11A2, COL4A3, COL4A4, COL4A4, CR1, CRX, CYP2J2, DHDDS, DNAJC8, EIF2AK3, ERN1, GALE, GUCY2F, GUCY2F, HEXA, HEXA, MAPK3, MBD5, MBD5, MBD5, MUT, MYH14, MYO6, NF1, NF2, NIPBL, NR1H4, NSD1, NSD1, NSD1, NSD1, OPA1, OPA1, PCCA, PKP2, PPARA, PRPF3, PRPF3, SCN2A, SCN8A, SCN8A, SCN9A, SEMA3C, SEMA3D, SIRT3, STK11, STK11, SYNGAP1, TOPORS, or VCAN protein deficiency, comprising administering a NIE repressor agent to a subject to increase levels of functional AKT3, CACNA1A, CBS, CD46, CFH, CHD2, CLN3, COL11A2, COL4A3, COL4A4, COL4A4, CR1, CRX, CYP2J2, DHDDS, DNAJC8, EIF2AK3, ERN1, GALE, GUCY2F, GUCY2F, HEXA, HEXA, MAPK3, MBD5, MBD5, MBD5, MUT, MYH14, MYO6, NF1, NF2, NIPBL, NR1H4, NSD1, NSD1, NSD1, NSD1, OPA1, OPA1, PCCA, PKP2, PPARA, PRPF3, PRPF3, SCN2A, SCN8A, SCN8A, SCN9A, SEMA3C, SEMA3D, SIRT3, STK11, STK11, SYNGAP1, TOPORS, or VCAN protein, wherein the agent binds to a region of an intron containing an NIE (e.g., exon (GRCh38/hg38: chr1 243564285 243564388) of AKT3; exon (GRCh38/hg38: chr19 13236449 13236618) of CACNA1A; exon (GRCh38/hg38: chr21 43059730 43060012) of CBS; exon (GRCh38/hg38: chr1 207775610 207775745) of CD46; exon (GRCh38/hg38: chr1 196675450 196675529) of CFH; exon (GRCh38/hg38: chr15 92998149 92998261) of CHD2; exon (GRCh38/hg38: chr16 28479644 28479765) of CLN3; exon (GRCh38/hg38: chr6 33183634 33183698) of COL11A2; exon (GRCh38/hg38: chr2 227296487 227296526) of COL4A3; exon (GRCh38/hg38: chr2 227144653 227144833) of COL4A4; exon (GRCh38/hg38: chr2 227015283 227015360) of COL4A4; exon (GRCh38/hg38: chr1 207637688 207637848) of CR1; exon (GRCh38/hg38: chr19 47835403 47835579) of CRX; exon (GRCh38/hg38: chr1 59904366 59904516) of CYP2J2; exon (GRCh38/hg38: chr1 26442335 26442372) of DHDDS; exon (GRCh38/hg38: chr1 28230131 28230252) of DNAJC8; exon (GRCh38/hg38: chr2 88582755 88582824) of EIF2AK3; exon (GRCh38/hg38: chr17 64102673 64102804) of ERN1; exon (GRCh38/hg38: chr1 23798311 23798484) of GALE; exon (GRCh38/hg38: chrX 109383365 109383446) of GUCY2F; exon (GRCh38/hg38: chrX 109439038 109439175) of GUCY2F; exon (GRCh38/hg38: chr15 72362376 72362466) of HEXA; exon (GRCh38/hg38: chr15 72345677 72345776) of HEXA; exon (GRCh38/hg38: chr16 30115595 30115645) of MAPK3; exon (GRCh38/hg38: chr2 148460219 148460304) of MBD5; exon (GRCh38/hg38: chr2 148490695 148490787) of MBD5; exon (GRCh38/hg38: chr2 148505761 148505830) of MBD5; exon (GRCh38/hg38: chr6 49436522 49436597) of MUT; exon (GRCh38/hg38: chr19 50230825 50230999) of MYH14; exon (GRCh38/hg38: chr6 75867431 75867523) of MYO6; exon (GRCh38/hg38: chr17 31249955 31250125) of NF1; exon (GRCh38/hg38: chr22 29628658 29628773) of NF2; exon (GRCh38/hg38: chr5 37048127 37048354) of NIPBL; exon (GRCh38/hg38: chr12 100499841 100500024) of NR1H4; exon (GRCh38/hg38: chr5 177169394 177169559) of NSD1; exon (GRCh38/hg38: chr5 177200761 177200783) of NSD1; exon (GRCh38/hg38: chr5 177247924 177248079) of NSD1; exon (GRCh38/hg38: chr5 177275947 177276101) of NSD1; exon (GRCh38/hg38: chr3 193628509 193628616) of OPA1; exon (GRCh38/hg38: chr3 193603500 193603557) of OPA1; exon (GRCh38/hg38: chr13 100305751 100305834) of PCCA; exon (GRCh38/hg38: chr12 32894516 32894778) of PKP2; exon (GRCh38/hg38: chr22 46203575 46203752) of PPARA; exon (GRCh38/hg38: chr1 150327557 150327652) of PRPF3; exon (GRCh38/hg38: chr1 150330401 150330498) of PRPF3; exon (GRCh38/hg38: chr2 165327155 165327202) of SCN2A; exon (GRCh38/hg38: chr12 51688758 51688849) of SCN8A; exon (GRCh38/hg38: chr12 51780202 51780271) of SCN8A; exon (GRCh38/hg38: chr2 166304238 166304329) of SCN9A; exon (GRCh38/hg38: chr7 80794854 80794957) of SEMA3C; exon (GRCh38/hg38: chr7 85059498 85059541) of SEMA3D; exon (GRCh38/hg38: chr11 225673 226081) of SIRT3; exon (GRCh38/hg38: chr19 1216268 1216398) of STK11; exon (GRCh38/hg38: chr19 1221621 1221846) of STK11; exon (GRCh38/hg38: chr6 33448789 33448868) of SYNGAP1; exon (GRCh38/hg38: chr9 32551365 32551469) of TOPORS; exon (GRCh38/hg38: chr5 83544965 83545070) of VCAN) of the pre-mRNA transcript or to a NIE-activating regulatory sequence in the same intron.

Where reference is made to reducing NIE inclusion in the mature mRNA, the reduction may be complete, e.g., 100%, or may be partial. The reduction may be clinically significant. The reduction/correction may be relative to the level of NIE inclusion in the subject without treatment, or relative to the amount of NIE inclusion in a population of similar subjects. The reduction/correction may be at least 10% less NIE inclusion relative to the average subject, or the subject prior to treatment. The reduction may be at least 20% less NIE inclusion relative to an average subject, or the subject prior to treatment. The reduction may be at least 40% less NIE inclusion relative to an average subject, or the subject prior to treatment. The reduction may be at least 50% less NIE inclusion relative to an average subject, or the subject prior to treatment. The reduction may be at least 60% less NIE inclusion relative to an average subject, or the subject prior to treatment. The reduction may be at least 80% less NIE inclusion relative to an average subject, or the subject prior to treatment. The reduction may be at least 90% less NIE inclusion relative to an average subject, or the subject prior to treatment.

Where reference is made to increasing active ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein levels, the increase may be clinically significant. The increase may be relative to the level of active ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein in the subject without treatment, or relative to the amount of active ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein in a population of similar subjects. The increase may be at least 10% more active ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein relative to the average subject, or the subject prior to treatment. The increase may be at least 20% more active ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein relative to the average subject, or the subject prior to treatment. The increase may be at least 40% more active ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein relative to the average subject, or the subject prior to treatment. The increase may be at least 50% more active ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein relative to the average subject, or the subject prior to treatment. The increase may be at least 80% more active ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein relative to the average subject, or the subject prior to treatment. The increase may be at least 100% more active ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein relative to the average subject, or the subject prior to treatment. The increase may be at least 200% more active ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein relative to the average subject, or the subject prior to treatment. The increase may be at least 500% more active ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 protein relative to the average subject, or the subject prior to treatment.

In embodiments wherein the NIE repressor agent comprises a polynucleic acid polymer, the polynucleic acid polymer may be about 50 nucleotides in length. The polynucleic acid polymer may be about 45 nucleotides in length. The polynucleic acid polymer may be about 40 nucleotides in length. The polynucleic acid polymer may be about 35 nucleotides in length. The polynucleic acid polymer may be about 30 nucleotides in length. The polynucleic acid polymer may be about 24 nucleotides in length. The polynucleic acid polymer may be about 25 nucleotides in length. The polynucleic acid polymer may be about 20 nucleotides in length. The polynucleic acid polymer may be about 19 nucleotides in length. The polynucleic acid polymer may be about 18 nucleotides in length. The polynucleic acid polymer may be about 17 nucleotides in length. The polynucleic acid polymer may be about 16 nucleotides in length. The polynucleic acid polymer may be about 15 nucleotides in length. The polynucleic acid polymer may be about 14 nucleotides in length. The polynucleic acid polymer may be about 13 nucleotides in length. The polynucleic acid polymer may be about 12 nucleotides in length. The polynucleic acid polymer may be about 11 nucleotides in length. The polynucleic acid polymer may be about 10 nucleotides in length. The polynucleic acid polymer may be between about 10 and about 50 nucleotides in length. The polynucleic acid polymer may be between about 10 and about 45 nucleotides in length. The polynucleic acid polymer may be between about 10 and about 40 nucleotides in length. The polynucleic acid polymer may be between about 10 and about 35 nucleotides in length. The polynucleic acid polymer may be between about 10 and about 30 nucleotides in length. The polynucleic acid polymer may be between about 10 and about 25 nucleotides in length. The polynucleic acid polymer may be between about 10 and about 20 nucleotides in length. The polynucleic acid polymer may be between about 15 and about 25 nucleotides in length. The polynucleic acid polymer may be between about 15 and about 30 nucleotides in length. The polynucleic acid polymer may be between about 12 and about 30 nucleotides in length.

The sequence of the polynucleic acid polymer may be at least 50%, 55%, 60%, 65%, 70%, 75%, 80%, 85%, 90%, 91%, 92%, 93%, 94%, 95%, 96%, 97%, 98%, 99%, or 99.5% complementary to a target sequence of an mRNA transcript, e.g., a partially processed mRNA transcript. The sequence of the polynucleic acid polymer may be 100% complementary to a target sequence of a pre-mRNA transcript.

The sequence of the polynucleic acid polymer may have 4 or fewer mismatches to a target sequence of the pre-mRNA transcript. The sequence of the polynucleic acid polymer may have 3 or fewer mismatches to a target sequence of the pre-mRNA transcript. The sequence of the polynucleic acid polymer may have 2 or fewer mismatches to a target sequence of the pre-mRNA transcript. The sequence of the polynucleic acid polymer may have 1 or fewer mismatches to a target sequence of the pre-mRNA transcript. The sequence of the polynucleic acid polymer may have no mismatches to a target sequence of the pre-mRNA transcript.

The polynucleic acid polymer may specifically hybridize to a target sequence of the pre-mRNA transcript. For example, the polynucleic acid polymer may have 91%, 92%, 93%, 94%, 95%, 96%, 97%, 98%, 99%, 99.5% or 100% sequence complementarity to a target sequence of the pre-mRNA transcript. The hybridization may be under high stringent hybridization conditions.

The polynucleic acid polymer comprising a sequence with at least 50%, 55%, 60%, 65%, 70%, 75%, 80%, 85%, 90%, 91%, 92%, 93%, 94%, 95%, 96%, 97%, 98%, 99%, or 99.5% sequence identity to a sequence selected from the group consisting of SEQ ID NOs: 60-191. The polynucleic acid polymer may comprise a sequence with 100% sequence identity to a sequence selected from the group consisting of SEQ ID NOs: 60-191.

Where reference is made to a polynucleic acid polymer sequence, the skilled person will understand that one or more substitutions may be tolerated, optionally two substitutions may be tolerated in the sequence, such that it maintains the ability to hybridize to the target sequence; or where the substitution is in a target sequence, the ability to be recognized as the target sequence.

References to sequence identity may be determined by BLAST sequence alignment using standard/default parameters. For example, the sequence may have 99% identity and still function according to the present disclosure. In other embodiments, the sequence may have 98% identity and still function according to the present disclosure. In another embodiment, the sequence may have 95% identity and still function according to the present disclosure. In another embodiment, the sequence may have 90% identity and still function according to the present disclosure.

Antisense Oligomers

Provided herein is a composition comprising an antisense oligomer that induces exon skipping by binding to a targeted portion of a ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6AJ, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 NIE containing pre-mRNA. As used herein, the terms "ASO" and "antisense oligomer" are used interchangeably and refer to an oligomer such as a polynucleotide, comprising nucleobases that hybridizes to a target nucleic acid (e.g., a ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 NIE containing pre-mRNA) sequence by Watson-Crick base pairing or wobble base pairing (G-U). The ASO may have exact sequence complementary to the target sequence or near complementarity (e.g., sufficient complementarity to bind the target sequence and enhancing splicing at a splice site). ASOs are designed so that they bind (hybridize) to a target nucleic acid (e.g., a targeted portion of a pre-mRNA transcript) and remain hybridized under physiological conditions. Typically, if they hybridize to a site other than the intended (targeted) nucleic acid sequence, they hybridize to a limited number of sequences that are not a target nucleic acid (to a few sites other than a target nucleic acid). Design of an ASO can take into consideration the occurrence of the nucleic acid sequence of the targeted portion of the pre-mRNA transcript or a sufficiently similar nucleic acid sequence in other locations in the genome or cellular pre-mRNA or transcriptome, such that the likelihood the ASO will bind other sites and cause "off-target" effects is limited. Any antisense oligomers known in the art, for example in PCT Application No. PCT/US2014/054151, published as WO 2015/035091, titled "Reducing Nonsense-Mediated mRNA Decay," incorporated by reference herein, can be used to practice the methods described herein.

In some embodiments, ASOs "specifically hybridize" to or are "specific" to a target nucleic acid or a targeted portion of a NIE containing pre-mRNA. Typically such hybridization occurs with a $T_m$ substantially greater than 37 °C, preferably at least 50 °C, and typically between 60 °C to approximately 90 °C. Such hybridization preferably corresponds to stringent hybridization conditions. At a given ionic strength and pH, the $T_m$ is the temperature at which 50% of a target sequence hybridizes to a complementary oligonucleotide.

Oligomers, such as oligonucleotides, are "complementary" to one another when hybridization occurs in an antiparallel configuration between two single-stranded polynucleotides. A double-stranded polynucleotide can be "complementary" to another polynucleotide, if hybridization can occur between one of the strands of the first polynucleotide and the second. Complementarity (the degree to which one polynucleotide is complementary with another) is quantifiable in terms of the proportion (e.g., the percentage) of bases in opposing strands that are expected to form hydrogen bonds with each other, according to generally accepted base-pairing rules. The sequence of an antisense oligomer (ASO) need not be 100% complementary to that of its target nucleic acid to hybridize. In certain embodiments, ASOs can comprise at least 70%, at least 75%, at least 80%, at least 85%, at least 90%, at least 95%, at least 96%, at least 97%, at least 98%, or at least 99% sequence complementarity to a target region within the target nucleic acid sequence to which they are targeted. For example, an ASO in which 18 of 20 nucleobases of the oligomeric compound are complementary to a target region, and would therefore specifically hybridize, would represent 90 percent complementarity. In this example, the remaining noncomplementary nucleobases may be clustered together or interspersed with complementary nucleobases and need not be contiguous to each other or to complementary nucleobases. Percent complementarity of an ASO with a region of a target nucleic acid can be determined routinely using BLAST programs (basic local alignment search tools) and PowerBLAST programs known in the art (Altschul, et al., J. Mol. Biol., 1990, 215, 403-410; Zhang and Madden, Genome Res., 1997, 7, 649-656).

An ASO need not hybridize to all nucleobases in a target sequence and the nucleobases to which it does hybridize may be contiguous or noncontiguous. ASOs may hybridize over one or more segments of a pre-mRNA transcript, such that intervening or adjacent segments are not involved in the hybridization event (e.g., a loop structure or hairpin structure may be formed). In certain embodiments, an ASO hybridizes to noncontiguous nucleobases in a target pre-mRNA transcript. For example, an ASO can hybridize to nucleobases in a pre-mRNA transcript that are separated by one or more nucleobase(s) to which the ASO does not hybridize.

The ASOs described herein comprise nucleobases that are complementary to nucleobases present in a target portion of a NIE containing pre-mRNA. The term ASO embodies oligonucleotides and any other oligomeric molecule that comprises nucleobases capable of hybridizing to a complementary nucleobase on a target mRNA but does not comprise a sugar moiety, such as a peptide nucleic acid (PNA). The ASOs may comprise naturally-occurring nucleotides, nucleotide analogs, modified nucleotides, or any combination of two or three of the preceding. The term "naturally occurring nucleotides" includes deoxyribonucleotides and ribonucleotides. The term "modified nucleotides" includes nucleotides with modified or substituted sugar groups and/or having a modified backbone. In some embodiments, all of the nucleotides of the ASO are modified nucleotides. Chemical modifications of ASOs or components of ASOs that are compatible with the methods and compositions described herein will be evident to one of skill in the art and can be found, for example, in U.S. Pat. No. 8,258,109 B2, U.S. Pat. No. 5,656,612, U.S. Patent Publication No. 2012/0190728, and Dias and Stein, Mol. Cancer Ther. 2002, 347-355, herein incorporated by reference in their entirety.

One or more nucleobases of an ASO may be any naturally occurring, unmodified nucleobase such as adenine, guanine, cytosine, thymine and uracil, or any synthetic or modified nucleobase that is sufficiently similar to an unmodified nucleobase such that it is capable of hydrogen bonding with a nucleobase present on a target pre-mRNA. Examples of modified nucleobases include, without limitation, hypoxanthine, xanthine, 7-methylguanine, 5,6-dihydrouracil, 5-methylcytosine, and 5-hydroxymethylcytosine.

The ASOs described herein also comprise a backbone structure that connects the components of an oligomer. The term "backbone structure" and "oligomer linkages" may be used interchangeably and refer to the connection between monomers of the ASO. In naturally occurring oligonucleotides, the backbone comprises a 3'-5' phosphodiester linkage connecting sugar moieties of the oligomer. The backbone structure or oligomer linkages of the ASOs described herein may include (but are not limited to) phosphorothioate, phosphorodithioate, phosphoroselenoate, phosphorodiselenoate, phosphoroanilothioate, phosphoranilidate, phosphoramidate, and the like. See, e.g., LaPlanche, et al., Nucleic Acids Res. 14:9081 (1986); Stec, et al., J. Am. Chem. Soc. 106:6077 (1984), Stein, et al., Nucleic Acids Res. 16:3209 (1988), Zon, et al., Anti-Cancer Drug Design 6:539 (1991); Zon, et al., Oligonucleotides and Analogues: A Practical Approach, pp. 87-108 (F. Eckstein, Ed., Oxford University Press, Oxford England (1991)); Stec, et al., U.S. Pat. No. 5,151,510; Uhlmann and Peyman, Chemical Reviews 90:543 (1990). In some embodiments, the backbone structure of the ASO does not contain phosphorous but rather contains peptide bonds, for example in a peptide nucleic acid (PNA), or linking groups including carbamate, amides, and linear and cyclic hydrocarbon groups. In some embodiments, the backbone modification is a phosphothioate linkage. In some embodiments, the backbone modification is a phosphoramidate linkage.

In some embodiments, the stereochemistry at each of the phosphorus internucleotide linkages of the ASO backbone is random. In some embodiments, the stereochemistry at each of the phosphorus internucleotide linkages of the ASO backbone is controlled and is not random. For example, U.S. Pat. App. Pub. No. 2014/0194610, "Methods for the Synthesis of Functionalized Nucleic Acids," incorporated herein by reference, describes methods for independently selecting the handedness of chirality at each phosphorous atom in a nucleic acid oligomer. In some embodiments, an ASO used in the methods of the disclosure, including, but not limited to, any of the ASOs set forth herein in Tables 5 and 6, comprises an ASO having phosphorus internucleotide linkages that are not random. In some embodiments, a composition used in the methods of the disclosure comprises a pure diastereomeric ASO. In some embodiments, a composition used in the methods of the disclosure comprises an ASO that has diastereomeric purity of at least about 90%, at least about 91%, at least about 92%, at least about 93%, at least about 94%, at least about 95%, at least about 96%, at least about 97%, at least about 98%, at least about 99%, about 100%, about 90% to about 100%, about 91% to about 100%, about 92% to about 100%, about 93% to about 100%, about 94% to about 100%, about 95% to about 100%, about 96% to about 100%, about 97% to about 100%, about 98% to about 100%, or about 99% to about 100%.

In some embodiments, the ASO has a nonrandom mixture of Rp and Sp configurations at its phosphorus internucleotide linkages. For example, it has been suggested that a mix of Rp and Sp is required in antisense oligonucleotides to achieve a balance between good activity and nuclease stability (Wan, et al., 2014, "Synthesis, biophysical properties and biological activity of second generation antisense oligonucleotides containing chiral phosphorothioate linkages," Nucleic Acids Research 42(22): 13456-13468, incorporated herein by reference). In some embodiments, an ASO used in the methods of the disclosure, including, but not limited to, any of the ASOs set forth herein in SEQ ID NOs: 60-191, comprises about 5-100% Rp, at least about 5% Rp, at least about 10% Rp, at least about 15% Rp, at least about 20% Rp, at least about 25% Rp, at least about 30% Rp, at least about 35% Rp, at least about 40% Rp, at least about 45% Rp, at least about 50% Rp, at least about 55% Rp, at least about 60% Rp, at least about 65% Rp, at least about 70% Rp, at least about 75% Rp, at least about 80% Rp, at least about 85% Rp, at least about 90% Rp, or at least about 95% Rp, with the remainder Sp, or about 100% Rp. In some embodiments, an ASO used in the methods of the disclosure, including, but not limited to, any of the ASOs set forth herein comprise a sequence with at least about 80%, 85%, 90%, 95%, 97%, or 100% sequence identity to a region comprising at least 8 contiguous nucleic acids of any one of SEQ ID NOs: 60-191, comprises about 10% to about 100% Rp, about 15% to about 100% Rp, about 20% to about 100% Rp, about 25% to about 100% Rp, about 30% to about 100% Rp, about 35% to about 100% Rp, about 40% to about 100% Rp, about 45% to about 100% Rp, about 50% to about 100% Rp, about 55% to about 100% Rp, about 60% to about 100% Rp, about 65% to about 100% Rp, about 70% to about 100% Rp, about 75% to about 100% Rp, about 80% to about 100% Rp, about 85% to about 100% Rp, about 90% to about 100% Rp, or about 95% to about 100% Rp, about 20% to about 80% Rp, about 25% to about 75% Rp, about 30% to about 70% Rp, about 40% to about 60% Rp, or about 45% to about 55% Rp, with the remainder Sp.

In some embodiments, an ASO used in the methods of the disclosure, including, but not limited to, any of the ASOs set forth herein comprise a sequence with at least about 80%, 85%, 90%, 95%, 97%, or 100% sequence identity to a region comprising at least 8 contiguous nucleic acids of any one of SEQ ID NOs: 60-191, comprises about 5-100% Sp, at least about 5% Sp, at least about 10% Sp, at least about 15% Sp, at least about 20% Sp, at least about 25% Sp, at least about 30% Sp, at least about 35% Sp, at least about 40% Sp, at least about 45% Sp, at least about 50% Sp, at least about 55% Sp, at least about 60% Sp, at least about 65% Sp, at least about 70% Sp, at least about 75% Sp, at least about 80% Sp, at least about 85% Sp, at least about 90% Sp, or at least about 95% Sp, with the remainder Rp, or about 100% Sp. In embodiments, an ASO used in the methods of the disclosure, including, but not limited to, any of the ASOs set forth herein comprise a sequence with at least about 80%, 85%, 90%, 95%, 97%, or 100% sequence identity to a region comprising at least 8 contiguous nucleic acids of any one of SEQ ID NOs: 60-191, comprises about 10% to about 100% Sp, about 15% to about 100% Sp, about 20% to about 100% Sp, about 25% to about 100% Sp, about 30% to about 100% Sp, about 35% to about 100% Sp, about 40% to about 100% Sp, about 45% to about 100% Sp, about 50% to about 100% Sp, about 55% to about 100% Sp, about 60% to about 100% Sp, about 65% to about 100% Sp, about 70% to about 100% Sp, about 75% to about 100% Sp, about 80% to about 100% Sp, about 85% to about 100% Sp, about 90% to about 100% Sp, or about 95% to about 100% Sp, about 20% to about 80% Sp, about 25% to about 75% Sp, about 30% to about 70% Sp, about 40% to about 60% Sp, or about 45% to about 55% Sp, with the remainder Rp.

Any of the ASOs described herein may contain a sugar moiety that comprises ribose or deoxyribose, as present in naturally occurring nucleotides, or a modified sugar moiety or sugar analog, including a morpholine ring. Non-limiting examples of modified sugar moieties include 2' substitutions such as 2'-O-methyl (2'-O-Me), 2'-O-methoxyethyl (2'MOE), 2'-O-aminoethyl, 2'F; N3'→P5' phosphoramidate, 2'dimethylaminooxyethoxy, 2'dimethylaminoethoxyethoxy, 2'-guanidinium, 2'-O-guanidinium ethyl, carbamate modified sugars, and bicyclic modified sugars. In some embodiments, the sugar moiety modification is selected from 2'-O-Me, 2'F, and 2'MOE. In some embodiments, the sugar moiety modification is an extra bridge bond, such as in a locked nucleic acid (LNA). In some embodiments the sugar analog contains a morpholine ring, such as phosphorodiamidate morpholino (PMO). In some embodiments, the sugar moiety comprises a ribofuranosyl or 2'deoxyribofuranosyl modification. In some embodiments, the sugar moiety comprises 2'4'-constrained 2'O-methyoxyethyl (cMOE) modifications. In some embodiments, the sugar moiety comprises cEt 2',4' constrained 2'-O ethyl BNA modifications. In some embodiments, the sugar moiety comprises tricycloDNA (tcDNA) modifications. In some embodiments, the sugar moiety comprises ethylene nucleic acid (ENA) modifications. In some embodiments, the sugar moiety comprises MCE modifications. Modifications are known in the art and described in the literature, e.g., by Jarver, et al., 2014, "A Chemical View of Oligonucleotides for Exon Skipping and Related Drug Applications," Nucleic Acid Therapeutics 24(1): 37-47, incorporated by reference for this purpose herein.

In some embodiments, each monomer of the ASO is modified in the same way, for example each linkage of the backbone of the ASO comprises a phosphorothioate linkage or each ribose sugar moiety comprises a 2'O-methyl modification. Such modifications that are present on each of the monomer components of an ASO are referred to as "uniform modifications." In some examples, a combination of different modifications may be desired, for example, an ASO may comprise a combination of phosphorodiamidate linkages and sugar moieties comprising morpholine rings (morpholinos). Combinations of different modifications to an ASO are referred to as "mixed modifications" or "mixed chemistries."

In some embodiments, the ASO comprises one or more backbone modifications. In some embodiments, the ASO comprises one or more sugar moiety modification. In some embodiments, the ASO comprises one or more backbone modifications and one or more sugar moiety modifications. In some embodiments, the ASO comprises a 2'MOE modification and a phosphorothioate backbone. In some embodiments, the ASO comprises a phosphorodiamidate morpholino (PMO). In some embodiments, the ASO comprises a peptide nucleic acid (PNA). Any of the ASOs or any component of an ASO (e.g., a nucleobase, sugar moiety, backbone) described herein may be modified in order to achieve desired properties or activities of the ASO or reduce undesired properties or activities of the ASO. For example, an ASO or one or more components of any ASO may be modified to enhance binding affinity to a target sequence on a pre-mRNA transcript; reduce binding to any non-target sequence; reduce degradation by cellular nucleases (i.e., RNase H); improve uptake of the ASO into a cell and/or into the nucleus of a cell; alter the pharmacokinetics or pharmacodynamics of the ASO; and/or modulate the half-life of the ASO.

In some embodiments, the ASOs are comprised of 2'-O-(2-methoxyethyl) (MOE) phosphorothioate-modified nucleotides. ASOs comprised of such nucleotides are especially well-suited to the methods disclosed herein; oligomers having such modifications have been shown to have significantly enhanced resistance to nuclease degradation and increased bioavailability, making them suitable, for example, for oral delivery in some embodiments described herein. See e.g., Geary, et al., J Pharmacol Exp Ther. 2001; 296(3):890-7; Geary, et al., J Pharmacol Exp Ther. 2001; 296(3):898-904.

Methods of synthesizing ASOs will be known to one of skill in the art. Alternatively or in addition, ASOs may be obtained from a commercial source.

Unless specified otherwise, the left-hand end of single-stranded nucleic acid (e.g., pre-mRNA transcript, oligonucleotide, ASO, etc.) sequences is the 5' end and the left-hand direction of single or double-stranded nucleic acid sequences is referred to as the 5' direction. Similarly, the right-hand end or direction of a nucleic acid sequence (single or double stranded) is the 3' end or direction. Generally, a region or sequence that is 5' to a reference point in a nucleic acid is referred to as "upstream," and a region or sequence that is 3' to a reference point in a nucleic acid is referred to as "downstream." Generally, the 5' direction or end of an mRNA is where the initiation or start codon is located, while the 3' end or direction is where the termination codon is located. In some aspects, nucleotides that are upstream of a reference point in a nucleic acid may be designated by a negative number, while nucleotides that are downstream of a reference point may be designated by a positive number. For example, a reference point (e.g., an exon-exon junction in mRNA) may be designated as the "zero" site, and a nucleotide that is directly adjacent and upstream of the reference point is designated "minus one," e.g., "−1," while a nucleotide that is directly adjacent and downstream of the reference point is designated "plus one," e.g., "+1."

In some embodiments, the ASOs are complementary to (and bind to) a targeted portion of a ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 NIE containing pre-mRNA that is downstream (in the 3' direction) of the 5' splice site (or 3' end of the NIE) of the included exon in a ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 NIE containing pre-mRNA (e.g., the direction designated by positive numbers relative to the 5' splice site). In some embodiments, the ASOs are complementary to a targeted portion of the ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 NIE containing pre-mRNA that is within the region about +1 to about +500 relative to the 5' splice site (or 3' end) of the included exon. In some embodiments, the ASOs may be complementary to a targeted portion of a ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 NIE containing pre-mRNA that is within the region between nucleotides +6 and +40,000 relative to the 5' splice site (or 3' end) of the included exon. In some aspects, the ASOs are complementary to a targeted portion that is within the region about +1 to about +40,000, about +1 to about +30,000, about +1 to about +20,000, about +1 to about +15,000, about +1 to about +10,000, about +1 to about +5,000, about +1 to about +4,000, about +1 to about +3,000, about +1 to about +2,000, about +1 to about +1,000, about +1 to about +500, about +1 to about +490, about +1 to about +480, about +1 to about +470, about +1 to about +460, about +1 to about +450, about +1 to about +440, about +1 to about +430, about +1 to about +420, about +1 to about +410, about +1 to about +400, about +1 to about +390, about +1 to about +380, about +1 to about +370, about +1 to about +360, about +1 to about +350, about +1 to about +340, about +1 to about +330, about +1 to about +320, about +1 to about +310, about +1 to about +300, about +1 to about +290, about +1 to about +280, about +1 to about +270, about +1 to about +260, about +1 to about +250, about +1 to about +240, about +1 to about +230, about +1 to about +220, about +1 to about +210, about +1 to about +200, about +1 to about +190, about +1 to about +180, about +1 to about +170, about +1 to about +160, about +1 to about +150, about +1 to about +140, about +1 to about +130, about +1 to about +120, about +1 to about +110, about +1 to about +100, about +1 to about +90, about +1 to about +80, about +1 to about +70, about +1 to about +60, about +1 to about +50, about +1 to about +40, about +1 to about +30, or about +1 to about +20 relative to 5' splice site (or 3' end) of the included exon. In some aspects, the ASOs are complementary to a targeted portion that is within the region from about +1 to about +100, from about +100 to about +200, from about +200 to about +300, from about +300 to about +400, or from about +400 to about +500 relative to 5' splice site (or 3' end) of the included exon.

In some embodiments, the ASOs are complementary to (and bind to) a targeted portion of a ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 NIE containing pre-mRNA that is upstream (in the 5' direction) of the 5' splice site (or 3' end) of the included exon in a ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 NIE containing pre-mRNA (e.g., the direction designated by negative numbers relative to the 5' splice site). In some embodiments, the ASOs are complementary to a targeted portion of the ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 NIE containing pre-mRNA that is within the region about −4 to about −270 relative to the 5' splice site (or 3'end) of the included exon. In some embodiments, the ASOs may be complementary to a targeted portion of a ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 NIE containing pre-mRNA that is within the region between nucleotides −1 and −40,000 relative to the 5' splice site (or 3' end) of the included exon. In some aspects, the ASOs are complementary to a targeted portion that is within the region about −1 to about −40,000, about −1 to about −30,000, about −1 to about −20,000, about −1 to about −15,000, about −1 to about −10,000, about −1 to about −5,000, about −1 to about −4,000, about −1 to about −3,000, about −1 to about −2,000, about −1 to about −1,000, about −1 to about −500, about −1 to about −490, about −1 to about −480, about −1 to about −470, about −1 to about −460, about −1 to about −450, about −1 to about −440, about −1 to about −430, about −1 to about −420, about −1 to about −410, about −1 to about −400, about −1 to about −390, about −1 to about −380, about −1 to about −370, about −1 to about −360, about −1 to about −350, about −1 to about −340, about −1 to about −330, about −1 to about −320, about −1 to about −310, about −1 to about −300, about −1 to about −290, about −1 to about −280, about −1 to about −270, about −1 to about −260, about −1 to about −250, about −1 to about −240, about −1 to about −230, about −1 to about −220, about −1 to about −210, about −1 to about −200, about −1 to about −190, about −1 to about −180, about −1 to about −170, about −1 to about −160, about −1 to about −150, about −1 to about −140, about −1 to about −130, about −1 to about −120, about −1 to about −110, about −1 to about −100, about −1 to about −90, about −1 to about −80, about −1 to about −70, about −1 to about −60, about −1 to about −50, about −1 to about −40, about −1 to about −30, or about −1 to about −20 relative to 5' splice site (or 3' end) of the included exon.

In some embodiments, the ASOs are complementary to a targeted region of a ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6AJ, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 NIE containing pre-mRNA that is upstream (in the 5' direction) of the 3' splice site (or 5' end) of the included exon in a ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 NIE containing pre-mRNA (e.g., in the direction designated by negative numbers). In some embodiments, the ASOs are complementary to a targeted portion of the ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 NIE containing pre-mRNA that is within the region about −1 to about −500 relative to the 3' splice site (or 5' end) of the included exon. In some embodiments, the ASOs are complementary to a targeted portion of the ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 NIE containing pre-mRNA that is within the region −1 to −40,000 relative to the 3' splice site of the included exon. In some aspects, the ASOs are complementary to a targeted portion that is within the region about −1 to about −40,000, about −1 to about −30,000, −1 to about −20,000, about −1 to about −15,000, about −1 to about −10,000, about −1 to about −5,000, about −1 to about −4,000, about −1 to about −3,000, about −1 to about −2,000, about −1 to about −1,000, about −1 to about −500, about −1 to about −490, about −1 to about −480, about −1 to about −470, about −1 to about −460, about −1 to about −450, about −1 to about −440, about −1 to about −430, about −1 to about −420, about −1 to about −410, about −1 to about −400, about −1 to about −390, about −1 to about −380, about −1 to about −370, about −1 to about −360, about −1 to about −350, about −1 to about −340, about −1 to about −330, about −1 to about −320, about −1 to about −310, about −1 to about −300, about −1 to about −290, about −1 to about −280, about −1 to about −270, about −1 to about −260, about −1 to about −250, about −1 to about −240, about −1 to about −230, about −1 to about −220, about −1 to about −210, about −1 to about −200, about −1 to about −190, about −1 to about −180, about −1 to about −170, about −1 to about −160, about −1 to about −150, about −1 to about −140, about −1 to about −130, about −1 to about −120, about −1 to about −110, about −1 to about −100, about −1 to about −90, about −1 to about −80, about −1 to about −70, about −1 to about −60, about −1 to about −50, about −1 to about −40, about −1 to about −30, or about −1 to about −20 relative to 3' splice site of the included exon. In some aspects, the ASOs are complementary to a targeted portion that is within the region from about −1 to about −100, from about −100 to about −200, from about −200 to about −300, from about −300 to about −400, or from about −400 to about −500 relative to 3' splice site of the included exon.

In some embodiments, the ASOs are complementary to a targeted region of a ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 NIE containing pre-mRNA that is downstream (in the 3' direction) of the 3' splice site (5' end) of the included exon in a ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 NIE containing pre-mRNA (e.g., in the direction designated by positive numbers). In some embodiments, the ASOs are complementary to a targeted portion of the ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 NIE containing pre-mRNA that is within the region of about +1 to about +40,000 relative to the 3' splice site of the included exon. In some aspects, the ASOs are complementary to a targeted portion that is within the region about +1 to about +40,000, about +1 to about +30,000, about +1 to about +20,000, about +1 to about +15,000, about +1 to about +10,000, about +1 to about +5,000, about +1 to about +4,000, about +1 to about +3,000, about +1 to about +2,000, about +1 to about +1,000, about +1 to about +500, about +1 to about +490, about +1 to about +480, about +1 to about +470, about +1 to about +460, about +1 to about +450, about +1 to about +440, about +1 to about +430, about +1 to about +420, about +1 to about +410, about +1 to about +400, about +1 to about +390, about +1 to about +380, about +1 to about +370, about +1 to about +360, about +1 to about +350, about +1 to about +340, about +1 to about +330, about +1 to about +320, about +1 to about +310, about +1 to about +300, about +1 to about +290, about +1 to about +280, about +1 to about +270, about +1 to about +260, about +1 to about +250, about +1 to about +240, about +1 to about +230, about +1 to about +220, about +1 to about +210, about +1 to about +200, about +1 to about +190, about +1 to about +180, about +1 to about +170, about +1 to about +160, about +1 to about +150, about +1 to about +140, about +1 to about +130, about +1 to about +120, about +1 to about +110, about +1 to about +100, about +1 to about +90, about +1 to about +80, about +1 to about +70, about +1 to about +60, about +1 to about +50, about +1 to about +40, about +1 to about +30, or about +1 to about +20, or about +1 to about +10 relative to 3' splice site of the included exon.

In some embodiments, the targeted portion of the ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6AJ, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 NIE containing pre-mRNA is within the region +100 relative to the 5' splice site (3' end) of the included exon to −100 relative to the 3' splice site (5' end) of the included exon. In some embodiments, the targeted portion of the ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 NIE containing pre-mRNA is within the NIE. In some embodiments, the target portion of the ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 NIE containing pre-mRNA comprises a pseudo-exon and intron boundary.

The ASOs may be of any length suitable for specific binding and effective enhancement of splicing. In some embodiments, the ASOs consist of 8 to 50 nucleobases. For example, the ASO may be 8, 9, 10, 11, 12, 13, 14, 15, 16, 17, 18, 19, 20, 21, 22, 23, 24, 25, 26, 27, 28, 29, 30, 31, 32, 33, 34, 35, 40, 45, or 50 nucleobases in length. In some embodiments, the ASOs consist of more than 50 nucleobases. In some embodiments, the ASO is from 8 to 50 nucleobases, 8 to 40 nucleobases, 8 to 35 nucleobases, 8 to 30 nucleobases, 8 to 25 nucleobases, 8 to 20 nucleobases, 8 to 15 nucleobases, 9 to 50 nucleobases, 9 to 40 nucleobases, 9 to 35 nucleobases, 9 to 30 nucleobases, 9 to 25 nucleobases, 9 to 20 nucleobases, 9 to 15 nucleobases, 10 to 50 nucleobases, 10 to 40 nucleobases, 10 to 35 nucleobases, 10 to 30 nucleobases, 10 to 25 nucleobases, 10 to 20 nucleobases, 10 to 15 nucleobases, 11 to 50 nucleobases, 11 to 40 nucleobases, 11 to 35 nucleobases, 11 to 30 nucleobases, 11 to 25 nucleobases, 11 to 20 nucleobases, 11 to 15 nucleobases, 12 to 50 nucleobases, 12 to 40 nucleobases, 12 to 35 nucleobases, 12 to 30 nucleobases, 12 to 25 nucleobases, 12 to 20 nucleobases, 12 to 15 nucleobases, 13 to 50 nucleobases, 13 to 40 nucleobases, 13 to 35 nucleobases, 13 to 30 nucleobases, 13 to 25 nucleobases, 13 to 20 nucleobases, 14 to 50 nucleobases, 14 to 40 nucleobases, 14 to 35 nucleobases, 14 to 30 nucleobases, 14 to 25 nucleobases, 14 to 20 nucleobases, 15 to 50 nucleobases, 15 to 40 nucleobases, 15 to 35 nucleobases, 15 to 30 nucleobases, 15 to 25 nucleobases, 15 to 20 nucleobases, 20 to 50 nucleobases, 20 to 40 nucleobases, 20 to 35 nucleobases, 20 to 30 nucleobases, 20 to 25 nucleobases, 25 to 50 nucleobases, 25 to 40 nucleobases, 25 to 35 nucleobases, or 25 to 30 nucleobases in length. In some embodiments, the ASOs are 18 nucleotides in length. In some embodiments, the ASOs are 15 nucleotides in length. In some embodiments, the ASOs are 25 nucleotides in length.

In some embodiments, two or more ASOs with different chemistries but complementary to the same targeted portion of the NIE containing pre-mRNA are used. In some embodiments, two or more ASOs that are complementary to different targeted portions of the NIE containing pre-mRNA are used.

In some embodiments, the antisense oligonucleotides of the disclosure are chemically linked to one or more moieties or conjugates, e.g., a targeting moiety or other conjugate that enhances the activity or cellular uptake of the oligonucleotide. Such moieties include, but are not limited to, a lipid moiety, e.g., as a cholesterol moiety, a cholesteryl moiety, an aliphatic chain, e.g., dodecandiol or undecyl residues, a polyamine or a polyethylene glycol chain, or adamantane acetic acid. Oligonucleotides comprising lipophilic moieties and preparation methods have been described in the published literature. In embodiments, the antisense oligonucleotide is conjugated with a moiety including, but not limited to, an abasic nucleotide, a polyether, a polyamine, a polyamide, a peptides, a carbohydrate, e.g., N-acetylgalactosamine (GalNAc), N—Ac-Glucosamine (GluNAc), or mannose (e.g., mannose-6-phosphate), a lipid, or a polyhydrocarbon compound. Conjugates can be linked to one or more of any nucleotides comprising the antisense oligonucleotide at any of several positions on the sugar, base or phosphate group, as understood in the art and described in the literature, e.g., using a linker. Linkers can include a bivalent or trivalent branched linker. In embodiments, the conjugate is attached to the 3' end of the antisense oligonucleotide. Methods of preparing oligonucleotide conjugates are described, e.g., in U.S. Pat. No. 8,450,467, "Carbohydrate conjugates as delivery agents for oligonucleotides," incorporated by reference herein.

In some embodiments, the nucleic acid to be targeted by an ASO is a ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6AJ, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 NIE containing pre-mRNA expressed in a cell, such as a eukaryotic cell. In some embodiments, the term "cell" may refer to a population of cells. In some embodiments, the cell is in a subject. In some embodiments, the cell is isolated from a subject. In some embodiments, the cell is ex vivo. In some embodiments, the cell is a condition or disease-relevant cell or a cell line. In some embodiments, the cell is in vitro (e.g., in cell culture).

Pharmaceutical Compositions

Pharmaceutical compositions or formulations comprising the agent, e.g., antisense oligonucleotide, of the described compositions and for use in any of the described methods can be prepared according to conventional techniques well known in the pharmaceutical industry and described in the published literature. In embodiments, a pharmaceutical composition or formulation for treating a subject comprises an effective amount of any antisense oligomer as described herein, or a pharmaceutically acceptable salt, solvate, hydrate or ester thereof. The pharmaceutical formulation comprising an antisense oligomer may further comprise a pharmaceutically acceptable excipient, diluent or carrier.

Pharmaceutically acceptable salts are suitable for use in contact with the tissues of humans and lower animals without undue toxicity, irritation, allergic response, etc., and are commensurate with a reasonable benefit/risk ratio. (See, e.g., S. M. Berge, et al., J. Pharmaceutical Sciences, 66: 1-19 (1977), incorporated herein by reference for this purpose. The salts can be prepared in situ during the final isolation and purification of the compounds, or separately by reacting the free base form with a suitable organic acid. Examples of pharmaceutically acceptable, nontoxic acid addition salts are salts of an amino group formed with inorganic acids such as hydrochloric acid, hydrobromic acid, phosphoric acid, sulfuric acid and perchloric acid or with organic acids such as acetic acid, oxalic acid, maleic acid, tartaric acid, citric acid, succinic acid or malonic acid or by using other documented methodologies such as ion exchange. Other pharmaceutically acceptable salts include adipate, alginate, ascorbate, aspartate, benzenesulfonate, benzoate, bisulfate, borate, butyrate, camphorate, camphorsulfonate, citrate, cyclopentanepropionate, digluconate, dodecylsulfate, ethanesulfonate, formate, fumarate, glucoheptonate, glycerophosphate, gluconate, hemisulfate, heptanoate, hexanoate, hydroiodide, 2-hydroxy-ethanesulfonate, lactobionate, lactate, laurate, lauryl sulfate, malate, maleate, malonate, methanesulfonate, 2-naphthalenesulfonate, nicotinate, nitrate, oleate, oxalate, palmitate, pamoate, pectinate, persulfate, 3-phenylpropionate, phosphate, picrate, pivalate, propionate, stearate, succinate, sulfate, tartrate, thiocyanate, p-toluenesulfonate, undecanoate, valerate salts, and the like. Representative alkali or alkaline earth metal salts include sodium, lithium, potassium, calcium, magnesium, and the like. Further pharmaceutically acceptable salts include, when appropriate, nontoxic ammonium, quaternary ammonium, and amine cations formed using counterions such as halide, hydroxide, carboxylate, sulfate, phosphate, nitrate, loweralkyl sulfonate and aryl sulfonate.

In some embodiments, the compositions are formulated into any of many possible dosage forms such as, but not limited to, tablets, capsules, gel capsules, liquid syrups, soft gels, suppositories, and enemas. In embodiments, the compositions are formulated as suspensions in aqueous, non-aqueous or mixed media. Aqueous suspensions may further contain substances that increase the viscosity of the suspension including, for example, sodium carboxymethylcellulose, sorbitol and/or dextran. The suspension may also contain stabilizers. In embodiments, a pharmaceutical formulation or composition of the present disclosure includes, but is not limited to, a solution, emulsion, microemulsion, foam or liposome-containing formulation (e.g., cationic or noncationic liposomes).

The pharmaceutical composition or formulation described herein may comprise one or more penetration enhancers, carriers, excipients or other active or inactive ingredients as appropriate and well known to those of skill in the art or described in the published literature. In embodiments, liposomes also include sterically stabilized liposomes, e.g., liposomes comprising one or more specialized lipids. These specialized lipids result in liposomes with enhanced circulation lifetimes. In embodiments, a sterically stabilized liposome comprises one or more glycolipids or is derivatized with one or more hydrophilic polymers, such as a polyethylene glycol (PEG) moiety. In some embodiments, a surfactant is included in the pharmaceutical formulation or compositions. The use of surfactants in drug products, formulations and emulsions is well known in the art. In embodiments, the present disclosure employs a penetration enhancer to effect the efficient delivery of the antisense oligonucleotide, e.g., to aid diffusion across cell membranes and/or enhance the permeability of a lipophilic drug. In some embodiments, the penetration enhancers are a surfactant, fatty acid, bile salt, chelating agent, or non-chelating nonsurfactant.

In some embodiments, the pharmaceutical formulation comprises multiple antisense oligonucleotides. In embodiments, the antisense oligonucleotide is administered in combination with another drug or therapeutic agent.

Combination Therapies

In some embodiments, the ASOs disclosed in the present disclosure can be used in combination with one or more additional therapeutic agents. In some embodiments, the one or more additional therapeutic agents can comprise a small molecule. For example, the one or more additional therapeutic agents can comprise a small molecule described in WO2016128343A1, WO2017053982A1, WO2016196386A1, WO201428459A1, WO201524876A2, WO2013119916A2, and WO2014209841A2, which are incorporated by reference herein in their entirety. In some embodiments, the one or more additional therapeutic agents comprise an ASO that can be used to correct intron retention.

Treatment of Subjects

Any of the compositions provided herein may be administered to an individual. "Individual" may be used interchangeably with "subject" or "patient." An individual may be a mammal, for example a human or animal such as a non-human primate, a rodent, a rabbit, a rat, a mouse, a horse, a donkey, a goat, a cat, a dog, a cow, a pig, or a sheep. In embodiments, the individual is a human. In embodiments, the individual is a fetus, an embryo, or a child. In other embodiments, the individual may be another eukaryotic organism, such as a plant. In some embodiments, the compositions provided herein are administered to a cell ex vivo.

In some embodiments, the compositions provided herein are administered to an individual as a method of treating a disease or disorder. In some embodiments, the individual has a genetic disease, such as any of the diseases described herein. In some embodiments, the individual is at risk of having a disease, such as any of the diseases described herein. In some embodiments, the individual is at increased risk of having a disease or disorder caused by insufficient amount of a protein or insufficient activity of a protein. If an individual is "at an increased risk" of having a disease or disorder caused insufficient amount of a protein or insufficient activity of a protein, the method involves preventative or prophylactic treatment. For example, an individual may be at an increased risk of having such a disease or disorder because of family history of the disease. Typically, individuals at an increased risk of having such a disease or disorder benefit from prophylactic treatment (e.g., by preventing or delaying the onset or progression of the disease or disorder). In embodiments, a fetus is treated in utero, e.g., by administering the ASO composition to the fetus directly or indirectly (e.g., via the mother).

Suitable routes for administration of ASOs of the present disclosure may vary depending on cell type to which delivery of the ASOs is desired. Multiple tissues and organs are affected by Dravet syndrome, with the brain being the most significantly affected tissue. The ASOs of the present disclosure may be administered to patients parenterally, for example, by intrathecal injection, intracerebroventricular injection, intraperitoneal injection, intramuscular injection, subcutaneous injection, or intravenous injection.

In embodiments, the antisense oligonucleotide is administered with one or more agents capable of promoting penetration of the subject antisense oligonucleotide across the blood-brain barrier by any method known in the art. For example, delivery of agents by administration of an adenovirus vector to motor neurons in muscle tissue is described in U.S. Pat. No. 6,632,427, "Adenoviral-vector-mediated gene transfer into medullary motor neurons," incorporated herein by reference. Delivery of vectors directly to the brain, e.g., the striatum, the thalamus, the hippocampus, or the substantia nigra, is described, e.g., in U.S. Pat. No. 6,756,523, "Adenovirus vectors for the transfer of foreign genes into cells of the central nervous system particularly in brain," incorporated herein by reference.

In some embodiments, the antisense oligonucleotides are linked or conjugated with agents that provide desirable pharmaceutical or pharmacodynamic properties. In embodiments, the antisense oligonucleotide is coupled to a substance, known in the art to promote penetration or transport across the blood-brain barrier, e.g., an antibody to the transferrin receptor. In embodiments, the antisense oligonucleotide is linked with a viral vector, e.g., to render the antisense compound more effective or increase transport across the blood-brain barrier. In embodiments, osmotic blood brain barrier disruption is assisted by infusion of sugars, e.g., meso erythritol, xylitol, D(+) galactose, D(+) lactose, D(+) xylose, dulcitol, myo-inositol, L(−) fructose, D(−) mannitol, D(+) glucose, D(+) arabinose, D(−) arabinose, cellobiose, D(+) maltose, D(+) raffinose, L(+) rhamnose, D(+) melibiose, D(−) ribose, adonitol, D(+) arabitol, L(−) arabitol, D(+) fucose, L(−) fucose, D(−) lyxose, L(+) lyxose, and L(−) lyxose, or amino acids, e.g., glutamine, lysine, arginine, asparagine, aspartic acid, cysteine, glutamic acid, glycine, histidine, leucine, methionine, phenylalanine, proline, serine, threonine, tyrosine, valine, and taurine. Methods and materials for enhancing blood brain barrier penetration are described, e.g., in U.S. Pat. No. 9,193,969, "Compositions and methods for selective delivery of oligonucleotide molecules to specific neuron types," U.S. Pat. No. 4,866,042, "Method for the delivery of genetic material across the blood brain barrier," U.S. Pat. No. 6,294,520, "Material for passage through the blood-brain barrier," and U.S. Pat. No. 6,936,589, "Parenteral delivery systems," each incorporated herein by reference.

In some embodiments, an ASO of the disclosure is coupled to a dopamine reuptake inhibitor (DRI), a selective serotonin reuptake inhibitor (SSRI), a noradrenaline reuptake inhibitor (NRI), a norepinephrine-dopamine reuptake inhibitor (NDRI), and a serotonin-norepinephrine-dopamine reuptake inhibitor (SNDRI), using methods described in, e.g., U.S. Pat. No. 9,193,969, incorporated herein by reference.

In some embodiments, subjects treated using the methods and compositions are evaluated for improvement in condition using any methods known and described in the art.

Methods of Identifying Additional ASOs that Induce Exon Skipping

Also within the scope of the present disclosure are methods for identifying or determining ASOs that induce exon skipping of a ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6AJ, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 NIE containing pre-mRNA. For example, a method can comprise identifying or determining ASOs that induce pseudo-exon skipping of a ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, VCAN, AKT3, CD46, COL11A2, CR1, CRX, DNAJC8, MYH14, MYO6, NF2, SEMA3C, SEMA3D, EIF2AK3, ERN1, GUCY2F, SIRT3, NR1H4, STK11, PPARA, CYP2J2, or SYNGAP1 NIE containing pre-mRNA. ASOs that specifically hybridize to different nucleotides within the target region of the pre-mRNA may be screened to identify or determine ASOs that improve the rate and/or extent of splicing of the target intron. In some embodiments, the ASO may block or interfere with the binding site(s) of a splicing repressor(s)/silencer. Any method known in the art may be used to identify (determine) an ASO that when hybridized to the target region of the exon results in the desired effect (e.g., pseudo-exon skipping, protein or functional RNA production). These methods also can be used for identifying ASOs that induce exon skipping of the included exon by binding to a targeted region in an intron flanking the included exon, or in a non-included exon. An example of a method that may be used is provided below.

A round of screening, referred to as an ASO "walk" may be performed using ASOs that have been designed to hybridize to a target region of a pre-mRNA. For example, the ASOs used in the ASO walk can be tiled every 5 nucleotides from approximately 100 nucleotides upstream of the 3' splice site of the included exon (e.g., a portion of sequence of the exon located upstream of the target/included exon) to approximately 100 nucleotides downstream of the 3' splice site of the target/included exon and/or from approximately 100 nucleotides upstream of the 5' splice site of the included exon to approximately 100 nucleotides downstream of the 5' splice site of the target/included exon (e.g., a portion of sequence of the exon located downstream of the target/included exon). For example, a first ASO of 15 nucleotides in length may be designed to specifically hybridize to nucleotides +6 to +20 relative to the 3' splice site of the target/included exon. A second ASO may be designed to specifically hybridize to nucleotides +11 to +25 relative to the 3' splice site of the target/included exon. ASOs are designed as such spanning the target region of the pre-mRNA. In embodiments, the ASOs can be tiled more closely, e.g., every 1, 2, 3, or 4 nucleotides. Further, the ASOs can be tiled from 100 nucleotides downstream of the 5' splice site, to 100 nucleotides upstream of the 3' splice site. In some embodiments, the ASOs can be tiled from about 1,160 nucleotides upstream of the 3' splice site, to about 500 nucleotides downstream of the 5' splice site. In some embodiments, the ASOs can be tiled from about 500 nucleotides upstream of the 3' splice site, to about 1,920 nucleotides downstream of the 3' splice site.

One or more ASOs, or a control ASO (an ASO with a scrambled sequence, sequence that is not expected to hybridize to the target region) are delivered, for example by transfection, into a disease-relevant cell line that expresses the target pre-mRNA (e.g., a NIE containing pre-mRNA described herein). The exon skipping effects of each of the ASOs may be assessed by any method known in the art, for example by reverse transcriptase (RT)-PCR using primers that span the splice junction, as described in Example 4. A reduction or absence of a longer RT-PCR product produced using the primers spanning the region containing the included exon (e.g. including the flanking exons of the NIE) in ASO-treated cells as compared to in control ASO-treated cells indicates that splicing of the target NIE has been enhanced. In some embodiments, the exon skipping efficiency (or the splicing efficiency to splice the intron containing the NIE), the ratio of spliced to unspliced pre-mRNA, the rate of splicing, or the extent of splicing may be improved using the ASOs described herein. The amount of protein or functional RNA that is encoded by the target pre-mRNA can also be assessed to determine whether each ASO achieved the desired effect (e.g., enhanced functional protein production). Any method known in the art for assessing and/or quantifying protein production, such as Western blotting, flow cytometry, immunofluorescence microscopy, and ELISA, can be used.

A second round of screening, referred to as an ASO "micro-walk" may be performed using ASOs that have been designed to hybridize to a target region of a pre-mRNA. The ASOs used in the ASO micro-walk are tiled every 1 nucleotide to further refine the nucleotide acid sequence of the pre-mRNA that when hybridized with an ASO results in exon skipping (or enhanced splicing of NIE).

Regions defined by ASOs that promote splicing of the target intron are explored in greater detail by means of an ASO "micro-walk", involving ASOs spaced in 1-nt steps, as well as longer ASOs, typically 18-25 nt.

As described for the ASO walk above, the ASO micro-walk is performed by delivering one or more ASOs, or a control ASO (an ASO with a scrambled sequence, sequence that is not expected to hybridize to the target region), for example by transfection, into a disease-relevant cell line that expresses the target pre-mRNA. The splicing-inducing effects of each of the ASOs may be assessed by any method known in the art, for example by reverse transcriptase (RT)-PCR using primers that span the NIE, as described herein (see, e.g., Example 4). A reduction or absence of a longer RT-PCR product produced using the primers spanning the NIE in ASO-treated cells as compared to in control ASO-treated cells indicates that exon skipping (or splicing of the target intron containing an NIE) has been enhanced. In some embodiments, the exon skipping efficiency (or the splicing efficiency to splice the intron containing the NIE), the ratio of spliced to unspliced pre-mRNA, the rate of splicing, or the extent of splicing may be improved using the ASOs described herein. The amount of protein or functional RNA that is encoded by the target pre-mRNA can also be assessed to determine whether each ASO achieved the desired effect (e.g., enhanced functional protein production). Any method known in the art for assessing and/or quantifying protein production, such as Western blotting, flow cytometry, immunofluorescence microscopy, and ELISA, can be used.

ASOs that when hybridized to a region of a pre-mRNA result in exon skipping (or enhanced splicing of the intron containing a NIE) and increased protein production may be tested in vivo using animal models, for example transgenic mouse models in which the full-length human gene has been knocked-in or in humanized mouse models of disease. Suitable routes for administration of ASOs may vary depending on the disease and/or the cell types to which delivery of the ASOs is desired. ASOs may be administered, for example, by intrathecal injection, intracerebroventricular injection, intraperitoneal injection, intramuscular injection, subcutaneous injection, or intravenous injection. Following administration, the cells, tissues, and/or organs of the model animals may be assessed to determine the effect of the ASO treatment by for example evaluating splicing (e.g., efficiency, rate, extent) and protein production by methods known in the art and described herein. The animal models may also be any phenotypic or behavioral indication of the disease or disease severity.

Also within the scope of the present disclosure is a method to identify or validate an NMD-inducing exon in the presence of an NMD inhibitor, for example, cycloheximide. An exemplary method is provided in Example 2.

SPECIFIC EMBODIMENTS (A)

Embodiment A1. A method of treating Alport syndrome; Amyotrophic lateral sclerosis (ALS); Angelman syndrome; Aphasia, primary progressive; Arrhythmogenic right ventricular dysplasia 9; Autism spectrum disorder; Cardiomyopathy, dilated, 1HH; Myopathy, myofibrillar 6; Ceriod lipofuscinosis, neuronal, 3; Cholestasis, intrahepatic, of pregnancy, 3; Cholestasis, progressive familial intrahepatic 1; Citrullinemia Type II; Citrullinemia, Type 1; Cognitive impairment with or without cerebral ataxia; Cornelia de Lange; Early-onset epileptic encephalopathy; Epilepsy-aphasia spectrum; Epilepsy, generalized, with febrile seizures plus, type 7; Epileptic encephalopathy, childhood-onset; Epileptic encephalopathy, early infantile, 11; Epileptic encephalopathy, early infantile, 12; Epileptic encephalopathy, early infantile, 13; Epileptic encephalopathy, early infantile, 2; Episodic ataxia, type 2; Familial focal epilepsy; Febrile seizures, familial, 3B; Friedreich ataxia; Friedreich ataxia with retained reflexes; Galactose epimerase deficiency; Glaucoma 3, primary congenital, E; Glycogen storage disease IV; GRN-related frontotemporal dementia; Homocystinuria, B6-responsive and nonresponsive types; HSAN2D, autosomal recessive; Insensitivity to pain, congenital; Kabuki syndrome; Koolen-De Vries syndrome; Mental retardation, autosomal dominant 1; Methyl malonic aciduria; Migraine, Myoclonic-atonic epilepsy; familial hemiplegic, 1; Neurofibromatosis type 1; Opioid addiction; Optic atrophy type 1; Pathway (eye); Pathway (central nervous system, epilepsy); Phelan-McDermid syndrome; Propionicacidemia; Primary open angle glaucoma; Propionic academia; Retinitis pigmentosa 11; Retinitis pigmentosa 18; Retinitis pigmentosa 31; Retinitis pigmentosa 59; Rett syndrome; Seizures, benign familial infantile, 3; Seizures, benign familial infantile, 5; Smith-Magenis syndrome; Sotos syndrome 1; Beckwith-Wiedemann syndrome; Stargardt disease 3; Tay-Sachs disease; Tuberous sclerosis; Tyrosinemia, type I; Wagner syndrome 1; West syndrome; Wolfram syndrome 2/NAFLD; 15q13.3 microdeletion; or 16p11.2 deletion syndrome in a subject in need thereof, by increasing the expression of a target protein or functional RNA by a cell of the subject, wherein the cell has an mRNA that contains a non-sense mediated RNA decay-inducing exon (NMD exon mRNA), and wherein the NMD exon mRNA encodes the target protein or functional RNA, the method comprising contacting the cell of the subject with a therapeutic agent that binds to a targeted portion of the NMD exon mRNA encoding the target protein or functional RNA, whereby the non-sense mediated RNA decay-inducing exon is excluded from the NMD exon mRNA encoding the target protein or functional RNA, thereby increasing the level of mRNA encoding the target protein or functional RNA, and increasing the expression of the target protein or functional RNA in the cell of the subject.

Embodiment A2. The method of embodiment A1, wherein the target protein is ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, or VCAN.

Embodiment A3. A method of increasing expression of ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, or VCAN protein by a cell having an mRNA that contains a non-sense mediated RNA decay-inducing exon (NMD exon mRNA) and encodes ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, or VCAN protein, the method comprising contacting the cell an agent that binds to a targeted portion of the NMD exon mRNA encoding ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, or VCAN protein, whereby the non-sense mediated RNA decay-inducing exon is excluded from the NMD exon mRNA encoding ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, or VCAN protein, thereby increasing the level of mRNA encoding ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, or VCAN protein, and increasing the expression of ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, or VCAN protein in the cell.

Embodiment A4. The method of any one of embodiments A1 to A3, wherein the non-sense mediated RNA decay-inducing exon is spliced out from the NMD exon mRNA encoding the target protein or functional RNA.

Embodiment A5. The method of any one of embodiments A1 to A4, wherein the target protein does not comprise an amino acid sequence encoded by the non-sense mediated RNA decay-inducing exon.

Embodiment A6. The method of any one of embodiments A1 to A5, wherein the target protein is a full-length target protein.

Embodiment A7. The method of any one of embodiments A1 to A6, wherein the agent is an antisense oligomer (ASO) complementary to the targeted portion of the NMD exon mRNA.

Embodiment A8. The method of any one of embodiments A1 to A7, wherein the mRNA is pre-mRNA.

Embodiment A9. The method of any one of embodiments A1 to A8, wherein the contacting comprises contacting the therapeutic agent to the mRNA, wherein the mRNA is in a nucleus of the cell.

Embodiment A10. The method of any one of embodiments A1 to A9, wherein the target protein or the functional RNA corrects a deficiency in the target protein or functional RNA in the subject.

Embodiment A11. The method of any one of embodiments A1 to A10, wherein the cells are in or from a subject with a condition caused by a deficient amount or activity of ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, or VCAN protein.

Embodiment A12. The method of any one of embodiments A1 to A11, wherein the deficient amount of the target protein is caused by haploinsufficiency of the target protein, wherein the subject has a first allele encoding a functional target protein, and a second allele from which the target protein is not produced, or a second allele encoding a nonfunctional target protein, and wherein the antisense oligomer binds to a targeted portion of a NMD exon mRNA transcribed from the first allele.

Embodiment A13. The method of any one of embodiments A1 to A11, wherein the subject has a condition caused by a disorder resulting from a deficiency in the amount or function of the target protein, wherein the subject has (a) a first mutant allele from which
   (i) the target protein is produced at a reduced level compared to production from a wild-type allele,
   (ii) the target protein is produced in a form having reduced function compared to an equivalent wild-type protein, or
   (iii) the target protein is not produced, and
(b) a second mutant allele from which
   (i) the target protein is produced at a reduced level compared to production from a wild-type allele,
   (ii) the target protein is produced in a form having reduced function compared to an equivalent wild-type protein, or
   (iii) the target protein is not produced, and wherein when the subject has a first mutant allele (a)(iii), the second mutant allele is (b)(i) or (b)(ii) and wherein when the subject has a second mutant allele (b)(iii), the first mutant allele is (a)(i) or (a)(ii), and wherein the NMD exon mRNA is transcribed from either the first mutant allele that is (a)(i) or (a)(ii), and/or the second allele that is (b)(i) or (b)(ii).

Embodiment A14. The method of embodiment A13, wherein the target protein is produced in a form having reduced function compared to the equivalent wild-type protein.

Embodiment A15. The method of embodiment A13, wherein the target protein is produced in a form that is fully-functional compared to the equivalent wild-type protein.

Embodiment A16. The method of any one of embodiments A1 to A15, wherein the targeted portion of the NMD exon mRNA is within the non-sense mediated RNA decay-inducing exon.

Embodiment A17. The method of any one of embodiments A1 to A15, wherein the targeted portion of the NMD exon mRNA is either upstream or downstream of the non-sense mediated RNA decay-inducing exon.

Embodiment A18. The method of any one of embodiments A1 to A17, wherein the NMD exon mRNA comprises a sequence with at least about 80%, 85%, 90%, 95%, 97%, or 100% sequence identity to any one of SEQ ID NOs: 60-134.

Embodiment A19. The method of any one of embodiments A1 to A17, wherein the NMD exon mRNA is encoded by a genetic sequence with at least about 80%, 85%, 90%, 95%, 97%, or 100% sequence identity to SEQ ID NOs: 1-59.

Embodiment A20. The method of any one of embodiments A1 to A17, wherein the targeted portion of the NMD exon mRNA comprises a sequence with at least 80%, 85%, 90%, 95%, 97%, or 100% sequence identity to a region comprising at least 8 contiguous nucleic acids of SEQ ID NO: SEQ ID NOs: 60-134.

Embodiment A21. The method of any one of embodiments A1 to A20, wherein the agent is an antisense oligomer (ASO) and wherein the ASO comprises a sequence that is at least about 80%, 85%, 90%, 95%, 97%, or 100% complementary to at least 8 contiguous nucleic acids of SEQ ID NOs: 60-134.

Embodiment A22. The method of any one of embodiments A1 to A15, wherein the targeted portion of the NMD exon mRNA is within the non-sense mediated RNA decay-inducing exon 8× of ABCB4, exon 9× of ASS1, exon 16× of ATP8B1, exon 1× of BAG3, exon 31× of CACNA1A, exon 36× of CACNA1A, exon 37× of CACNA1A, exon 3× of CBS, exon 12× of CBS, exon 1× of CD55, exon 16× of CDKL5, exon 3× of CFH, exon 30× of CHD2, exon 4× of CHRNA7, exon 1× of CISD2, exon 15× of CLN3, exon 11× of COL4A3, exon 41× of COL4A3, exon 22× of COL4A4, exon 44× of COL4A4, exon 20× of DEPDC5, exon 2× of DHDDS, exon 3× of ELOVL4, exon 5× of FAH, exon 4× of FXN, exon 4× of GALE, exon 3× of GBE1, exon 11× of GRIN2A, exon 1× of GRN, exon 2× of HEXA, exon 2× of KANSL1, exon 1× of KCNQ2, exon 50× of KMT2D, exon 8× of MAPK3, exon 13× of MBD5, exon 2× of MECP2, exon 11× of MUT, exon 31× of NF1, exon 7× of NIPBL, exon 38× of NIPBL, exon 11× of NSD1, exon 6× of OPA1, exon 28× of OPA1, exon 1× of OPTN, exon 1× of PCCA, exon 5× of PCCB, exon 6× of PCCB, exon 4× of PKP2, exon 23× of PLCB1, exon 3× of PRPF3, exon 9× of PRPF31, exon 1× of RAI1, exon 5× of RBFOX2, exon 13× of SCN2A, exon 6× of SCN3A, exon 7× of SCN3A, exon 4× of SCN8A, exon 6× of SCN8A, exon 20× of SCN8A, exon 6× of SCN9A, exon 24× of SHANK3, exon 3× of SLC25A13, exon 6× of SLC25A13, exon 9× of SLC25A13, exon 11× of SLC25A13, exon 13× of SLC25A13, exon 1× of SLC6A1, exon 12× of SPTAN1, exon 10× of TEK, exon 15× of TEK, exon 1× of TOPORS, exon 11× of TSC2, exon 30× of TSC2, exon 1× of UBE3A, or exon 7× of VCAN.

Embodiment A23. The method of any one of embodiments A1 to A15, wherein the targeted portion of the NMD exon mRNA is upstream or downstream of the non-sense mediated RNA decay-inducing exon 8× of ABCB4, exon 9× of ASS1, exon 16× of ATP8B1, exon 1× of BAG3, exon 31× of CACNA1A, exon 36× of CACNA1A, exon 37× of CACNA1A, exon 3× of CBS, exon 12× of CBS, exon 1× of CD55, exon 16× of CDKL5, exon 3× of CFH, exon 30× of CHD2, exon 4× of CHRNA7, exon 1× of CISD2, exon 15× of CLN3, exon 11× of COL4A3, exon 41× of COL4A3, exon 22× of COL4A4, exon 44× of COL4A4, exon 20× of DEPDC5, exon 2× of DHDDS, exon 3× of ELOVL4, exon 5× of FAH, exon 4× of FXN, exon 4× of GALE, exon 3× of GBE1, exon 11× of GRIN2A, exon 1× of GRN, exon 2× of HEXA, exon 2× of KANSL1, exon 1× of KCNQ2, exon 50× of KMT2D, exon 8× of MAPK3, exon 13× of MBD5, exon 2× of MECP2, exon 11× of MUT, exon 31× of NF1, exon 7× of NIPBL, exon 38× of NIPBL, exon 11× of NSD1, exon 6× of OPA1, exon 28× of OPA1, exon 1× of OPTN, exon 1× of PCCA, exon 5× of PCCB, exon 6× of PCCB, exon 4× of PKP2, exon 23× of PLCB1, exon 3× of PRPF3, exon 9× of PRPF31, exon 1× of RAI1, exon 5× of RBFOX2, exon 13× of SCN2A, exon 6× of SCN3A, exon 7× of SCN3A, exon 4× of SCN8A, exon 6× of SCN8A, exon 20× of SCN8A, exon 6× of SCN9A, exon 24× of SHANK3, exon 3× of SLC25A13, exon 6× of SLC25A13, exon 9× of SLC25A13, exon 11× of SLC25A13, exon 13× of SLC25A13, exon 1× of SLC6A1, exon 12× of SPTAN1, exon 10× of TEK, exon 15× of TEK, exon 1× of TOPORS, exon 11× of TSC2, exon 30× of TSC2, exon 1× of UBE3A, or exon 7× of VCAN.

Embodiment A24. The method of any one of embodiments A1 to A15, wherein the targeted portion of the NMD exon mRNA comprises an exon-intron junction exon 8× of ABCB4, exon 9× of ASS1, exon 16× of ATP8B1, exon 1× of BAG3, exon 31× of CACNA1A, exon 36× of CACNA1A, exon 37× of CACNA1A, exon 3× of CBS, exon 12× of CBS, exon 1× of CD55, exon 16× of CDKL5, exon 3× of CFH, exon 30× of CHD2, exon 4× of CHRNA7, exon 1× of CISD2, exon 15× of CLN3, exon 11× of COL4A3, exon 41× of COL4A3, exon 22× of COL4A4, exon 44× of COL4A4, exon 20× of DEPDC5, exon 2× of DHDDS, exon 3× of ELOVL4, exon 5× of FAH, exon 4× of FXN, exon 4× of GALE, exon 3× of GBE1, exon 11× of GRIN2A, exon 1× of GRN, exon 2× of HEXA, exon 2× of KANSL1, exon 1× of KCNQ2, exon 50× of KMT2D, exon 8× of MAPK3, exon 13× of MBD5, exon 2× of MECP2, exon 11× of MUT, exon 31× of NF1, exon 7× of NIPBL, exon 38× of NIPBL, exon 11× of NSD1, exon 6× of OPA1, exon 28× of OPA1, exon 1× of OPTN, exon 1× of PCCA, exon 5× of PCCB, exon 6× of PCCB, exon 4× of PKP2, exon 23× of PLCB1, exon 3× of PRPF3, exon 9× of PRPF31, exon 1× of RAI1, exon 5× of RBFOX2, exon 13× of SCN2A, exon 6× of SCN3A, exon 7× of SCN3A, exon 4× of SCN8A, exon 6× of SCN8A, exon 20× of SCN8A, exon 6× of SCN9A, exon 24× of SHANK3, exon 3× of SLC25A13, exon 6× of SLC25A13, exon 9× of SLC25A13, exon 11× of SLC25A13, exon 13× of SLC25A13, exon 1× of SLC6A1, exon 12× of SPTAN1, exon 10× of TEK, exon 15× of TEK, exon 1× of TOPORS, exon 11× of TSC2, exon 30× of TSC2, exon 1× of UBE3A, or exon 7× of VCAN.

Embodiment A25. The method of any one of embodiments A1 to A24, wherein the target protein produced is full-length protein, or wild-type protein.

Embodiment A26. The method of any one of embodiments A1 to A25, wherein the total amount of the mRNA encoding the target protein or functional RNA produced in the cell contacted with the antisense oligomer is increased about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold, compared to the total amount of the mRNA encoding the target protein or functional RNA produced in a control cell.

Embodiment A27. The method of any one of embodiments A1 to A25, wherein the total amount of the mRNA encoding the target protein or functional RNA produced in the cell contacted with the antisense oligomer is increased about 20% to about 300%, about 50% to about 300%, about 100% to about 300%, about 150% to about 300%, about 20% to about 50%, about 20% to about 100%, about 20% to about 150%, about 20% to about 200%, about 20% to about 250%, about 50% to about 100%, about 50% to about 150%, about 50% to about 200%, about 50% to about 250%, about 100% to about 150%, about 100% to about 200%, about 100% to about 250%, about 150% to about 200%, about 150% to about 250%, about 200% to about 250%, at least about 10%, at least about 20%, at least about 50%, at least about 100%, at least about 150%, at least about 200%, at least about 250%, or at least about 300%, compared to the total amount of the mRNA encoding the target protein or functional RNA produced in a control cell.

Embodiment A28. The method of one any of embodiments A1 to A25, wherein the total amount of target protein produced by the cell contacted with the antisense oligomer is increased about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold, compared to the total amount of target protein produced by a control cell.

Embodiment A29. The method of one any of embodiments A1 to A25, wherein the total amount of target protein produced by the cell contacted with the antisense oligomer is increased about 20% to about 300%, about 50% to about 300%, about 100% to about 300%, about 150% to about 300%, about 20% to about 50%, about 20% to about 100%, about 20% to about 150%, about 20% to about 200%, about 20% to about 250%, about 50% to about 100%, about 50% to about 150%, about 50% to about 200%, about 50% to about 250%, about 100% to about 150%, about 100% to about 200%, about 100% to about 250%, about 150% to about 200%, about 150% to about 250%, about 200% to about 250%, at least about 10%, at least about 20%, at least about 50%, at least about 100%, at least about 150%, at least about 200%, at least about 250%, or at least about 300%, compared to the total amount of target protein produced by a control cell.

Embodiment A30. The method of any one of embodiments A1 to 29, wherein the agent is an antisense oligomer (ASO) and wherein the antisense oligomer comprises a backbone modification comprising a phosphorothioate linkage or a phosphorodiamidate linkage.

Embodiment A31. The method of any one of embodiments A1 to A30, wherein the agent is an antisense oligomer (ASO) and wherein the antisense oligomer comprises a phosphorodiamidate morpholino, a locked nucleic acid, a peptide nucleic acid, a 2'-O-methyl, a 2'-Fluoro, or a 2'-O-methoxyethyl moiety.

Embodiment A32. The method of any one of embodiments A1 to A31, wherein the agent is an antisense oligomer (ASO) and wherein the antisense oligomer comprises at least one modified sugar moiety.

Embodiment A33. The method of embodiment A32, wherein each sugar moiety is a modified sugar moiety.

Embodiment A34. The method of any one of embodiments A1 to A33, wherein the agent is an antisense oligomer (ASO) and wherein the antisense oligomer consists of from 8 to 50 nucleobases, 8 to 40 nucleobases, 8 to 35 nucleobases, 8 to 30 nucleobases, 8 to 25 nucleobases, 8 to 20 nucleobases, 8 to 15 nucleobases, 9 to 50 nucleobases, 9 to 40 nucleobases, 9 to 35 nucleobases, 9 to 30 nucleobases, 9 to 25 nucleobases, 9 to 20 nucleobases, 9 to 15 nucleobases, 10 to 50 nucleobases, 10 to 40 nucleobases, 10 to 35 nucleobases, 10 to 30 nucleobases, 10 to 25 nucleobases, 10 to 20 nucleobases, 10 to 15 nucleobases, 11 to 50 nucleobases, 11 to 40 nucleobases, 11 to 35 nucleobases, 11 to 30 nucleobases, 11 to 25 nucleobases, 11 to 20 nucleobases, 11 to 15 nucleobases, 12 to 50 nucleobases, 12 to 40 nucleobases, 12 to 35 nucleobases, 12 to 30 nucleobases, 12 to 25 nucleobases, 12 to 20 nucleobases, or 12 to 15 nucleobases.

Embodiment A35. The method of any one of embodiments A1 to A34, wherein the agent is an antisense oligomer (ASO) and wherein the antisense oligomer is at least 80%, at least 85%, at least 90%, at least 95%, at least 98%, at least 99%, or 100%, complementary to the targeted portion of the NMD exon mRNA encoding the protein.

Embodiment A36. The method of any one of embodiments A1 to A35, wherein the method further comprises assessing ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, or VCAN mRNA or protein expression.

Embodiment A37. The method of any one of embodiments A1 to A36, wherein Alport syndrome; Amyotrophic lateral sclerosis (ALS); Angelman syndrome; Aphasia, primary progressive; Arrhythmogenic right ventricular dysplasia 9; Autism spectrum disorder; Cardiomyopathy, dilated, 1HH; Myopathy, myofibrillar 6; Ceriod lipofuscinosis, neuronal, 3; Cholestasis, intrahepatic, of pregnancy, 3; Cholestasis, progressive familial intrahepatic 1; Citrullinemia Type II; Citrullinemia, Type 1; Cognitive impairment with or without cerebral ataxia; Cornelia de Lange; Early-onset epileptic encephalopathy; Epilepsy-aphasia spectrum; Epilepsy, generalized, with febrile seizures plus, type 7; Epileptic encephalopathy, childhood-onset; Epileptic encephalopathy, early infantile, 11; Epileptic encephalopathy, early infantile, 12; Epileptic encephalopathy, early infantile, 13; Epileptic encephalopathy, early infantile, 2; Episodic ataxia, type 2; Familial focal epilepsy; Febrile seizures, familial, 3B; Friedreich ataxia; Friedreich ataxia with retained reflexes; Galactose epimerase deficiency; Glaucoma 3, primary congenital, E; Glycogen storage disease IV; GRN-related frontotemporal dementia; Homocystinuria, B6-responsive and nonresponsive types; HSAN2D, autosomal recessive; Insensitivity to pain, congenital; Kabuki syndrome; Koolen-De Vries syndrome; Mental retardation, autosomal dominant 1; Methyl malonic aciduria; Migraine, Myoclonic-atonic epilepsy; familial hemiplegic, 1; Neurofibromatosis type 1; Opioid addiction; Optic atrophy type 1; Pathway (eye); Pathway (central nervous system, epilepsy); Phelan-McDermid syndrome; Propionicacidemia; Primary open angle glaucoma; Propionic academia; Retinitis pigmentosa 11; Retinitis pigmentosa 18; Retinitis pigmentosa 31; Retinitis pigmentosa 59; Rett syndrome; Seizures, benign familial infantile, 3; Seizures, benign familial infantile, 5; Smith-Magenis syndrome; Sotos syndrome 1; Beckwith-Wiedemann syndrome; Stargardt disease 3; Tay-Sachs disease; Tuberous sclerosis; Tyrosinemia, type I; Wagner syndrome 1; West syndrome; Wolfram syndrome 2/NAFLD; 15q13.3 microdeletion; or 16p11.2 deletion syndrome is treated and wherein the antisense oligomer binds to a targeted portion of a ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, or VCAN NMD exon mRNA, wherein the targeted portion is within a sequence selected from SEQ ID NOs: 60-134.

Embodiment A38. The method of any one of embodiments A1 to A37, wherein the subject is a human.

Embodiment A39. The method of any one of embodiments A1 to A38, wherein the subject is a non-human animal.

Embodiment A40. The method of any one of embodiments A1 to A39, wherein the subject is a fetus, an embryo, or a child.

Embodiment A41. The method of any one of embodiments A1 to A40, wherein the cells are ex vivo.

Embodiment A42. The method of any one of embodiments A1 to A41, wherein the therapeutic agent is administered by intrathecal injection, intracerebroventricular injection, intraperitoneal injection, intramuscular injection, subcutaneous injection, or intravenous injection of the subject.

Embodiment A43. The method of any of embodiments A1 to A42, wherein the method further comprises administering a second therapeutic agent to the subject.

Embodiment A44. The method of embodiment A43, wherein the second therapeutic agent is a small molecule.

Embodiment A45. The method of embodiment A43, wherein the second therapeutic agent is an ASO.

Embodiment A46. The method of any one of embodiments A43 to A45, wherein the second therapeutic agent corrects intron retention.

Embodiment A47. An antisense oligomer as used in a method of any of embodiments A1 to A46.

Embodiment A48. An antisense oligomer comprising a sequence with at least about 80%, 85%, 90%, 95%, 97%, or 100% sequence identity to a region comprising at least 8 contiguous nucleic acids of SEQ ID NOs: 60-134.

Embodiment A49. A pharmaceutical composition comprising the antisense oligomer of embodiment A47 or A48 and an excipient.

Embodiment A50. A method of treating a subject in need thereof, comprising administering the pharmaceutical composition of embodiment A49 to the subject, wherein the administering is by intrathecal injection, intracerebroventricular injection, intraperitoneal injection, intramuscular injection, subcutaneous injection, or intravenous injection.

Embodiment A51. A composition comprising a therapeutic agent for use in a method of increasing expression of a target protein or a functional RNA by cells to treat Alport syndrome; Amyotrophic lateral sclerosis (ALS); Angelman syndrome; Aphasia, primary progressive; Arrhythmogenic right ventricular dysplasia 9; Autism spectrum disorder; Cardiomyopathy, dilated, 1HH; Myopathy, myofibrillar 6; Ceriod lipofuscinosis, neuronal, 3; Cholestasis, intrahepatic, of pregnancy, 3; Cholestasis, progressive familial intrahepatic 1; Citrullinemia Type II; Citrullinemia, Type 1; Cognitive impairment with or without cerebral ataxia; Cornelia de Lange; Early-onset epileptic encephalopathy; Epilepsy-aphasia spectrum; Epilepsy, generalized, with febrile seizures plus, type 7; Epileptic encephalopathy, childhood-onset; Epileptic encephalopathy, early infantile, 11; Epileptic encephalopathy, early infantile, 12; Epileptic encephalopathy, early infantile, 13; Epileptic encephalopathy, early infantile, 2; Episodic ataxia, type 2; Familial focal epilepsy; Febrile seizures, familial, 3B; Friedreich ataxia; Friedreich ataxia with retained reflexes; Galactose epimerase deficiency; Glaucoma 3, primary congenital, E; Glycogen storage disease IV; GRN-related frontotemporal dementia; Homocystinuria, B6-responsive and nonresponsive types; HSAN2D, autosomal recessive; Insensitivity to pain, congenital; Kabuki syndrome; Koolen-De Vries syndrome; Mental retardation, autosomal dominant 1; Methyl malonic aciduria; Migraine, Myoclonic-atonic epilepsy; familial hemiplegic, 1; Neurofibromatosis type 1; Opioid addiction; Optic atrophy type 1; Pathway (eye); Pathway (central nervous system, epilepsy); Phelan-McDermid syndrome; Propionicacidemia; Primary open angle glaucoma; Propionic academia; Retinitis pigmentosa 11; Retinitis pigmentosa 18; Retinitis pigmentosa 31; Retinitis pigmentosa 59; Rett syndrome; Seizures, benign familial infantile, 3; Seizures, benign familial infantile, 5; Smith-Magenis syndrome; Sotos syndrome 1; Beckwith-Wiedemann syndrome; Stargardt disease 3; Tay-Sachs disease; Tuberous sclerosis; Tyrosinemia, type I; Wagner syndrome 1; West syndrome; Wolfram syndrome 2/NAFLD; 15q13.3 microdeletion; or 16p11.2 deletion syndrome in a subject in need thereof, associated with a deficient protein or deficient functional RNA, wherein the deficient protein or deficient functional RNA is deficient in amount or activity in the subject, wherein the target protein is:

(a) the deficient protein; or (b) a compensating protein which functionally augments or replaces the deficient protein or in the subject;

and wherein the functional RNA is:

(c) the deficient RNA; or (d) a compensating functional RNA which functionally augments or replaces the deficient functional RNA in the subject;

wherein the therapeutic agent enhances exclusion of the non-sense mediated RNA decay-inducing exon from the NMD exon mRNA encoding the target protein or functional RNA, thereby increasing production or activity of the target protein or the functional RNA in the subject.

Embodiment A52. A composition comprising a therapeutic agent for use in a method of treating a condition associated with ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, or VCAN protein in a subject in need thereof, the method comprising the step of increasing expression of ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, or VCAN protein by cells of the subject, wherein the cells have an mRNA that contains a non-sense mediated RNA decay-inducing exon (NMD exon mRNA) and encodes ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, or VCAN protein, the method comprising contacting the cells with the therapeutic agent, whereby the non-sense mediated RNA decay-inducing exon is excluded from the NMD exon mRNA that encodes ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, or VCAN protein, thereby increasing the level of mRNA encoding ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, or VCAN protein, and increasing the expression of ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, or VCAN protein in the cells of the subject.

Embodiment A53. The composition of embodiment A52, wherein the condition is a disease or disorder.

Embodiment A54. The composition of embodiment A53, wherein the disease or disorder is Alport syndrome; Amyotrophic lateral sclerosis (ALS); Angelman syndrome; Aphasia, primary progressive; Arrhythmogenic right ventricular dysplasia 9; Autism spectrum disorder; Cardiomyopathy, dilated, 1HH; Myopathy, myofibrillar 6; Ceriod lipofuscinosis, neuronal, 3; Cholestasis, intrahepatic, of pregnancy, 3; Cholestasis, progressive familial intrahepatic 1; Citrullinemia Type II; Citrullinemia, Type 1; Cognitive impairment with or without cerebral ataxia; Cornelia de Lange; Early-onset epileptic encephalopathy; Epilepsy-aphasia spectrum; Epilepsy, generalized, with febrile seizures plus, type 7; Epileptic encephalopathy, childhood-onset; Epileptic encephalopathy, early infantile, 11; Epileptic encephalopathy, early infantile, 12; Epileptic encephalopathy, early infantile, 13; Epileptic encephalopathy, early infantile, 2; Episodic ataxia, type 2; Familial focal epilepsy; Febrile seizures, familial, 3B; Friedreich ataxia; Friedreich ataxia with retained reflexes; Galactose epimerase deficiency; Glaucoma 3, primary congenital, E; Glycogen storage disease IV; GRN-related frontotemporal dementia; Homocystinuria, B6-responsive and nonresponsive types; HSAN2D, autosomal recessive; Insensitivity to pain, congenital; Kabuki syndrome; Koolen-De Vries syndrome; Mental retardation, autosomal dominant 1; Methyl malonic aciduria; Migraine, Myoclonic-atonic epilepsy; familial hemiplegic, 1; Neurofibromatosis type 1; Opioid addiction; Optic atrophy type 1; Pathway (eye); Pathway (central nervous system, epilepsy); Phelan-McDermid syndrome; Propionicacidemia; Primary open angle glaucoma; Propionic academia; Retinitis pigmentosa 11; Retinitis pigmentosa 18; Retinitis pigmentosa 31; Retinitis pigmentosa 59; Rett syndrome; Seizures, benign familial infantile, 3; Seizures, benign familial infantile, 5; Smith-Magenis syndrome; Sotos syndrome 1; Beckwith-Wiedemann syndrome; Stargardt disease 3; Tay-Sachs disease; Tuberous sclerosis; Tyrosinemia, type I; Wagner syndrome 1; West syndrome; Wolfram syndrome 2/NAFLD; 15q13.3 microdeletion; or 16p11.2 deletion syndrome.

Embodiment A55. The composition of any one of embodiments A52 to 54, wherein the ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, or VCAN protein and NMD exon mRNA are encoded by the ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, or VCAN gene.

Embodiment A56. The composition of any one of embodiments A51 to A55, wherein the non-sense mediated RNA decay-inducing exon is spliced out from the NMD exon mRNA encoding the ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, or VCAN protein.

Embodiment A57. The composition of any one of embodiments A51 to A56, wherein the ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, or VCAN protein does not comprise an amino acid sequence encoded by the non-sense mediated RNA decay-inducing exon.

Embodiment A58. The composition of any one of embodiments A51 to A57, wherein the ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, or VCAN protein is a full-length ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, or VCAN protein.

Embodiment A59. The composition of any one of embodiments A51 to A58, wherein the therapeutic agent is an antisense oligomer (ASO) complementary to the targeted portion of the NMD exon mRNA.

Embodiment A60. The composition of any of embodiments A51 to A59, wherein the therapeutic agent is an antisense oligomer (ASO) and wherein the antisense oligomer targets a portion of the NMD exon mRNA that is within the non-sense mediated RNA decay-inducing exon.

Embodiment A61. The composition of any of embodiments A51 to A59, wherein the therapeutic agent is an antisense oligomer (ASO) and wherein the antisense oligomer targets a portion of the NMD exon mRNA that is upstream or downstream of the non-sense mediated RNA decay-inducing exon.

Embodiment A62. The composition of any one of embodiments A51 to A61, wherein the target protein is ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, or VCAN.

Embodiment A63. The composition of embodiment A62, wherein the NMD exon mRNA comprises a sequence with at least about 80%, 85%, 90%, 95%, 97%, or 100% sequence identity to any one of SEQ ID NOs: 60-134.

Embodiment A64. The composition of embodiment A62, wherein the NMD exon mRNA is encoded by a genetic sequence with at least about 80%, 85%, 90%, 95%, 97%, or 100% sequence identity to SEQ ID NO: 1-59.

Embodiment A65. The composition of embodiment A62, wherein the targeted portion of the NMD exon mRNA comprises a sequence with at least 80%, 85%, 90%, 95%, 97%, or 100% sequence identity to a region comprising at least 8 contiguous nucleic acids of SEQ ID NO: 60-134.

Embodiment A66. The composition of any one of embodiments A62 to A65, wherein the targeted portion of the NMD exon mRNA is within the non-sense mediated RNA decay-inducing exon 8× of ABCB4, exon 9× of ASS1, exon 16× of ATP8B1, exon 1× of BAG3, exon 31× of CACNA1A, exon 36× of CACNA1A, exon 37× of CACNA1A, exon 3× of CBS, exon 12× of CBS, exon 1× of CD55, exon 16× of CDKL5, exon 3× of CFH, exon 30× of CHD2, exon 4× of CHRNA7, exon 1× of CISD2, exon 15× of CLN3, exon 11× of COL4A3, exon 41× of COL4A3, exon 22× of COL4A4, exon 44× of COL4A4, exon 20× of DEPDC5, exon 2× of DHDDS, exon 3× of ELOVL4, exon 5× of FAH, exon 4× of FXN, exon 4× of GALE, exon 3× of GBE1, exon 11× of GRIN2A, exon 1× of GRN, exon 2× of HEXA, exon 2× of KANSL1, exon 1× of KCNQ2, exon 50× of KMT2D, exon 8× of MAPK3, exon 13× of MBD5, exon 2× of MECP2, exon 11× of MUT, exon 31× of NF1, exon 7× of NIPBL, exon 38× of NIPBL, exon 11× of NSD1, exon 6× of OPA1, exon 28× of OPA1, exon 1× of OPTN, exon 1× of PCCA, exon 5× of PCCB, exon 6× of PCCB, exon 4× of PKP2, exon 23× of PLCB1, exon 3× of PRPF3, exon 9× of PRPF31, exon 1× of RAI1, exon 5× of RBFOX2, exon 13× of SCN2A, exon 6× of SCN3A, exon 7× of SCN3A, exon 4× of SCN8A, exon 6× of SCN8A, exon 20× of SCN8A, exon 6× of SCN9A, exon 24× of SHANK3, exon 3× of SLC25A13, exon 6× of SLC25A13, exon 9× of SLC25A13, exon 11× of SLC25A13, exon 13× of SLC25A13, exon 1× of SLC6A1, exon 12× of SPTAN1, exon 10× of TEK, exon 15× of TEK, exon 1× of TOPORS, exon 11× of TSC2, exon 30× of TSC2, exon 1× of UBE3A, or exon 7× of VCAN.

Embodiment A67. The composition of any one of embodiments A62 to A65, wherein the targeted portion of the NMD exon mRNA is upstream or downstream of the non-sense mediated RNA decay-inducing exon 8× of ABCB4, exon 9× of ASS1, exon 16× of ATP8B1, exon 1× of BAG3, exon 31× of CACNA1A, exon 36× of CACNA1A, exon 37× of CACNA1A, exon 3× of CBS, exon 12× of CBS, exon 1× of CD55, exon 16× of CDKL5, exon 3× of CFH, exon 30× of CHD2, exon 4× of CHRNA7, exon 1× of CISD2, exon 15× of CLN3, exon 11× of COL4A3, exon 41× of COL4A3, exon 22× of COL4A4, exon 44× of COL4A4, exon 20× of DEPDC5, exon 2× of DHDDS, exon 3× of ELOVL4, exon 5× of FAH, exon 4× of FXN, exon 4× of GALE, exon 3× of GBE1, exon 11× of GRIN2A, exon 1× of GRN, exon 2× of HEXA, exon 2× of KANSL1, exon 1× of KCNQ2, exon 50× of KMT2D, exon 8× of MAPK3, exon 13× of MBD5, exon 2× of MECP2, exon 11× of MUT, exon 31× of NF1, exon 7× of NIPBL, exon 38× of NIPBL, exon 11× of NSD1, exon 6× of OPA1, exon 28× of OPA1, exon 1× of OPTN, exon 1× of PCCA, exon 5× of PCCB, exon 6× of PCCB, exon 4× of PKP2, exon 23× of PLCB1, exon 3× of PRPF3, exon 9× of PRPF31, exon 1× of RAI1, exon 5× of RBFOX2, exon 13× of SCN2A, exon 6× of SCN3A, exon 7× of SCN3A, exon 4× of SCN8A, exon 6× of SCN8A, exon 20× of SCN8A, exon 6× of SCN9A, exon 24× of SHANK3, exon 3× of SLC25A13, exon 6× of SLC25A13, exon 9× of SLC25A13, exon 11× of SLC25A13, exon 13× of SLC25A13, exon 1× of SLC6A1, exon 12× of SPTAN1, exon 10× of TEK, exon 15× of TEK, exon 1× of TOPORS, exon 11× of TSC2, exon 30× of TSC2, exon 1× of UBE3A, or exon 7× of VCAN.

Embodiment A68. The composition of any one of embodiments A62 to A65, wherein the targeted portion of the NMD exon mRNA comprises an exon-intron junction of exon 8× of ABCB4, exon 9× of ASS1, exon 16× of ATP8B1, exon 1× of BAG3, exon 31× of CACNA1A, exon 36× of CACNA1A, exon 37× of CACNA1A, exon 3× of CBS, exon 12× of CBS, exon 1× of CD55, exon 16× of CDKL5, exon 3× of CFH, exon 30× of CHD2, exon 4× of CHRNA7, exon 1× of CISD2, exon 15× of CLN3, exon 11× of COL4A3, exon 41× of COL4A3, exon 22× of COL4A4, exon 44× of COL4A4, exon 20× of DEPDC5, exon 2× of DHDDS, exon 3× of ELOVL4, exon 5× of FAH, exon 4× of FXN, exon 4× of GALE, exon 3× of GBE1, exon 11× of GRIN2A, exon 1× of GRN, exon 2× of HEXA, exon 2× of KANSL1, exon 1× of KCNQ2, exon 50× of KMT2D, exon 8× of MAPK3, exon 13× of MBD5, exon 2× of MECP2, exon 11× of MUT, exon 31× of NF1, exon 7× of NIPBL, exon 38× of NIPBL, exon 11× of NSD1, exon 6× of OPA1, exon 28× of OPA1, exon 1× of OPTN, exon 1× of PCCA, exon 5× of PCCB, exon 6× of PCCB, exon 4× of PKP2, exon 23× of PLCB1, exon 3× of PRPF3, exon 9× of PRPF31, exon 1× of RAI1, exon 5× of RBFOX2, exon 13× of SCN2A, exon 6× of SCN3A, exon 7× of SCN3A, exon 4× of SCN8A, exon 6× of SCN8A, exon 20× of SCN8A, exon 6× of SCN9A, exon 24× of SHANK3, exon 3× of SLC25A13, exon 6× of SLC25A13, exon 9× of SLC25A13, exon 11× of SLC25A13, exon 13× of SLC25A13, exon 1× of SLC6A1, exon 12× of SPTAN1, exon 10× of TEK, exon 15× of TEK, exon 1× of TOPORS, exon 11× of TSC2, exon 30× of TSC2, exon 1× of UBE3A, or exon 7× of VCAN.

Embodiment A69. The composition of any one of embodiments A62 to A68, wherein the therapeutic agent is an antisense oligomer (ASO) and wherein the ASO comprises a sequence that is at least about 80%, 85%, 90%, 95%, 97%, or 100% complementary to a region comprising at least 8 contiguous nucleic acids of SEQ ID NOs: 60-134.

Embodiment A70. The composition of any one of embodiments A51 to A69, wherein the mRNA encoding the target protein or functional RNA is a full-length mature mRNA, or a wild-type mature mRNA.

Embodiment A71. The composition of any one of embodiments A51 to A70, wherein the target protein produced is full-length protein, or wild-type protein.

Embodiment A72. The composition of any one of embodiments A51 to A71, wherein the therapeutic agent is an antisense oligomer (ASO) and wherein the antisense oligomer comprises a backbone modification comprising a phosphorothioate linkage or a phosphorodiamidate linkage.

Embodiment A73. The composition of any of embodiments A51 to A72, wherein the therapeutic agent is an antisense oligomer (ASO) and wherein said antisense oligomer is an antisense oligonucleotide.

Embodiment A74. The composition of any of embodiments A51 to A73, wherein the therapeutic agent is an antisense oligomer (ASO) and wherein the antisense oligomer comprises a phosphorodiamidate morpholino, a locked nucleic acid, a peptide nucleic acid, a 2'-O-methyl, a 2'-Fluoro, or a 2'-O-methoxyethyl moiety.

Embodiment A75. The composition of any of embodiments A51 to A74, wherein the therapeutic agent is an antisense oligomer (ASO) and wherein the antisense oligomer comprises at least one modified sugar moiety.

Embodiment A76. The composition of embodiment A75, wherein each sugar moiety is a modified sugar moiety.

Embodiment A77. The composition of any of embodiments A51 to A76, wherein the therapeutic agent is an antisense oligomer (ASO) and wherein the antisense oligomer consists of from 8 to 50 nucleobases, 8 to 40 nucleobases, 8 to 35 nucleobases, 8 to 30 nucleobases, 8 to 25 nucleobases, 8 to 20 nucleobases, 8 to 15 nucleobases, 9 to 50 nucleobases, 9 to 40 nucleobases, 9 to 35 nucleobases, 9 to 30 nucleobases, 9 to 25 nucleobases, 9 to 20 nucleobases, 9 to 15 nucleobases, 10 to 50 nucleobases, 10 to 40 nucleobases, 10 to 35 nucleobases, 10 to 30 nucleobases, 10 to 25 nucleobases, 10 to 20 nucleobases, 10 to 15 nucleobases, 11 to 50 nucleobases, 11 to 40 nucleobases, 11 to 35 nucleobases, 11 to 30 nucleobases, 11 to 25 nucleobases, 11 to 20 nucleobases, 11 to 15 nucleobases, 12 to 50 nucleobases, 12 to 40 nucleobases, 12 to 35 nucleobases, 12 to 30 nucleobases, 12 to 25 nucleobases, 12 to 20 nucleobases, or 12 to 15 nucleobases.

Embodiment A78. A pharmaceutical composition comprising the therapeutic agent of any of the compositions of embodiments A51 to A77, and an excipient.

Embodiment A79. A method of treating a subject in need thereof, comprising administering the pharmaceutical composition of embodiment A78 to the subject, wherein the administering is by intrathecal injection, intracerebroventricular injection, intraperitoneal injection, intramuscular injection, subcutaneous injection, or intravenous injection.

Embodiment A80. The method of any of embodiments A51 to A79, wherein the method further comprises administering a second therapeutic agent to the subject.

Embodiment A81. The method of embodiment A80, wherein the second therapeutic agent is a small molecule.

Embodiment A82. The method of embodiment A80, wherein the second therapeutic agent is an ASO.

Embodiment A83. The method of any one of embodiments A80 to A82, wherein the second therapeutic agent corrects intron retention.

Embodiment A84. A pharmaceutical composition comprising: an antisense oligomer that hybridizes to a target sequence of a ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, or VCANmRNA transcript, wherein the ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, or VCAN mRNA transcript comprises a non-sense mediated RNA decay-inducing exon, wherein the antisense oligomer induces exclusion of the non-sense mediated RNA decay-inducing exon from the ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, or VCAN mRNA transcript; and a pharmaceutical acceptable excipient.

Embodiment A85. The pharmaceutical composition of embodiment A84, wherein the ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, or VCAN mRNA transcript is a ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, or VCAN NMD exon mRNA transcript.

Embodiment A86. The pharmaceutical composition of embodiment A84 or A85, wherein the targeted portion of the NMD exon mRNA is within the non-sense mediated RNA decay-inducing exon 8× of ABCB4, exon 9× of ASS1, exon 16× of ATP8B1, exon 1× of BAG3, exon 31× of CACNA1A, exon 36× of CACNA1A, exon 37× of CACNA1A, exon 3× of CBS, exon 12× of CBS, exon 1× of CD55, exon 16× of CDKL5, exon 3× of CFH, exon 30× of CHD2, exon 4× of CHRNA7, exon 1× of CISD2, exon 15× of CLN3, exon 11× of COL4A3, exon 41× of COL4A3, exon 22× of COL4A4, exon 44× of COL4A4, exon 20× of DEPDC5, exon 2× of DHDDS, exon 3× of ELOVL4, exon 5× of FAH, exon 4× of FXN, exon 4× of GALE, exon 3× of GBE1, exon 11× of GRIN2A, exon 1× of GRN, exon 2× of HEXA, exon 2× of KANSL1, exon 1× of KCNQ2, exon 50× of KMT2D, exon 8× of MAPK3, exon 13× of MBD5, exon 2× of MECP2, exon 11× of MUT, exon 31× of NF1, exon 7× of NIPBL, exon 38× of NIPBL, exon 11× of NSD1, exon 6× of OPA1, exon 28× of OPA1, exon 1× of OPTN, exon 1× of PCCA, exon 5× of PCCB, exon 6× of PCCB, exon 4× of PKP2, exon 23× of PLCB1, exon 3× of PRPF3, exon 9× of PRPF31, exon 1× of RAI1, exon 5× of RBFOX2, exon 13× of SCN2A, exon 6× of SCN3A, exon 7× of SCN3A, exon 4× of SCN8A, exon 6× of SCN8A, exon 20× of SCN8A, exon 6× of SCN9A, exon 24× of SHANK3, exon 3× of SLC25A13, exon 6× of SLC25A13, exon 9× of SLC25A13, exon 11× of SLC25A13, exon 13× of SLC25A13, exon 1× of SLC6A1, exon 12× of SPTAN1, exon 10× of TEK, exon 15× of TEK, exon 1× of TOPORS, exon 11× of TSC2, exon 30× of TSC2, exon 1× of UBE3A, or exon 7× of VCAN.

Embodiment A87. The pharmaceutical composition of embodiment A84 or A85, wherein the targeted portion of the NMD exon mRNA is upstream or downstream of the non-sense mediated RNA decay-inducing exon 8× of ABCB4, exon 9× of ASS1, exon 16× of ATP8B1, exon 1× of BAG3, exon 31× of CACNA1A, exon 36× of CACNA1A, exon 37× of CACNA1A, exon 3× of CBS, exon 12× of CBS, exon 1× of CD55, exon 16× of CDKL5, exon 3× of CFH, exon 30× of CHD2, exon 4× of CHRNA7, exon 1× of CISD2, exon 15× of CLN3, exon 11× of COL4A3, exon 41× of COL4A3, exon 22× of COL4A4, exon 44× of COL4A4, exon 20× of DEPDC5, exon 2× of DHDDS, exon 3× of ELOVL4, exon 5× of FAH, exon 4× of FXN, exon 4× of GALE, exon 3× of GBE1, exon 11× of GRIN2A, exon 1× of GRN, exon 2× of HEXA, exon 2× of KANSL1, exon 1× of KCNQ2, exon 50× of KMT2D, exon 8× of MAPK3, exon 13× of MBD5, exon 2× of MECP2, exon 11× of MUT, exon 31× of NF1, exon 7× of NIPBL, exon 38× of NIPBL, exon 11× of NSD1, exon 6× of OPA1, exon 28× of OPA1, exon 1× of OPTN, exon 1× of PCCA, exon 5× of PCCB, exon 6× of PCCB, exon 4× of PKP2, exon 23× of PLCB1, exon 3× of PRPF3, exon 9× of PRPF31, exon 1× of RAI1, exon 5× of RBFOX2, exon 13× of SCN2A, exon 6× of SCN3A, exon 7× of SCN3A, exon 4× of SCN8A, exon 6× of SCN8A, exon 20× of SCN8A, exon 6× of SCN9A, exon 24× of SHANK3, exon 3× of SLC25A13, exon 6× of SLC25A13, exon 9× of SLC25A13, exon 11× of SLC25A13, exon 13× of SLC25A13, exon 1× of SLC6A1, exon 12× of SPTAN1, exon 10× of TEK, exon 15× of TEK, exon 1× of TOPORS, exon 11× of TSC2, exon 30× of TSC2, exon 1× of UBE3A, or exon 7× of VCAN.

Embodiment A88. The pharmaceutical composition of embodiment A84 or A85, wherein the targeted portion of the NMD exon mRNA comprises an exon-intron junction exon 8× of ABCB4, exon 9× of ASS1, exon 16× of ATP8B1, exon 1× of BAG3, exon 31× of CACNA1A, exon 36× of CACNA1A, exon 37× of CACNA1A, exon 3× of CBS, exon 12× of CBS, exon 1× of CD55, exon 16× of CDKL5, exon 3× of CFH, exon 30× of CHD2, exon 4× of CHRNA7, exon 1× of CISD2, exon 15× of CLN3, exon 11× of COL4A3, exon 41× of COL4A3, exon 22× of COL4A4, exon 44× of COL4A4, exon 20× of DEPDC5, exon 2× of DHDDS, exon 3× of ELOVL4, exon 5× of FAH, exon 4× of FXN, exon 4× of GALE, exon 3× of GBE1, exon 11× of GRIN2A, exon 1× of GRN, exon 2× of HEXA, exon 2× of KANSL1, exon 1× of KCNQ2, exon 50× of KMT2D, exon 8× of MAPK3, exon 13× of MBD5, exon 2× of MECP2, exon 11× of MUT, exon 31× of NF1, exon 7× of NIPBL, exon 38× of NIPBL, exon 11× of NSD1, exon 6× of OPA1, exon 28× of OPA1, exon 1× of OPTN, exon 1× of PCCA, exon 5× of PCCB, exon 6× of PCCB, exon 4× of PKP2, exon 23× of PLCB1, exon 3× of PRPF3, exon 9× of PRPF31, exon 1× of RAI1, exon 5× of RBFOX2, exon 13× of SCN2A, exon 6× of SCN3A, exon 7× of SCN3A, exon 4× of SCN8A, exon 6× of SCN8A, exon 20× of SCN8A, exon 6× of SCN9A, exon 24× of SHANK3, exon 3× of SLC25A13, exon 6× of SLC25A13, exon 9× of SLC25A13, exon 11× of SLC25A13, exon 13× of SLC25A13, exon 1× of SLC6A1, exon 12× of SPTAN1, exon 10× of TEK, exon 15× of TEK, exon 1× of TOPORS, exon 11× of TSC2, exon 30× of TSC2, exon 1× of UBE3A, or exon 7× of VCAN.

Embodiment A89. The pharmaceutical composition of any one of embodiments A84 to A88, wherein the ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, or VCAN NMD exon mRNA transcript is encoded by a genetic sequence with at least about 80%, 85%, 90%, 95%, 96%, 97%, 98%, 99% or 100% sequence identity to any one of SEQ ID NOs: 1-59.

Embodiment A90. The pharmaceutical composition of embodiment A84 or A88, wherein the ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, or VCAN NMD exon mRNA transcript comprises a sequence with at least about 80%, 85%, 90%, 95%, 96%, 97%, 98%, 99% or 100% sequence identity to any one of SEQ ID NOs: 60-134.

Embodiment A91. The pharmaceutical composition of embodiment A84, wherein the antisense oligomer comprises a backbone modification comprising a phosphorothioate linkage or a phosphorodiamidate linkage.

Embodiment A92. The pharmaceutical composition of embodiment A84, wherein the antisense oligomer is an antisense oligonucleotide.

Embodiment A93. The pharmaceutical composition of embodiment A84, wherein the antisense oligomer comprises a phosphorodiamidate morpholino, a locked nucleic acid, a peptide nucleic acid, a 2'-O-methyl, a 2'-Fluoro, or a 2'-O-methoxyethyl moiety.

Embodiment A94. The pharmaceutical composition of embodiment A84, wherein the antisense oligomer comprises at least one modified sugar moiety.

Embodiment A95. The pharmaceutical composition of embodiment A84, wherein the antisense oligomer comprises from 8 to 50 nucleobases, 8 to 40 nucleobases, 8 to 35 nucleobases, 8 to 30 nucleobases, 8 to 25 nucleobases, 8 to 20 nucleobases, 8 to 15 nucleobases, 9 to 50 nucleobases, 9 to 40 nucleobases, 9 to 35 nucleobases, 9 to 30 nucleobases, 9 to 25 nucleobases, 9 to 20 nucleobases, 9 to 15 nucleobases, 10 to 50 nucleobases, 10 to 40 nucleobases, 10 to 35 nucleobases, 10 to 30 nucleobases, 10 to 25 nucleobases, 10 to 20 nucleobases, 10 to 15 nucleobases, 11 to 50 nucleobases, 11 to 40 nucleobases, 11 to 35 nucleobases, 11 to 30 nucleobases, 11 to 25 nucleobases, 11 to 20 nucleobases, 11 to 15 nucleobases, 12 to 50 nucleobases, 12 to 40 nucleobases, 12 to 35 nucleobases, 12 to 30 nucleobases, 12 to 25 nucleobases, 12 to 20 nucleobases, or 12 to 15 nucleobases.

Embodiment A96. The pharmaceutical composition of embodiment A84 or A85, wherein the antisense oligomer is at least 80%, at least 85%, at least 90%, at least 95%, at least 98%, at least 99%, or is 100% complementary to a targeted portion of the ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, or VCAN NMD exon mRNA transcript.

Embodiment A97. The pharmaceutical composition of embodiment A84 or A85, wherein the targeted portion of the ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, or VCAN NMD exon mRNA transcript is within a sequence selected from SEQ ID NOs: 60-134.

Embodiment A98. The pharmaceutical composition of embodiment A84, wherein the antisense oligomer comprises a nucleotide sequence that is at least about 80%, 85%, 90%, 91%, 92%, 93%, 94%, 95%, 96%, 97%, 98%, or 99% sequence identity to a region comprising at least 8 contiguous nucleic acids of SEQ ID NOs: 60-134.

Embodiment A99. The pharmaceutical composition of embodiment A84, wherein the antisense oligomer comprises a nucleotide sequence that is identical a region comprising at least 8 contiguous nucleic acids of SEQ ID NOs: 60-134.

Embodiment A100. The pharmaceutical composition of any one of the embodiments A84 to A99, wherein the pharmaceutical composition is formulated for intrathecal injection, intracerebroventricular injection, intraperitoneal injection, intramuscular injection, subcutaneous injection, or intravenous injection.

Embodiment A101. The method of any of embodiments A84 to A100, wherein the method further comprises administering a second therapeutic agent to the subject.

Embodiment A102. The method of embodiment A101, wherein the second therapeutic agent is a small molecule.

Embodiment A103. The method of embodiment A101, wherein the second therapeutic agent is an ASO.

Embodiment A104. The method of any one of embodiments A101 to A103, wherein the second therapeutic agent corrects intron retention.

Embodiment A105. A method of inducing processing of a deficient ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, or VCAN mRNA transcript to facilitate removal of a non-sense mediated RNA decay-inducing exon to produce a fully processed ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, or VCAN mRNA transcript that encodes a functional form of a ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, or VCAN protein, the method comprising:

(a) contacting an antisense oligomer to a target cell of a subject;

(b) hybridizing the antisense oligomer to the deficient ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, or VCAN mRNA transcript, wherein the deficient ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, or VCAN mRNA transcript is capable of encoding the functional form of a ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, or VCAN protein and comprises at least one non-sense mediated RNA decay-inducing exon;

(c) removing the at least one non-sense mediated RNA decay-inducing exon from the deficient ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, or VCAN mRNA transcript to produce the fully processed ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, or VCAN mRNA transcript that encodes the functional form of ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, or VCAN protein; and (d) translating the functional form of ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, or VCAN protein from the fully processed ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, or VCAN mRNA transcript.

Embodiment A106. A method of treating a subject having a condition caused by a deficient amount or activity of ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, or VCAN protein comprising administering to the subject an antisense oligomer comprising a nucleotide sequence with at least about 80%, 85%, 90%, 91%, 92%, 93%, 94%, 95%, 96%, 97%, 98%, or 99% sequence identity to a region comprising at least 8 contiguous nucleic acids of SEQ ID NOs: 60-134.

Embodiment A107. A method of treating Alport syndrome; Amyotrophic lateral sclerosis (ALS); Angelman syndrome; Aphasia, primary progressive; Arrhythmogenic right ventricular dysplasia 9; Autism spectrum disorder; Cardiomyopathy, dilated, 1HH; Myopathy, myofibrillar 6; Ceriod lipofuscinosis, neuronal, 3; Cholestasis, intrahepatic, of pregnancy, 3; Cholestasis, progressive familial intrahepatic 1; Citrullinemia Type II; Citrullinemia, Type 1; Cognitive impairment with or without cerebral ataxia; Cornelia de Lange; Early-onset epileptic encephalopathy; Epilepsy-aphasia spectrum; Epilepsy, generalized, with febrile seizures plus, type 7; Epileptic encephalopathy, childhood-onset; Epileptic encephalopathy, early infantile, 11; Epileptic encephalopathy, early infantile, 12; Epileptic encephalopathy, early infantile, 13; Epileptic encephalopathy, early infantile, 2; Episodic ataxia, type 2; Familial focal epilepsy; Febrile seizures, familial, 3B; Friedreich ataxia; Friedreich ataxia with retained reflexes; Galactose epimerase deficiency; Glaucoma 3, primary congenital, E; Glycogen storage disease IV; GRN-related frontotemporal dementia; Homocystinuria, B6-responsive and nonresponsive types; HSAN2D, autosomal recessive; Insensitivity to pain, congenital; Kabuki syndrome; Koolen-De Vries syndrome; Mental retardation, autosomal dominant 1; Methyl malonic aciduria; Migraine, Myoclonic-atonic epilepsy; familial hemiplegic, 1; Neurofibromatosis type 1; Opioid addiction; Optic atrophy type 1; Pathway (eye); Pathway (central nervous system, epilepsy); Phelan-McDermid syndrome; Propionicacidemia; Primary open angle glaucoma; Propionic academia; Retinitis pigmentosa 11; Retinitis pigmentosa 18; Retinitis pigmentosa 31; Retinitis pigmentosa 59; Rett syndrome; Seizures, benign familial infantile, 3; Seizures, benign familial infantile, 5; Smith-Magenis syndrome; Sotos syndrome 1; Beckwith-Wiedemann syndrome; Stargardt disease 3; Tay-Sachs disease; Tuberous sclerosis; Tyrosinemia, type I; Wagner syndrome 1; West syndrome; Wolfram syndrome 2/NAFLD; 15q13.3 microdeletion; or 16p11.2 deletion syndrome in a subject in need thereof, by increasing the expression of a target protein or functional RNA by a cell of the subject, wherein the cell has an mRNA that contains a non-sense mediated RNA decay-inducing exon (NMD exon mRNA), and wherein the NMD exon mRNA encodes the target protein or functional RNA, the method comprising contacting the cell of the subject with a therapeutic agent that modulates splicing of the NMD exon mRNA encoding the target protein or functional RNA, whereby the non-sense mediated RNA decay-inducing exon is excluded from the NMD exon mRNA encoding the target protein or functional RNA, thereby increasing the level of mRNA encoding the target protein or functional RNA, and increasing the expression of the target protein or functional RNA in the cell of the subject.

Embodiment A108. A method of increasing expression of ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, or VCAN protein by a cell having an mRNA that contains a non-sense mediated RNA decay-inducing exon (NMD exon mRNA) and encodes ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, or VCAN protein, the method comprising contacting the cell with an agent that modulates splicing of the NMD exon mRNA encoding ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, or VCAN protein, whereby the non-sense mediated RNA decay-inducing exon is excluded from the NMD exon mRNA encoding ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, or VCAN protein, thereby increasing the level of mRNA encoding ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, or VCAN protein, and increasing the expression of ABCB4, ASS1, ATP8B1, BAG3, CACNA1A, CBS, CD55, CDKL5, CFH, CHD2, CHRNA7, CISD2, CLN3, COL4A3, COL4A4, DEPDC5, DHDDS, ELOVL4, FAH, FXN, GALE, GBE1, GRIN2A, GRN, HEXA, KANSL1, KCNQ2, KMT2D, MAPK3, MBD5, MECP2, MUT, NF1, NIPBL, NSD1, OPA1, OPTN, PCCA, PCCB, PKP2, PLCB1, PRPF3, PRPF31, RAI1, RBFOX2, SCN2A, SCN3A, SCN8A, SCN9A, SHANK3, SLC25A13, SLC6A1, SPTAN1, TEK, TOPORS, TSC2, UBE3A, or VCAN protein in the cell.

Embodiment A109. The method of embodiment A107 or A108, wherein the agent (a) binds to a targeted portion of the NMD exon mRNA encoding the target protein or functional RNA;

(b) binds to one or more components of a spliceosome; or (c) a combination of (a) and (b).

FURTHER SPECIFIC EMBODIMENTS

Embodiment 1. A method of modulating expression of a target protein, by a cell having an mRNA that comprises a non-sense mediated RNA decay-inducing exon (NMD exon) and encodes the target protein, the method comprising contacting a therapeutic agent to the cell, whereby the therapeutic agent modulates splicing of the NMD exon from the mRNA, thereby modulating level of processed mRNA encoding the target protein, and modulating the expression of the target protein in the cell, wherein the target protein is selected from the group consisting of: AKT3, CACNA1A, CBS, CD46, CFH, CHD2, CLN3, COL11A2, COL4A3, COL4A4, COL4A4, CR1, CRX, CYP2J2, DHDDS, DNAJC8, EIF2AK3, ERN1, GALE, GUCY2F, GUCY2F, HEXA, HEXA, MAPK3, MBD5, MBD5, MBD5, MUT, MYH14, MYO6, NF1, NF2, NIPBL, NR1H4, NSD1, NSD1, NSD1, NSD1, OPA1, OPA1, PCCA, PKP2, PPARA, PRPF3, PRPF3, SCN2A, SCN8A, SCN8A, SCN9A, SEMA3C, SEMA3D, SIRT3, STK11, STK11, SYNGAP1, TOPORS, and VCAN proteins.

Embodiment 2. A method of treating a disease or condition in a subject in need thereof by modulating expression of a target protein in a cell of the subject, comprising: contacting the cell of the subject with a therapeutic agent that modulates splicing of a non-sense mediated mRNA decay-inducing exon (NMD exon) from an mRNA in the cell, wherein the mRNA comprises the NMD exon and encodes the target protein, thereby modulating level of processed mRNA encoding the target protein, and modulating expression of the target protein in the cell of the subject, wherein the target protein is selected from the group consisting of: AKT3, CACNA1A, CBS, CD46, CFH, CHD2, CLN3, COL11A2, COL4A3, COL4A4, COL4A4, CR1, CRX, CYP2J2, DHDDS, DNAJC8, EIF2AK3, ERN1, GALE, GUCY2F, GUCY2F, HEXA, HEXA, MAPK3, MBD5, MBD5, MBD5, MUT, MYH14, MYO6, NF1, NF2, NIPBL, NR1H4, NSD1, NSD1, NSD1, NSD1, OPA1, OPA1, PCCA, PKP2, PPARA, PRPF3, PRPF3, SCN2A, SCN8A, SCN8A, SCN9A, SEMA3C, SEMA3D, SIRT3, STK11, STK11, SYNGAP1, TOPORS, and VCAN proteins.

Embodiment 3. The method of embodiment 1 or 2, wherein the therapeutic agent (a) binds to a targeted portion of the mRNA encoding the target protein;

(b) modulates binding of a factor involved in splicing of the NMD exon; or (c) a combination of (a) and (b).

Embodiment 4. The method of embodiment 3, wherein the therapeutic agent interferes with binding of the factor involved in splicing of the NMD exon to a region of the targeted portion.

Embodiment 5. The method of embodiment 3 or 4, wherein the targeted portion is proximal to the NMD exon.

Embodiment 6. The method of any one of embodiments 3 to 5, wherein the targeted portion is at most about 1500 nucleotides, about 1000 nucleotides, about 800 nucleotides, about 700 nucleotides, about 600 nucleotides, about 500 nucleotides, about 400 nucleotides, about 300 nucleotides, about 200 nucleotides, about 100 nucleotides, about 80 nucleotides, about 70 nucleotides, about 60 nucleotides, about 50 nucleotides upstream of 5' end of the NMD exon.

Embodiment 7. The method of any one of embodiments 3 to 6, wherein the targeted portion is at least about 1500 nucleotides, about 1000 nucleotides, about 800 nucleotides, about 700 nucleotides, about 600 nucleotides, about 500 nucleotides, about 400 nucleotides, about 300 nucleotides, about 200 nucleotides, about 100 nucleotides, about 80 nucleotides, about 70 nucleotides, about 60 nucleotides, about 50 nucleotides, about 40 nucleotides, about 30 nucleotides, about 20 nucleotides, about 10 nucleotides, about 5 nucleotides, about 4 nucleotides, about 2 nucleotides, about 1 nucleotides upstream of 5' end of the NMD exon.

Embodiment 8. The method of any one of embodiments 3 to 5, wherein the targeted portion is at most about 1500 nucleotides, about 1000 nucleotides, about 800 nucleotides, about 700 nucleotides, about 600 nucleotides, about 500 nucleotides, about 400 nucleotides, about 300 nucleotides, about 200 nucleotides, about 100 nucleotides, about 80 nucleotides, about 70 nucleotides, about 60 nucleotides, about 50 nucleotides downstream of 3' end of the NMD exon.

Embodiment 9. The method of any one of embodiments 3 to 5 or 8, wherein the targeted portion is at least about 1500 nucleotides, about 1000 nucleotides, about 800 nucleotides, about 700 nucleotides, about 600 nucleotides, about 500 nucleotides, about 400 nucleotides, about 300 nucleotides, about 200 nucleotides, about 100 nucleotides, about 80 nucleotides, about 70 nucleotides, about 60 nucleotides, about 50 nucleotides, about 40 nucleotides, about 30 nucleotides, about 20 nucleotides, about 10 nucleotides, about 5 nucleotides, about 4 nucleotides, about 2 nucleotides, about 1 nucleotides downstream of 3' end of the NMD exon.

Embodiment 10. The method of any one of embodiments 3 to 5, wherein the targeted portion is at most about 1500 nucleotides, about 1000 nucleotides, about 800 nucleotides, about 700 nucleotides, about 600 nucleotides, about 500 nucleotides, about 400 nucleotides, about 300 nucleotides, about 200 nucleotides, about 100 nucleotides, about 80 nucleotides, about 70 nucleotides, about 60 nucleotides, about 50 nucleotides upstream of genomic site selected from the group consisting of: GRCh38/hg38: chr1 243564388;

GRCh38/hg38: chr19 13236618; GRCh38/hg38: chr21 43060012; GRCh38/hg38: chr1 207775610; GRCh38/hg38: chr1 196675450; GRCh38/hg38: chr15 92998149; GRCh38/hg38: chr16 28479765; GRCh38/hg38: chr6 33183698; GRCh38/hg38: chr2 227296487; GRCh38/hg38: chr2 227144833; GRCh38/hg38: chr2 227015360; GRCh38/hg38: chr1 207637688; GRCh38/hg38: chr19 47835403; GRCh38/hg38: chr1 59904516; GRCh38/hg38: chr1 26442335; GRCh38/hg38: chr1 28230252; GRCh38/hg38: chr2 88582824; GRCh38/hg38: chr17 64102804; GRCh38/hg38: chr1 23798484; GRCh38/hg38: chrX 109383446; GRCh38/hg38: chrX 109439175; GRCh38/hg38: chr15 72362466; GRCh38/hg38: chr15 72345776; GRCh38/hg38: chr16 30115645; GRCh38/hg38: chr2 148460219; GRCh38/hg38: chr2 148490695; GRCh38/hg38: chr2 148505761; GRCh38/hg38: chr6 49436597; GRCh38/hg38: chr19 50230825; GRCh38/hg38: chr6 75867431; GRCh38/hg38: chr17 31249955; GRCh38/hg38: chr22 29628658; GRCh38/hg38: chr5 37048127; GRCh38/hg38: chr12 100499841; GRCh38/hg38: chr5 177169394; GRCh38/hg38: chr5 177200761; GRCh38/hg38: chr5 177247924; GRCh38/hg38: chr5 177275947; GRCh38/hg38: chr3 193628509; GRCh38/hg38: chr3 193603500; GRCh38/hg38: chr13 100305751; GRCh38/hg38: chr12 32894778; GRCh38/hg38: chr22 46203575; GRCh38/hg38: chr1 150327557; GRCh38/hg38: chr1 150330401; GRCh38/hg38: chr2 165327155; GRCh38/hg38: chr12 51688758; GRCh38/hg38: chr12 51780202; GRCh38/hg38: chr2 166304329; GRCh38/hg38: chr7 80794957; GRCh38/hg38: chr7 85059541; GRCh38/hg38: chr11 226081; GRCh38/hg38: chr19 1216268; GRCh38/hg38: chr19 1221621; GRCh38/hg38: chr6 33448789; GRCh38/hg38: chr9 32551469; and GRCh38/hg38: chr5 83544965.

Embodiment 11. The method of any one of embodiments 3 to 5 or 10, wherein the targeted portion is about 1500 nucleotides, about 1000 nucleotides, about 800 nucleotides, about 700 nucleotides, about 600 nucleotides, about 500 nucleotides, about 400 nucleotides, about 300 nucleotides, about 200 nucleotides, about 100 nucleotides, about 80 nucleotides, about 70 nucleotides, about 60 nucleotides, about 50 nucleotides upstream of genomic site selected from the group consisting of: GRCh38/hg38: chr1 243564388; GRCh38/hg38: chr19 13236618; GRCh38/hg38: chr21 43060012; GRCh38/hg38: chr1 207775610; GRCh38/hg38: chr1 196675450; GRCh38/hg38: chr15 92998149; GRCh38/hg38: chr16 28479765; GRCh38/hg38: chr6 33183698; GRCh38/hg38: chr2 227296487; GRCh38/hg38: chr2 227144833; GRCh38/hg38: chr2 227015360; GRCh38/hg38: chr1 207637688; GRCh38/hg38: chr19 47835403; GRCh38/hg38: chr1 59904516; GRCh38/hg38: chr1 26442335; GRCh38/hg38: chr1 28230252; GRCh38/hg38: chr2 88582824; GRCh38/hg38: chr17 64102804; GRCh38/hg38: chr1 23798484; GRCh38/hg38: chrX 109383446; GRCh38/hg38: chrX 109439175; GRCh38/hg38: chr15 72362466; GRCh38/hg38: chr15 72345776; GRCh38/hg38: chr16 30115645; GRCh38/hg38: chr2 148460219; GRCh38/hg38: chr2 148490695; GRCh38/hg38: chr2 148505761; GRCh38/hg38: chr6 49436597; GRCh38/hg38: chr19 50230825; GRCh38/hg38: chr6 75867431; GRCh38/hg38: chr17 31249955; GRCh38/hg38: chr22 29628658; GRCh38/hg38: chr5 37048127; GRCh38/hg38: chr12 100499841; GRCh38/hg38: chr5 177169394; GRCh38/hg38: chr5 177200761; GRCh38/hg38: chr5 177247924; GRCh38/hg38: chr5 177275947; GRCh38/hg38: chr3 193628509; GRCh38/hg38: chr3 193603500; GRCh38/hg38: chr13 100305751; GRCh38/hg38: chr12 32894778; GRCh38/hg38: chr22 46203575; GRCh38/hg38: chr1 150327557; GRCh38/hg38: chr1 150330401; GRCh38/hg38: chr2 165327155; GRCh38/hg38: chr12 51688758; GRCh38/hg38: chr12 51780202; GRCh38/hg38: chr2 166304329; GRCh38/hg38: chr7 80794957; GRCh38/hg38: chr7 85059541; GRCh38/hg38: chr11 226081; GRCh38/hg38: chr19 1216268; GRCh38/hg38: chr19 1221621; GRCh38/hg38: chr6 33448789; GRCh38/hg38: chr9 32551469; and GRCh38/hg38: chr5 83544965.

Embodiment 12. The method of any one of embodiments 3 to 5, wherein the targeted portion is at most about 1500 nucleotides, about 1000 nucleotides, about 800 nucleotides, about 700 nucleotides, about 600 nucleotides, about 500 nucleotides, about 400 nucleotides, about 300 nucleotides, about 200 nucleotides, about 100 nucleotides, about 80 nucleotides, about 70 nucleotides, about 60 nucleotides, about 50 nucleotides downstream of genomic site selected from the group consisting of: GRCh38/hg38: chr1 243564285; GRCh38/hg38: chr19 13236449; GRCh38/hg38: chr21 43059730; GRCh38/hg38: chr1 207775745; GRCh38/hg38: chr1 196675529; GRCh38/hg38: chr15 92998261; GRCh38/hg38: chr16 28479644; GRCh38/hg38: chr6 33183634; GRCh38/hg38: chr2 227296526; GRCh38/hg38: chr2 227144653; GRCh38/hg38: chr2 227015283; GRCh38/hg38: chr1 207637848; GRCh38/hg38: chr19 47835579; GRCh38/hg38: chr1 59904366; GRCh38/hg38: chr1 26442372; GRCh38/hg38: chr1 28230131; GRCh38/hg38: chr2 88582755; GRCh38/hg38: chr17 64102673; GRCh38/hg38: chr1 23798311; GRCh38/hg38: chrX 109383365; GRCh38/hg38: chrX 109439038; GRCh38/hg38: chr15 72362376; GRCh38/hg38: chr15 72345677; GRCh38/hg38: chr16 30115595; GRCh38/hg38: chr2 148460304; GRCh38/hg38: chr2 148490787; GRCh38/hg38: chr2 148505830; GRCh38/hg38: chr6 49436522; GRCh38/hg38: chr19 50230999; GRCh38/hg38: chr6 75867523; GRCh38/hg38: chr17 31250125; GRCh38/hg38: chr22 29628773; GRCh38/hg38: chr5 37048354; GRCh38/hg38: chr12 100500024; GRCh38/hg38: chr5 177169559; GRCh38/hg38: chr5 177200783; GRCh38/hg38: chr5 177248079; GRCh38/hg38: chr5 177276101; GRCh38/hg38: chr3 193628616; GRCh38/hg38: chr3 193603557; GRCh38/hg38: chr13 100305834; GRCh38/hg38: chr12 32894516; GRCh38/hg38: chr22 46203752; GRCh38/hg38: chr1 150327652; GRCh38/hg38: chr1 150330498; GRCh38/hg38: chr2 165327202; GRCh38/hg38: chr12 51688849; GRCh38/hg38: chr12 51780271; GRCh38/hg38: chr2 166304238; GRCh38/hg38: chr7 80794854; GRCh38/hg38: chr7 85059498; GRCh38/hg38: chr11 225673; GRCh38/hg38: chr19 1216398; GRCh38/hg38: chr19 1221846; GRCh38/hg38: chr6 33448868; GRCh38/hg38: chr9 32551365; and GRCh38/hg38: chr5 83545070.

Embodiment 13. The method of any one of embodiments 3 to 5 or 12, wherein the targeted portion is about 1500 nucleotides, about 1000 nucleotides, about 800 nucleotides, about 700 nucleotides, about 600 nucleotides, about 500 nucleotides, about 400 nucleotides, about 300 nucleotides, about 200 nucleotides, about 100 nucleotides, about 80 nucleotides, about 70 nucleotides, about 60 nucleotides, about 50 nucleotides downstream of genomic site selected from the group consisting of: GRCh38/hg38: chr1 243564285; GRCh38/hg38: chr19 13236449; GRCh38/hg38: chr21 43059730; GRCh38/hg38: chr1 207775745; GRCh38/hg38: chr1 196675529; GRCh38/hg38: chr15 92998261; GRCh38/hg38: chr16 28479644; GRCh38/hg38: chr6 33183634; GRCh38/hg38: chr2 227296526; GRCh38/hg38: chr2 227144653; GRCh38/hg38: chr2 227015283; GRCh38/hg38: chr1 207637848; GRCh38/hg38: chr19 47835579; GRCh38/hg38: chr1 59904366; GRCh38/hg38:

chr1 26442372; GRCh38/hg38: chr1 28230131; GRCh38/hg38: chr2 88582755; GRCh38/hg38: chr17 64102673; GRCh38/hg38: chr1 23798311; GRCh38/hg38: chrX 109383365; GRCh38/hg38: chrX 109439038; GRCh38/hg38: chr15 72362376; GRCh38/hg38: chr15 72345677; GRCh38/hg38: chr16 30115595; GRCh38/hg38: chr2 148460304; GRCh38/hg38: chr2 148490787; GRCh38/hg38: chr2 148505830; GRCh38/hg38: chr6 49436522; GRCh38/hg38: chr19 50230999; GRCh38/hg38: chr6 75867523; GRCh38/hg38: chr17 31250125; GRCh38/hg38: chr22 29628773; GRCh38/hg38: chr5 37048354; GRCh38/hg38: chr12 100500024; GRCh38/hg38: chr5 177169559; GRCh38/hg38: chr5 177200783; GRCh38/hg38: chr5 177248079; GRCh38/hg38: chr5 177276101; GRCh38/hg38: chr3 193628616; GRCh38/hg38: chr3 193603557; GRCh38/hg38: chr13 100305834; GRCh38/hg38: chr12 32894516; GRCh38/hg38: chr22 46203752; GRCh38/hg38: chr1 150327652; GRCh38/hg38: chr1 150330498; GRCh38/hg38: chr2 165327202; GRCh38/hg38: chr12 51688849; GRCh38/hg38: chr12 51780271; GRCh38/hg38: chr2 166304238; GRCh38/hg38: chr7 80794854; GRCh38/hg38: chr7 85059498; GRCh38/hg38: chr11 225673; GRCh38/hg38: chr19 1216398; GRCh38/hg38: chr19 1221846; GRCh38/hg38: chr6 33448868; GRCh38/hg38: chr9 32551365; and GRCh38/hg38: chr5 83545070.

Embodiment 14. The method of any one of embodiments 3 to 13, wherein the targeted portion is located in an intronic region between two canonical exonic regions of the mRNA encoding the target protein, and wherein the intronic region contains the NMD exon.

Embodiment 15. The method of any one of embodiments 3 to 14, wherein the targeted portion at least partially overlaps with the NMD exon.

Embodiment 16. The method of any one of embodiments 3 to 15, wherein the targeted portion at least partially overlaps with an intron upstream or downstream of the NMD exon.

Embodiment 17. The method of any one of embodiments 3 to 16, wherein the targeted portion comprises 5' NMD exon-intron junction or 3' NMD exon-intron junction.

Embodiment 18. The method of any one of embodiments 3 to 16, wherein the targeted portion is within the NMD exon.

Embodiment 19. The method of any one of embodiments 1 to 18, wherein the targeted portion comprises about 5, 6, 7, 8, 9, 10, 11, 12, 13, 14, 15, 16, 17, 18, 19, 20, 21, 22, 23, 24, 25, 26, 27, 28, 29, 30, or more consecutive nucleotides of the NMD exon.

Embodiment 20. The method of any one of embodiments 1 to 19, wherein the mRNA encoding the target protein comprises a sequence with at least about 80%, 85%, 90%, 95%, 97%, or 100% sequence identity to a sequence selected from the group consisting of SEQ ID NOs: 135-191.

Embodiment 21. The method of any one of embodiments 1 to 20, wherein the mRNA encoding the target protein is encoded by a genetic sequence with at least about 80%, 85%, 90%, 95%, 97%, or 100% sequence identity to a sequence selected from the group consisting of SEQ ID NOs: 1-5, 12, 19-21, 25, 26, 28, 30, 33, 35, 38, 40, 41, 44, 45, 51, 53, 55-57, and 192-211.

Embodiment 22. The method of any one of embodiments 3 to 21, wherein the targeted portion of the mRNA comprises a sequence with at least 80%, 85%, 90%, 95%, 97%, or 100% sequence identity to a region comprising at least 8 contiguous nucleic acids of a sequence selected from the group consisting of SEQ ID NOs: 135-191.

Embodiment 23. The method of any one of embodiments 1 to 22, wherein the agent is an antisense oligomer (ASO) and wherein the ASO comprises a sequence that is at least about 80%, 85%, 90%, 95%, 97%, or 100% complementary to at least 8 contiguous nucleic acids of a sequence selected from the group consisting of SEQ ID NOs: 135-191.

Embodiment 24. The method of any one of embodiments 3 to 23, wherein the targeted portion of the mRNA is within the non-sense mediated RNA decay-inducing exon selected from the group consisting of: GRCh38/hg38: chr1 243564285 243564388; GRCh38/hg38: chr19 13236449 13236618; GRCh38/hg38: chr21 43059730 43060012; GRCh38/hg38: chr1 207775610 207775745; GRCh38/hg38: chr1 196675450 196675529; GRCh38/hg38: chr15 92998149 92998261; GRCh38/hg38: chr16 28479644 28479765; GRCh38/hg38: chr6 33183634 33183698; GRCh38/hg38: chr2 227296487 227296526; GRCh38/hg38: chr2 227144653 227144833; GRCh38/hg38: chr2 227015283 227015360; GRCh38/hg38: chr1 207637688 207637848; GRCh38/hg38: chr19 47835403 47835579; GRCh38/hg38: chr1 59904366 59904516; GRCh38/hg38: chr1 26442335 26442372; GRCh38/hg38: chr1 28230131 28230252; GRCh38/hg38: chr2 88582755 88582824; GRCh38/hg38: chr17 64102673 64102804; GRCh38/hg38: chr1 23798311 23798484; GRCh38/hg38: chrX 109383365 109383446; GRCh38/hg38: chrX 109439038 109439175; GRCh38/hg38: chr15 72362376 72362466; GRCh38/hg38: chr15 72345677 72345776; GRCh38/hg38: chr16 30115595 30115645; GRCh38/hg38: chr2 148460219 148460304; GRCh38/hg38: chr2 148490695 148490787; GRCh38/hg38: chr2 148505761 148505830; GRCh38/hg38: chr6 49436522 49436597; GRCh38/hg38: chr19 50230825 50230999; GRCh38/hg38: chr6 75867431 75867523; GRCh38/hg38: chr17 31249955 31250125; GRCh38/hg38: chr22 29628658 29628773; GRCh38/hg38: chr5 37048127 37048354; GRCh38/hg38: chr12 100499841 100500024; GRCh38/hg38: chr5 177169394 177169559; GRCh38/hg38: chr5 177200761 177200783; GRCh38/hg38: chr5 177247924 177248079; GRCh38/hg38: chr5 177275947 177276101; GRCh38/hg38: chr3 193628509 193628616; GRCh38/hg38: chr3 193603500 193603557; GRCh38/hg38: chr13 100305751 100305834; GRCh38/hg38: chr12 32894516 32894778; GRCh38/hg38: chr22 46203575 46203752; GRCh38/hg38: chr1 150327557 150327652; GRCh38/hg38: chr1 150330401 150330498; GRCh38/hg38: chr2 165327155 165327202; GRCh38/hg38: chr12 51688758 51688849; GRCh38/hg38: chr12 51780202 51780271; GRCh38/hg38: chr2 166304238 166304329; GRCh38/hg38: chr7 80794854 80794957; GRCh38/hg38: chr7 85059498 85059541; GRCh38/hg38: chr11 225673 226081; GRCh38/hg38: chr19 1216268 1216398; GRCh38/hg38: chr19 1221621 1221846; GRCh38/hg38: chr6 33448789 33448868; GRCh38/hg38: chr9 32551365 32551469; and GRCh38/hg38: chr5 83544965 83545070.

Embodiment 25. The method of any one of embodiments 3 to 23, wherein the targeted portion of the mRNA is upstream or downstream of the non-sense mediated RNA decay-inducing exon selected from the group consisting of: GRCh38/hg38: chr1 243564285 243564388; GRCh38/hg38: chr19 13236449 13236618; GRCh38/hg38: chr21 43059730 43060012; GRCh38/hg38: chr1 207775610 207775745; GRCh38/hg38: chr1 196675450 196675529; GRCh38/hg38: chr15 92998149 92998261; GRCh38/hg38: chr16 28479644 28479765; GRCh38/hg38: chr6 33183634 33183698; GRCh38/hg38: chr2 227296487 227296526; GRCh38/hg38: chr2 227144653 227144833; GRCh38/hg38: chr2 227015283 227015360; GRCh38/hg38: chr1

207637688 207637848; GRCh38/hg38: chr19 47835403 47835579; GRCh38/hg38: chr1 59904366 59904516; GRCh38/hg38: chr1 26442335 26442372; GRCh38/hg38: chr1 28230131 28230252; GRCh38/hg38: chr2 88582755 88582824; GRCh38/hg38: chr17 64102673 64102804; GRCh38/hg38: chr1 23798311 23798484; GRCh38/hg38: chrX 109383365 109383446; GRCh38/hg38: chrX 109439038 109439175; GRCh38/hg38: chr15 72362376 72362466; GRCh38/hg38: chr15 72345677 72345776; GRCh38/hg38: chr16 30115595 30115645; GRCh38/hg38: chr2 148460219 148460304; GRCh38/hg38: chr2 148490695 148490787; GRCh38/hg38: chr2 148505761 148505830; GRCh38/hg38: chr6 49436522 49436597; GRCh38/hg38: chr19 50230825 50230999; GRCh38/hg38: chr6 75867431 75867523; GRCh38/hg38: chr17 31249955 31250125; GRCh38/hg38: chr22 29628658 29628773; GRCh38/hg38: chr5 37048127 37048354; GRCh38/hg38: chr12 100499841 100500024; GRCh38/hg38: chr5 177169394 177169559; GRCh38/hg38: chr5 177200761 177200783; GRCh38/hg38: chr5 177247924 177248079; GRCh38/hg38: chr5 177275947 177276101; GRCh38/hg38: chr3 193628509 193628616; GRCh38/hg38: chr3 193603500 193603557; GRCh38/hg38: chr13 100305751 100305834; GRCh38/hg38: chr12 32894516 32894778; GRCh38/hg38: chr22 46203575 46203752; GRCh38/hg38: chr1 150327557 150327652; GRCh38/hg38: chr1 150330401 150330498; GRCh38/hg38: chr2 165327155 165327202; GRCh38/hg38: chr12 51688758 51688849; GRCh38/hg38: chr12 51780202 51780271; GRCh38/hg38: chr2 166304238 166304329; GRCh38/hg38: chr7 80794854 80794957; GRCh38/hg38: chr7 85059498 85059541; GRCh38/hg38: chr11 225673 226081; GRCh38/hg38: chr19 1216268 1216398; GRCh38/hg38: chr19 1221621 1221846; GRCh38/hg38: chr6 33448789 33448868; GRCh38/hg38: chr9 32551365 32551469; and GRCh38/hg38: chr5 83544965 83545070.

Embodiment 26. The method of any one of embodiments 3 to 23, wherein the targeted portion of the mRNA comprises an exon-intron junction of exon selected from the group consisting of: GRCh38/hg38: chr1 243564285 243564388; GRCh38/hg38: chr19 13236449 13236618; GRCh38/hg38: chr21 43059730 43060012; GRCh38/hg38: chr1 207775610 207775745; GRCh38/hg38: chr1 196675450 196675529; GRCh38/hg38: chr15 92998149 92998261; GRCh38/hg38: chr16 28479644 28479765; GRCh38/hg38: chr6 33183634 33183698; GRCh38/hg38: chr2 227296487 227296526; GRCh38/hg38: chr2 227144653 227144833; GRCh38/hg38: chr2 227015283 227015360; GRCh38/hg38: chr1 207637688 207637848; GRCh38/hg38: chr19 47835403 47835579; GRCh38/hg38: chr1 59904366 59904516; GRCh38/hg38: chr1 26442335 26442372; GRCh38/hg38: chr1 28230131 28230252; GRCh38/hg38: chr2 88582755 88582824; GRCh38/hg38: chr17 64102673 64102804; GRCh38/hg38: chr1 23798311 23798484; GRCh38/hg38: chrX 109383365 109383446; GRCh38/hg38: chrX 109439038 109439175; GRCh38/hg38: chr15 72362376 72362466; GRCh38/hg38: chr15 72345677 72345776; GRCh38/hg38: chr16 30115595 30115645; GRCh38/hg38: chr2 148460219 148460304; GRCh38/hg38: chr2 148490695 148490787; GRCh38/hg38: chr2 148505761 148505830; GRCh38/hg38: chr6 49436522 49436597; GRCh38/hg38: chr19 50230825 50230999; GRCh38/hg38: chr6 75867431 75867523; GRCh38/hg38: chr17 31249955 31250125; GRCh38/hg38: chr22 29628658 29628773; GRCh38/hg38: chr5 37048127 37048354; GRCh38/hg38: chr12 100499841 100500024; GRCh38/hg38: chr5 177169394 177169559; GRCh38/hg38: chr5 177200761 177200783; GRCh38/hg38: chr5 177247924 177248079; GRCh38/hg38: chr5 177275947 177276101; GRCh38/hg38: chr3 193628509 193628616; GRCh38/hg38: chr3 193603500 193603557; GRCh38/hg38: chr13 100305751 100305834; GRCh38/hg38: chr12 32894516 32894778; GRCh38/hg38: chr22 46203575 46203752; GRCh38/hg38: chr1 150327557 150327652; GRCh38/hg38: chr1 150330401 150330498; GRCh38/hg38: chr2 165327155 165327202; GRCh38/hg38: chr12 51688758 51688849; GRCh38/hg38: chr12 51780202 51780271; GRCh38/hg38: chr2 166304238 166304329; GRCh38/hg38: chr7 80794854 80794957; GRCh38/hg38: chr7 85059498 85059541; GRCh38/hg38: chr11 225673 226081; GRCh38/hg38: chr19 1216268 1216398; GRCh38/hg38: chr19 1221621 1221846; GRCh38/hg38: chr6 33448789 33448868; GRCh38/hg38: chr9 32551365 32551469; and GRCh38/hg38: chr5 83544965 83545070.

Embodiment 27. The method of any one of embodiments 1 to 26, wherein the target protein produced is a full-length protein or a wild-type protein.

Embodiment 28. The method of any one of embodiments 1 to 27, wherein the therapeutic agent promotes exclusion of the NMD exon from the processed mRNA encoding the target protein.

Embodiment 29. The method of embodiment 28, wherein exclusion of the NMD exon from the processed mRNA encoding the target protein in the cell contacted with the therapeutic agent is increased by about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold, compared to exclusion of the NMD exon from the processed mRNA encoding the target protein in a control cell.

Embodiment 30. The method of embodiment 28 or 29, wherein the therapeutic agent increases the level of the processed mRNA encoding the target protein in the cell.

Embodiment 31. The method of any one of embodiments 28 to 30, wherein the level of the processed mRNA encoding the target protein produced in the cell contacted with the therapeutic agent is increased by about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold, compared to a level of the processed mRNA encoding the target protein in a control cell.

Embodiment 32. The method of any one of embodiments 28 to 31, wherein the therapeutic agent increases the expression of the target protein in the cell.

Embodiment 33. The method of any one of embodiments 28 to 32, wherein a level of the target protein produced in the cell contacted with the therapeutic agent is increased by about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold, compared to a level of the target protein produced in a control cell.

Embodiment 34. The method of any one of embodiments 2 to 33, wherein the disease or condition is induced by a loss-of-function mutation in the target protein.

Embodiment 35. The method of embodiment 34, wherein the disease or condition is associated with haploinsufficiency of a gene encoding the target protein, and wherein the subject has a first allele encoding a functional target protein, and a second allele from which the target protein is not produced or produced at a reduced level, or a second allele encoding a nonfunctional target protein or a partially functional target protein.

Embodiment 36. The method of any one of embodiments 2 to 35, wherein the disease or condition is selected from the group consisting of. Sotos syndrome 1; Beckwith-Wiedemann syndrome; Migraine, familial hemiplegic, 1; Episodic ataxia, type 2; Epileptic encephalopathy, childhood-onset; Wagner syndrome 1; Optic atrophy type 1; Alport syndrome; Arrhythmogenic right ventricular dysplasia 9; Neurofibromatosis type 1; Epileptic encephalopathy, early infantile, 11; Seizures, benign familial infantile, 3; Cognitive impairment with or without cerebellar ataxia; Epileptic encephalopathy, early infantile, 13; Seizures, benign familial infantile, 5; Pathway (CNS); 16p11.2 deletion syndrome?; Mental retardation, autosomal dominant 1; Retinitis pigmentosa 18; Retinitis pigmentosa 31; Deafness, autosomal dominant 13; Cone-rod retinal dystrophy-2; Deafness, autosomal dominant 4A; Peripheral neuropathy, myopathy, hoarseness, and hearing loss; Deafness, autosomal dominant 22; Neurofibromatosis type 2; Mental retardation, autosomal dominant 5; Epilepsy, generalized, with febrile seizures plus, type 7; and Febrile seizures, familial, 3B.

Embodiment 37. The method of any one of embodiments 2 to 36, wherein the disease or condition is associated with an autosomal recessive mutation of a gene encoding the target protein, wherein the subject has a first allele encoding from which:

(i) the target protein is not produced or produced at a reduced level compared to a wild-type allele; or (ii) the target protein produced is nonfunctional or partially functional compared to a wild-type allele, and a second allele from which:

(iii) the target protein is produced at a reduced level compared to a wild-type allele and the target protein produced is at least partially functional compared to a wild-type allele; or (iv) the target protein produced is partially functional compared to a wild-type allele.

Embodiment 38. The method of embodiment 37, wherein the disease or condition is selected from the group consisting of. Alport syndrome; Ceroid lipofuscinosis, neuronal, 3; Galactose epimerase deficiency; Homocystinuria, B6-responsive and nonresponsive types; Methyl Malonic Aciduria; Propionic acidemia; Retinitis pigmentosa 59; Tay-Sachs disease; Insensitivity to pain, congenital; and HSAN2D, autosomal recessive.

Embodiment 39. The method of any one of embodiments 34 to 39, wherein the therapeutic agent promotes exclusion of the NMD exon from the processed mRNA encoding the target protein and increases the expression of the target protein in the cell.

Embodiment 40. The method of any one of embodiments 1 to 27, wherein the therapeutic agent inhibits exclusion of the NMD exon from the processed mRNA encoding the target protein.

Embodiment 41. The method of embodiment 40, wherein exclusion of the NMD exon from the processed mRNA encoding the target protein in the cell contacted with the therapeutic agent is decreased by about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold, compared to exclusion of the NMD exon from the processed mRNA encoding the target protein in a control cell.

Embodiment 42. The method of embodiment 40 or 41, wherein the therapeutic agent decreases the level of the processed mRNA encoding the target protein in the cell.

Embodiment 43. The method of any one of embodiments 40 to 42, wherein the level of the processed mRNA encoding the target protein in the cell contacted with the therapeutic agent is decreased by about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold, compared to a level of the processed mRNA encoding the target protein in a control cell.

Embodiment 44. The method of any one of embodiments 40 to 43, wherein the therapeutic agent decreases the expression of the target protein in the cell.

Embodiment 45. The method of any one of embodiments 40 to 44, wherein a level of the target protein produced in the cell contacted with the therapeutic agent is decreased by about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold, compared to a level of the target protein produced in a control cell.

Embodiment 46. The method of any one of embodiments 2 to 27 or 40 to 45, wherein the disease or condition is induced by a gain-of-function mutation in the target protein Embodiment 47. The method of embodiment 46, wherein the subject has an allele from which the target protein is produced at an increased level, or an allele encoding a mutant target protein that exhibits increased activity in the cell.

Embodiment 48. The method of embodiment 46 or 47, wherein the therapeutic agent inhibits exclusion of the NMD exon from the processed mRNA encoding the target protein and decreases the expression of the target protein in the cell.

Embodiment 49. The method of embodiment 40, wherein the target protein comprises SCN8A.

Embodiment 50. The method of embodiment 49, wherein the disease or condition comprises a central nervous system disease.

Embodiment 51. The method of embodiment 50, wherein the disease or condition comprises epilepsy.

Embodiment 52. The method of embodiment 51, wherein the disease or condition comprises Dravet syndrome.

Embodiment 53. The method of any one of embodiments 1 to 52, wherein the therapeutic agent is an antisense oligomer (ASO) and wherein the antisense oligomer comprises a backbone modification comprising a phosphorothioate linkage or a phosphorodiamidate linkage.

Embodiment 54. The method of any one of embodiments 1 to 53, wherein the therapeutic agent is an antisense oligomer (ASO) and wherein the antisense oligomer comprises a phosphorodiamidate morpholino, a locked nucleic acid, a peptide nucleic acid, a 2'-O-methyl, a 2'-Fluoro, or a 2'-O-methoxyethyl moiety.

Embodiment 55. The method of any one of embodiments 1 to 54, wherein the therapeutic agent is an antisense oligomer (ASO) and wherein the antisense oligomer comprises at least one modified sugar moiety.

Embodiment 56. The method of embodiment 55, wherein each sugar moiety is a modified sugar moiety.

Embodiment 57. The method of any one of embodiments 1 to 56, wherein the therapeutic agent is an antisense oligomer (ASO) and wherein the antisense oligomer consists of from 8 to 50 nucleobases, 8 to 40 nucleobases, 8 to 35 nucleobases, 8 to 30 nucleobases, 8 to 25 nucleobases, 8 to 20 nucleobases, 8 to 15 nucleobases, 9 to 50 nucleobases, 9 to 40 nucleobases, 9 to 35 nucleobases, 9 to 30 nucleobases, 9 to 25 nucleobases, 9 to 20 nucleobases, 9 to 15 nucleobases, 10 to 50 nucleobases, 10 to 40 nucleobases, 10 to 35 nucleobases, 10 to 30 nucleobases, 10 to 25 nucleobases, 10 to 20 nucleobases, 10 to 15 nucleobases, 11 to 50 nucleobases, 11 to 40 nucleobases, 11 to 35 nucleobases, 11 to 30 nucleobases, 11 to 25 nucleobases, 11 to 20 nucleobases, 11 to 15 nucleobases, 12 to 50 nucleobases, 12 to 40 nucleobases, 12 to 35 nucleobases, 12 to 30 nucleobases, 12 to 25 nucleobases, 12 to 20 nucleobases, or 12 to 15 nucleobases.

Embodiment 58. The method of any one of embodiments 3 to 57, wherein the therapeutic agent is an antisense oligomer (ASO) and wherein the antisense oligomer is at least 80%, at least 85%, at least 90%, at least 95%, at least 98%, at least 99%, or 100%, complementary to the targeted portion of the mRNA.

Embodiment 59. The method of any one of embodiments 1 to 58, wherein the method further comprises assessing mRNA level or expression level of the target protein.

Embodiment 60. The method of any one of embodiments 1 to 59, wherein the subject is a human.

Embodiment 61. The method of any one of embodiments 1 to 59, wherein the subject is a non-human animal.

Embodiment 62. The method of any one of embodiments 2 to 60, wherein the subject is a fetus, an embryo, or a child.

Embodiment 63. The method of any one of embodiments 1 to 62, wherein the cells are ex vivo.

Embodiment 64. The method of any one of embodiments 2 to 62, wherein the therapeutic agent is administered by intrathecal injection, intracerebroventricular injection, intraperitoneal injection, intramuscular injection, subcutaneous injection, intravitreal, or intravenous injection of the subject.

Embodiment 65. The method of any one of embodiments 2 to 62 or 64, wherein the method further comprises administering a second therapeutic agent to the subject.

Embodiment 66. The method of any one of embodiments 1 to 65, wherein the second therapeutic agent is a small molecule.

Embodiment 67. The method of any one of embodiments 1 to 65, wherein the second therapeutic agent is an antisense oligomer.

Embodiment 68. The method of any one of embodiments 1 to 67, wherein the second therapeutic agent corrects intron retention.

Embodiment 69. The method of any one of embodiments 2 to 68, wherein the disease or condition is selected from the group consisting of: 16p11.2 deletion syndrome; Alport syndrome; Arrhythmogenic right ventricular dysplasia 9; Ceroid lipofuscinosis, neuronal, 3; Cognitive impairment with or without cerebellar ataxia; Epileptic encephalopathy, early infantile, 13; Seizures, benign familial infantile, 5; Cone-rod retinal dystrophy-2; Cornelia de Lange; Deafness, autosomal dominant 13; Deafness, autosomal dominant 4A; Peripheral neuropathy, myopathy, hoarseness, and hearing loss; Epilepsy, generalized, with febrile seizures plus, type 7; Febrile seizures, familial, 3B; Insensitivity to pain, congenital; HSAN2D, autosomal recessive; Epileptic encephalopathy, childhood-onset; Epileptic encephalopathy, early infantile, 11; Seizures, benign familial infantile, 3; Galactose epimerase deficiency; Homocystinuria, B6-responsive and nonresponsive types; Mental retardation, autosomal dominant 1; Mental retardation, autosomal dominant 5; Methyl Malonic Aciduria; Migraine, familial hemiplegic, 1; Episodic ataxia, type 2; NASH; Neurofibromatosis type 1; Neurofibromatosis type 2; Optic atrophy type 1; Propionic acidemia; Retinitis pigmentosa 18; Sotos syndrome 1; Beckwith-Wiedemann syndrome; Tay-Sachs disease; and Wagner syndrome 1.

EXAMPLES

The present disclosure will be more specifically illustrated by the following Examples.

However, it should be understood that the present disclosure is not limited by these examples in any manner.

Figure 2:
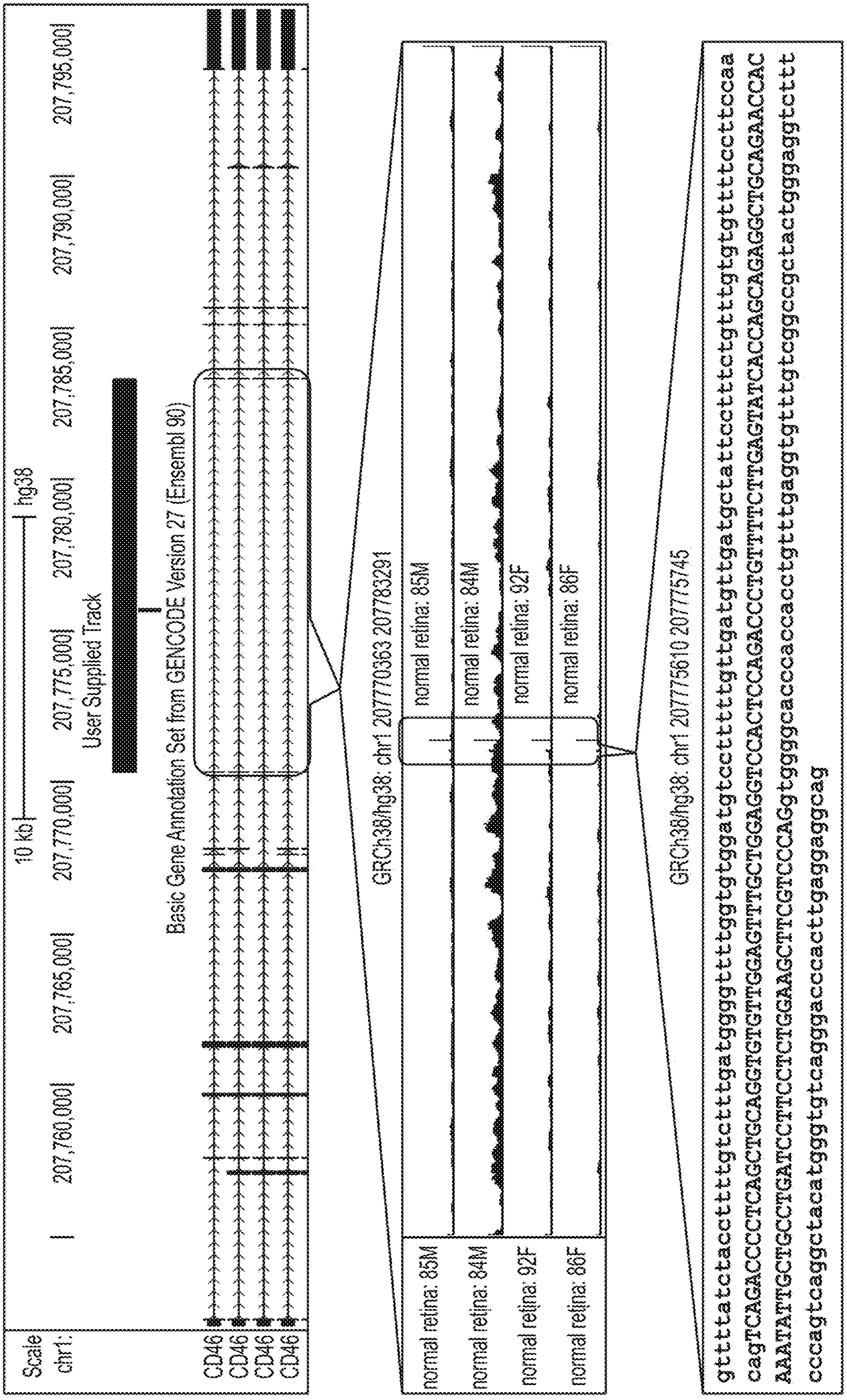
FIG. 2 depicts identification of an exemplary nonsense-mediated mRNA decay (NMD)-inducing exon in the CD46 gene. The identification of the NMD-inducing exon in the CD46 gene using RNA sequencing is shown, visualized in the UCSC genome browser. The upper panel shows a graphic representation of the CD46 gene to scale. Peaks corresponding to RNA sequencing reads were identified in intron GRCh38/hg38: chr1 207770363 207783291, shown in the middle panel. Bioinformatic analysis identified an exon-like sequence (bottom panel, sequence highlighted in uppercase) flanked by 3' and 5' splice sites. Inclusion of this exon leads to the introduction of a premature termination codon rendering the transcript a target of NMD.
Figure 3:
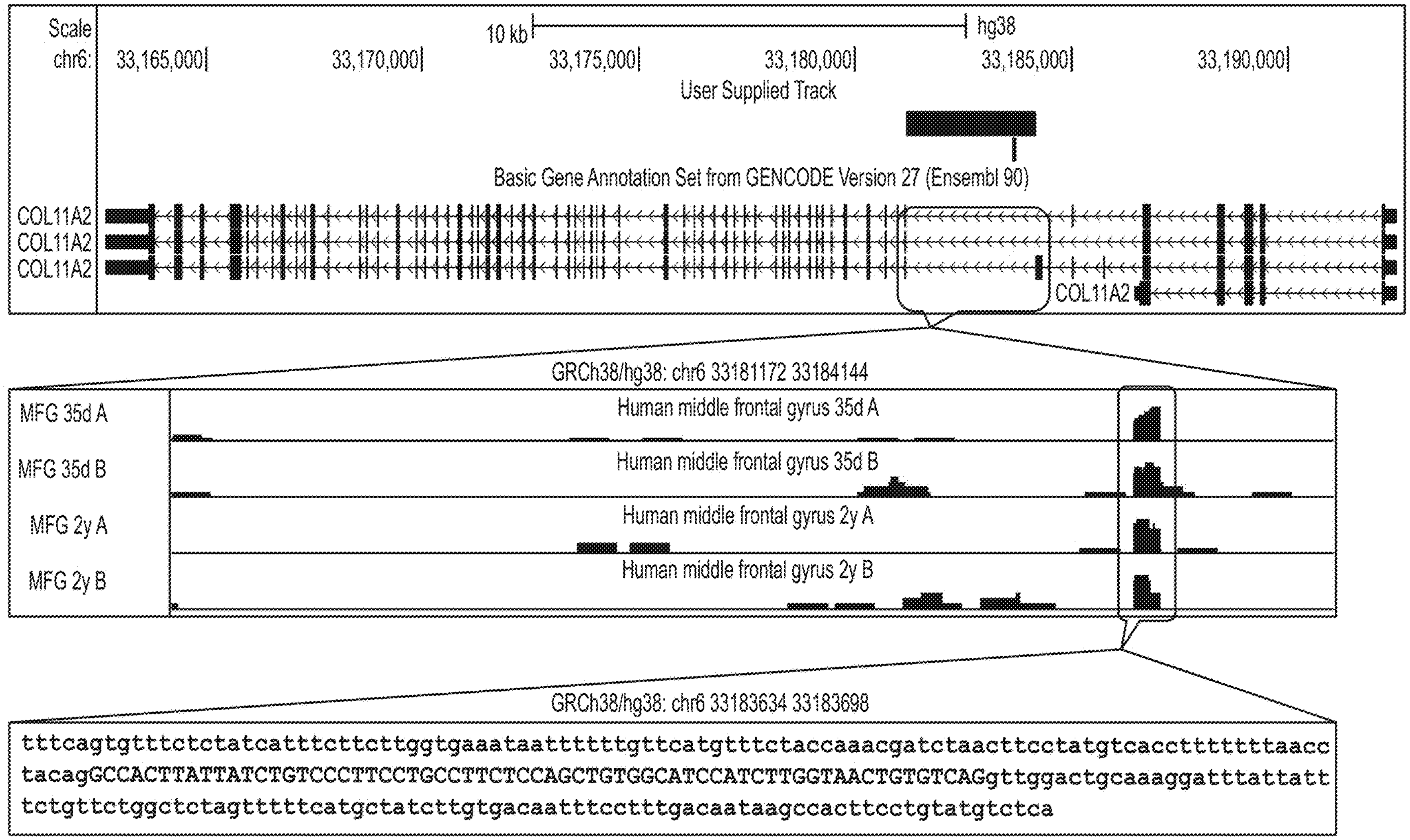
FIG. 3 depicts identification of an exemplary nonsense-mediated mRNA decay (NMD)-inducing exon in the COL11A2 gene. The identification of the NMD-inducing exon in the COL11A2 gene using RNA sequencing is shown, visualized in the UCSC genome browser. The upper panel shows a graphic representation of the COL11A2 gene to scale. Peaks corresponding to RNA sequencing reads were identified in intron GRCh38/hg38: chr6 33181172 33184144, shown in the middle panel. Bioinformatic analysis identified an exon-like sequence (bottom panel, sequence highlighted in uppercase) flanked by 3' and 5' splice sites. Inclusion of this exon leads to the introduction of a premature termination codon rendering the transcript a target of NMD.
Figure 4:
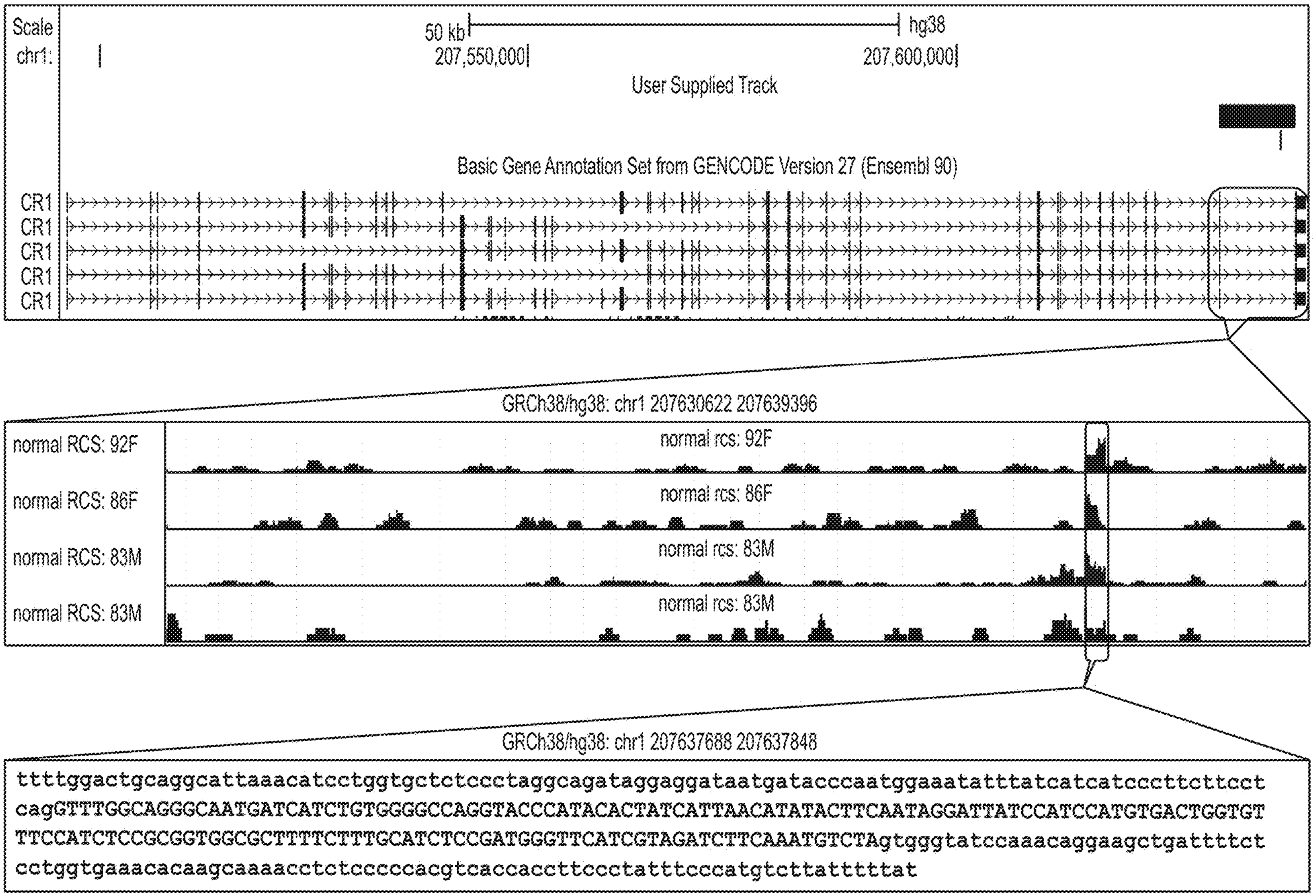
FIG. 4 depicts identification of an exemplary nonsense-mediated mRNA decay (NMD)-inducing exon in the CR1 gene. The identification of the NMD-inducing exon in the CR1 gene using RNA sequencing is shown, visualized in the UCSC genome browser. The upper panel shows a graphic representation of the CR1 gene to scale. Peaks corresponding to RNA sequencing reads were identified in intron GRCh38/hg38: chr1 207630622 207639396, shown in the middle panel. Bioinformatic analysis identified an exon-like sequence (bottom panel, sequence highlighted in uppercase) flanked by 3' and 5' splice sites. Inclusion of this exon leads to the introduction of a premature termination codon rendering the transcript a target of NMD.
Figure 5:
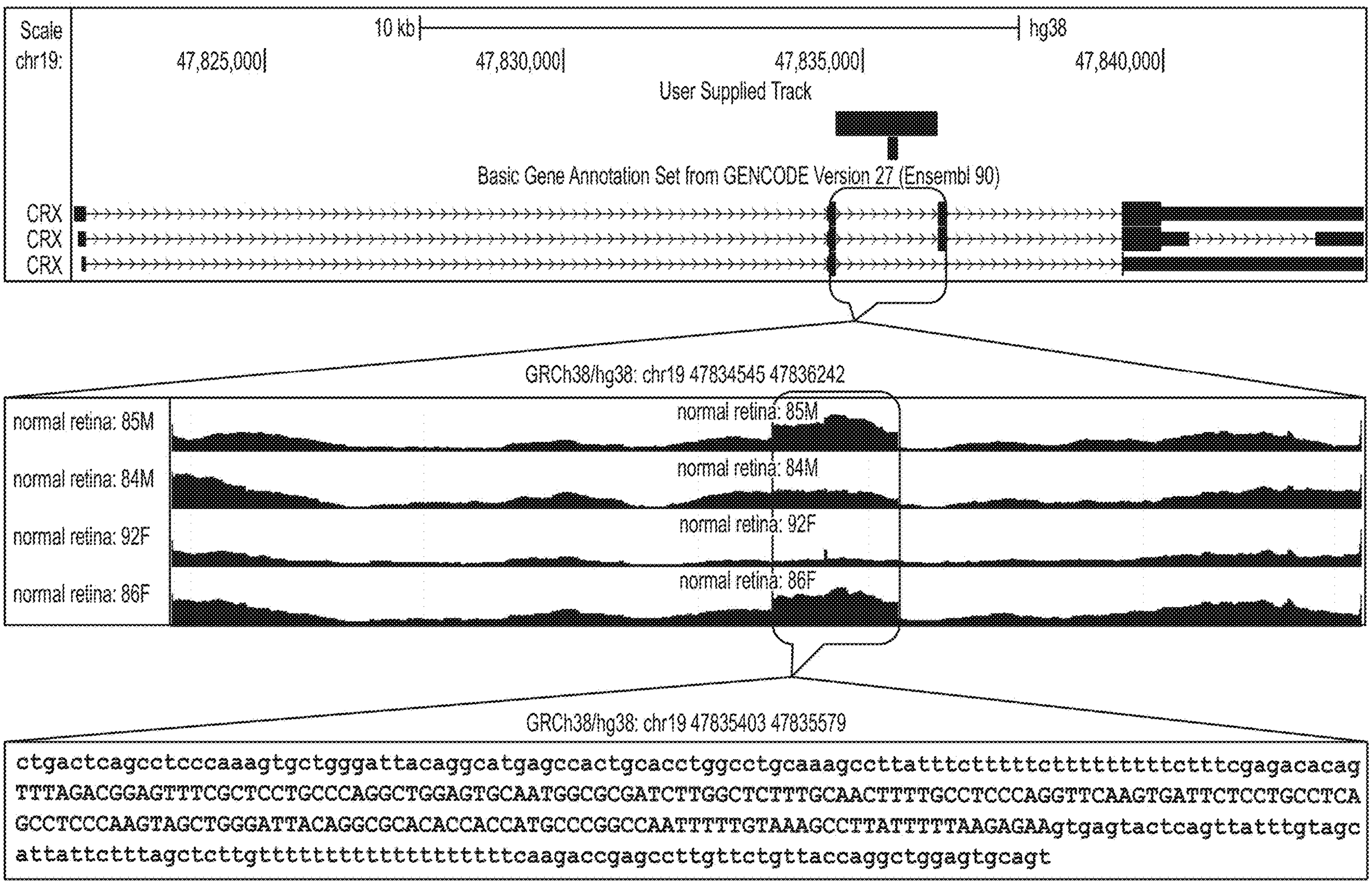
FIG. 5 depicts identification of an exemplary nonsense-mediated mRNA decay (NMD)-inducing exon in the CRX gene. The identification of the NMD-inducing exon in the CRX gene using RNA sequencing is shown, visualized in the UCSC genome browser. The upper panel shows a graphic representation of the CRX gene to scale. Peaks corresponding to RNA sequencing reads were identified in intron GRCh38/hg38: chr19 47834545 47836242, shown in the middle panel. Bioinformatic analysis identified an exon-like sequence (bottom panel, sequence highlighted in uppercase) flanked by 3' and 5' splice sites. Inclusion of this exon leads to the introduction of a premature termination codon rendering the transcript a target of NMD.
Figure 6:
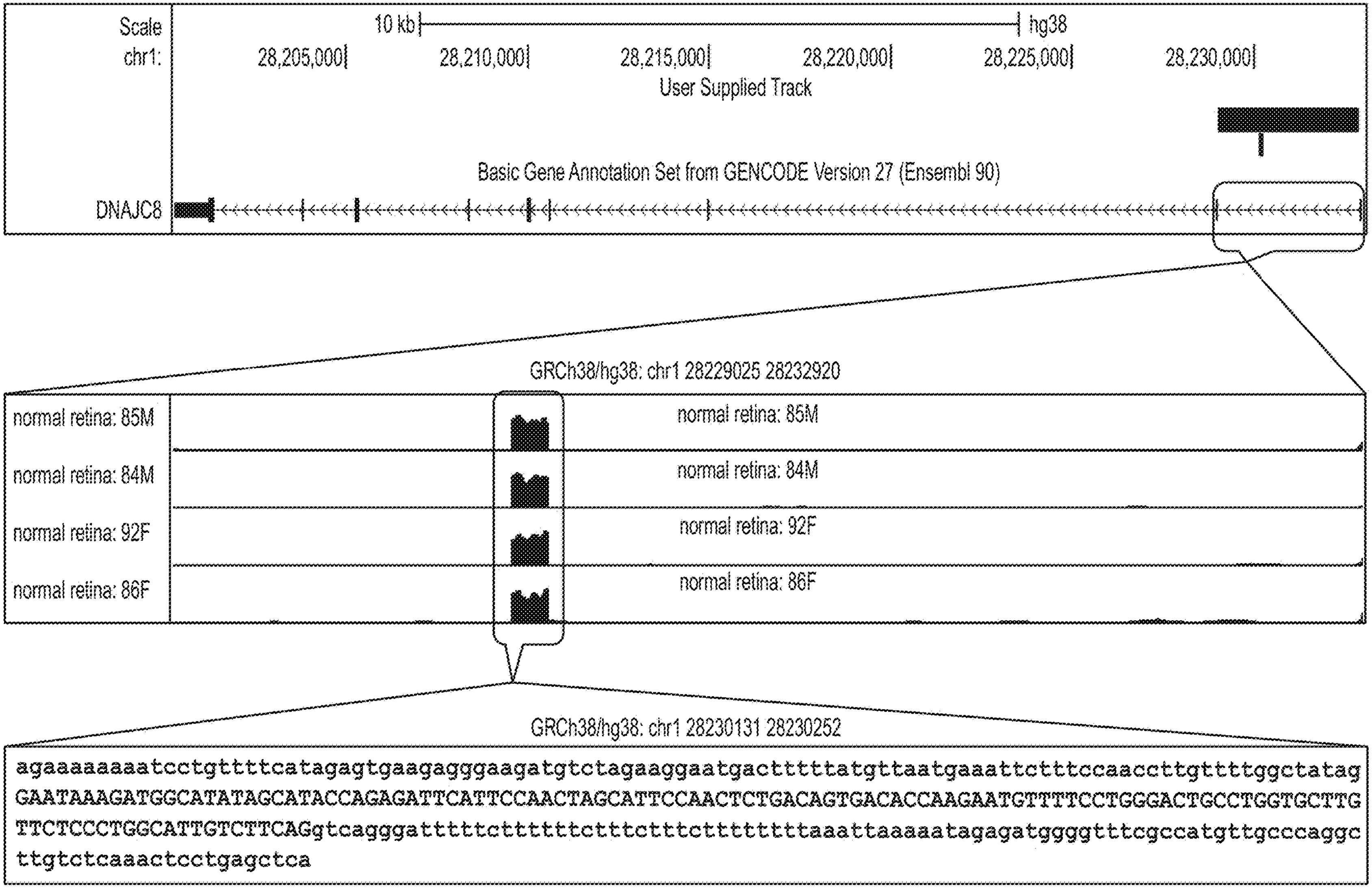
FIG. 6 depicts identification of an exemplary nonsense-mediated mRNA decay (NMD)-inducing exon in the DNAJC8 gene. The identification of the NMD-inducing exon in the DNAJC8 gene using RNA sequencing is shown, visualized in the UCSC genome browser. The upper panel shows a graphic representation of the DNAJC8 gene to scale. Peaks corresponding to RNA sequencing reads were identified in intron GRCh38/hg38: chr1 28229025 28232920, shown in the middle panel. Bioinformatic analysis identified an exon-like sequence (bottom panel, sequence highlighted in uppercase) flanked by 3' and 5' splice sites. Inclusion of this exon leads to the introduction of a premature termination codon rendering the transcript a target of NMD.
Figure 7:
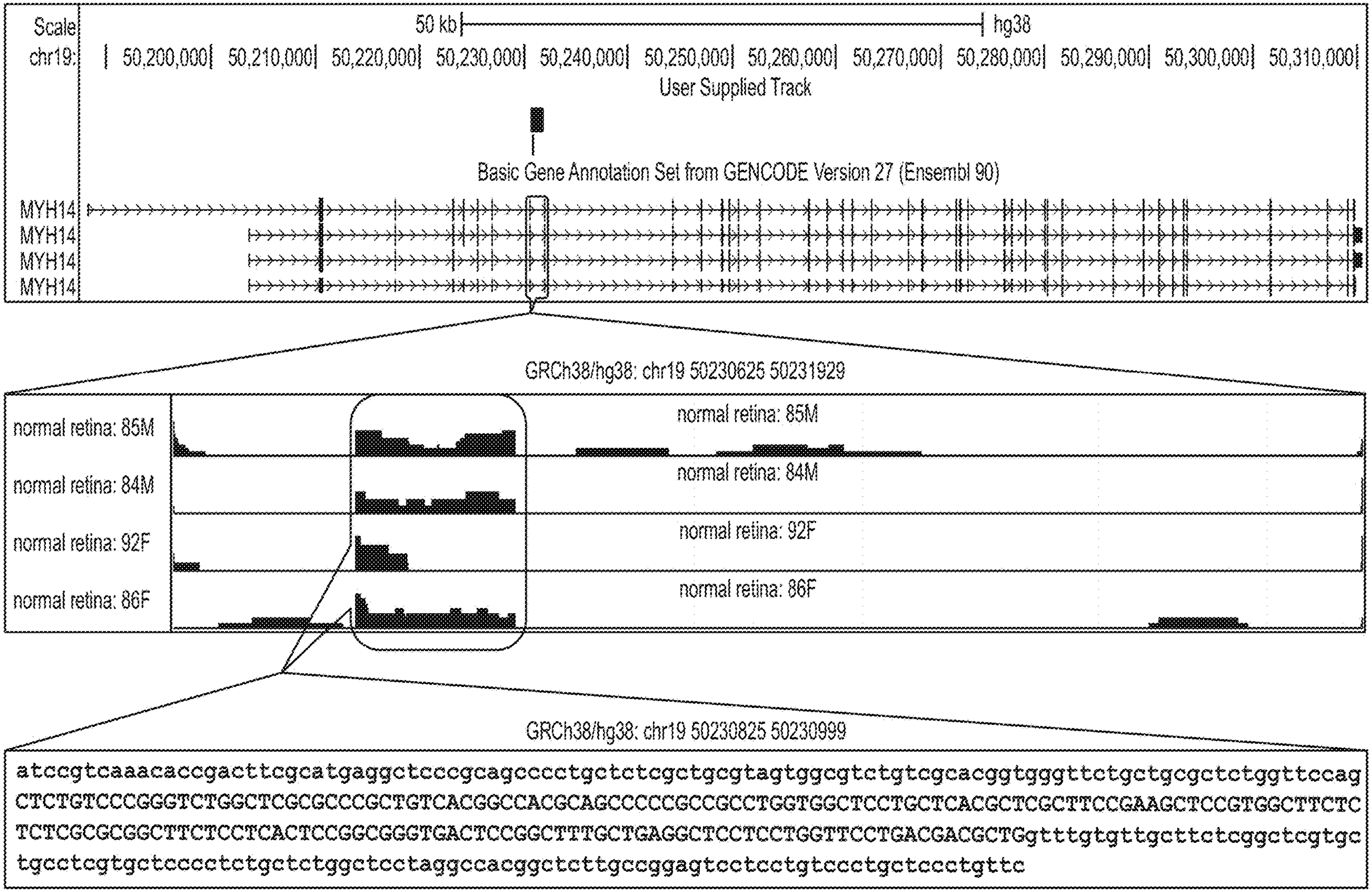
FIG. 7 depicts identification of an exemplary nonsense-mediated mRNA decay (NMD)-inducing exon in the MYH14 gene. The identification of the NMD-inducing exon in the MYH14 gene using RNA sequencing is shown, visualized in the UCSC genome browser. The upper panel shows a graphic representation of the MYH14 gene to scale. Peaks corresponding to RNA sequencing reads were identified in intron GRCh38/hg38: chr19 50230625 50231929, shown in the middle panel. Bioinformatic analysis identified an exon-like sequence (bottom panel, sequence highlighted in uppercase) flanked by 3' and 5' splice sites. Inclusion of this exon leads to the introduction of a premature termination codon rendering the transcript a target of NMD.
Figure 8:
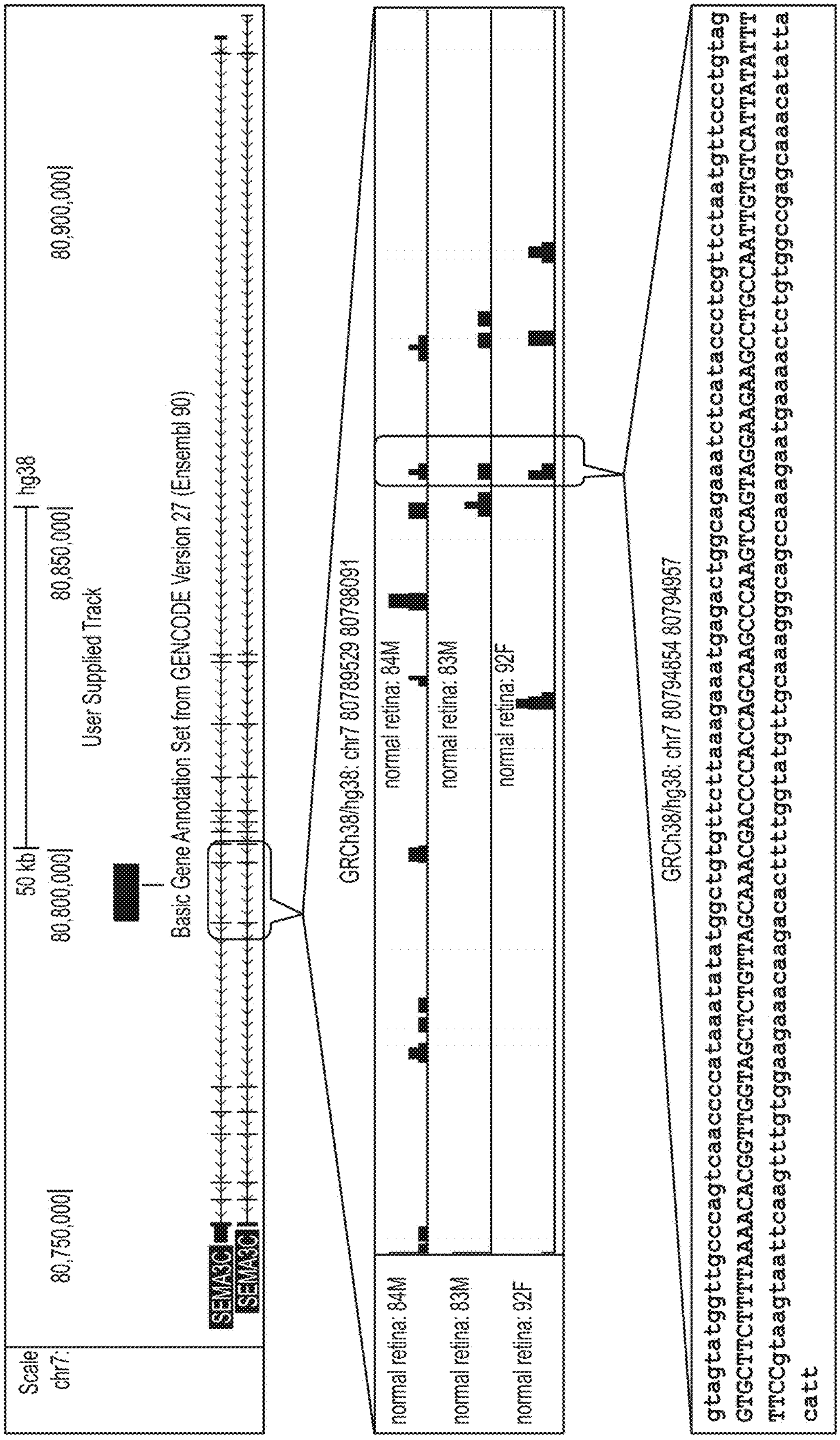
FIG. 8 depicts identification of an exemplary nonsense-mediated mRNA decay (NMD)-inducing exon in the SEMA3C gene. The identification of the NMD-inducing exon in the SEMA3C gene using RNA sequencing is shown, visualized in the UCSC genome browser. The upper panel shows a graphic representation of the SEMA3C gene to scale. Peaks corresponding to RNA sequencing reads were identified in intron GRCh38/hg38: chr7 80789529 80798091, shown in the middle panel. Bioinformatic analysis identified an exon-like sequence (bottom panel, sequence highlighted in uppercase) flanked by 3' and 5' splice sites. Inclusion of this exon leads to the introduction of a premature termination codon rendering the transcript a target of NMD.
Figure 9:
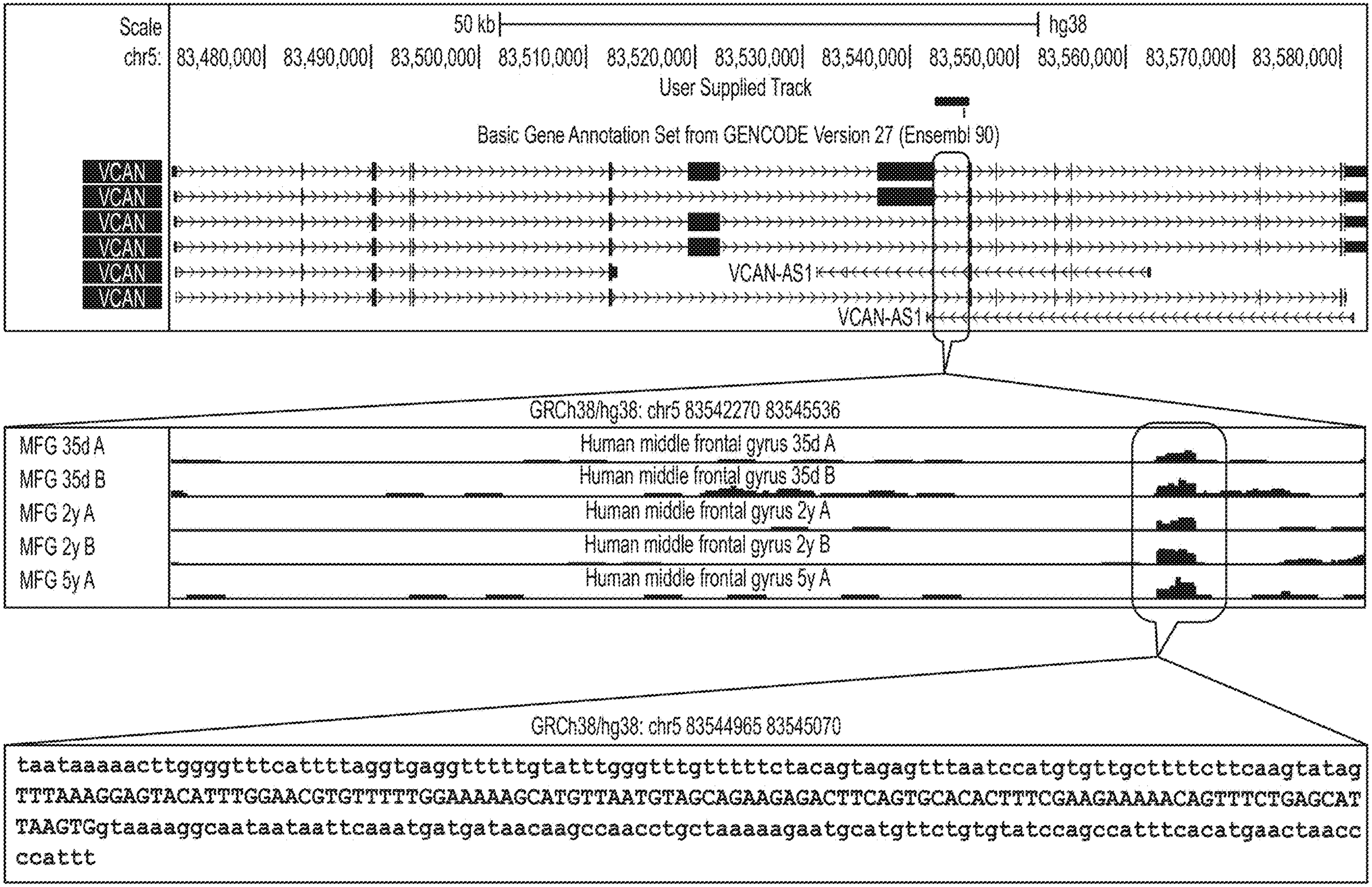
FIG. 9 depicts identification of an exemplary nonsense-mediated mRNA decay (NMD)-inducing exon in the VCAN gene. The identification of the NMD-inducing exon in the VCAN gene using RNA sequencing is shown, visualized in the UCSC genome browser. The upper panel shows a graphic representation of the VCAN gene to scale. Peaks corresponding to RNA sequencing reads were identified in intron GRCh38/hg38: chr5 83542270 83545536, shown in the middle panel. Bioinformatic analysis identified an exon-like sequence (bottom panel, sequence highlighted in uppercase) flanked by 3' and 5' splice sites. Inclusion of this exon leads to the introduction of a premature termination codon rendering the transcript a target of NMD.
Figure 10:
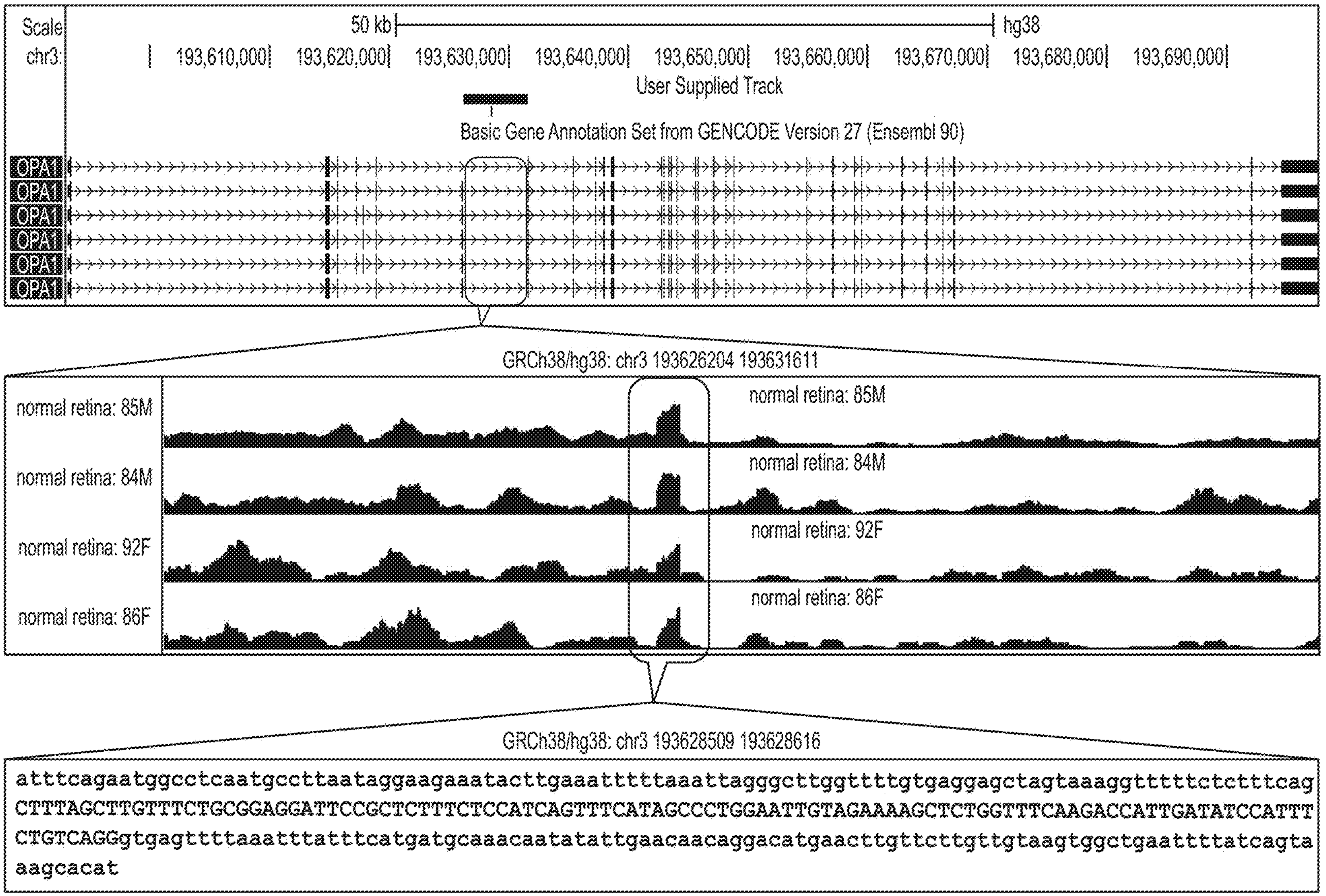
FIG. 10 depicts identification of an exemplary nonsense-mediated mRNA decay (NMD)-inducing exon in the OPA1 gene. The identification of the NMD-inducing exon in the OPA1 gene using RNA sequencing is shown, visualized in the UCSC genome browser. The upper panel shows a graphic representation of the OPA1 gene to scale. Peaks corresponding to RNA sequencing reads were identified in intron GRCh38/hg38: chr3 193626204 193631611, shown in the middle panel. Bioinformatic analysis identified an exon-like sequence (bottom panel, sequence highlighted in uppercase) flanked by 3' and 5' splice sites. Inclusion of this exon leads to the introduction of a premature termination codon rendering the transcript a target of NMD.
Figure 11:
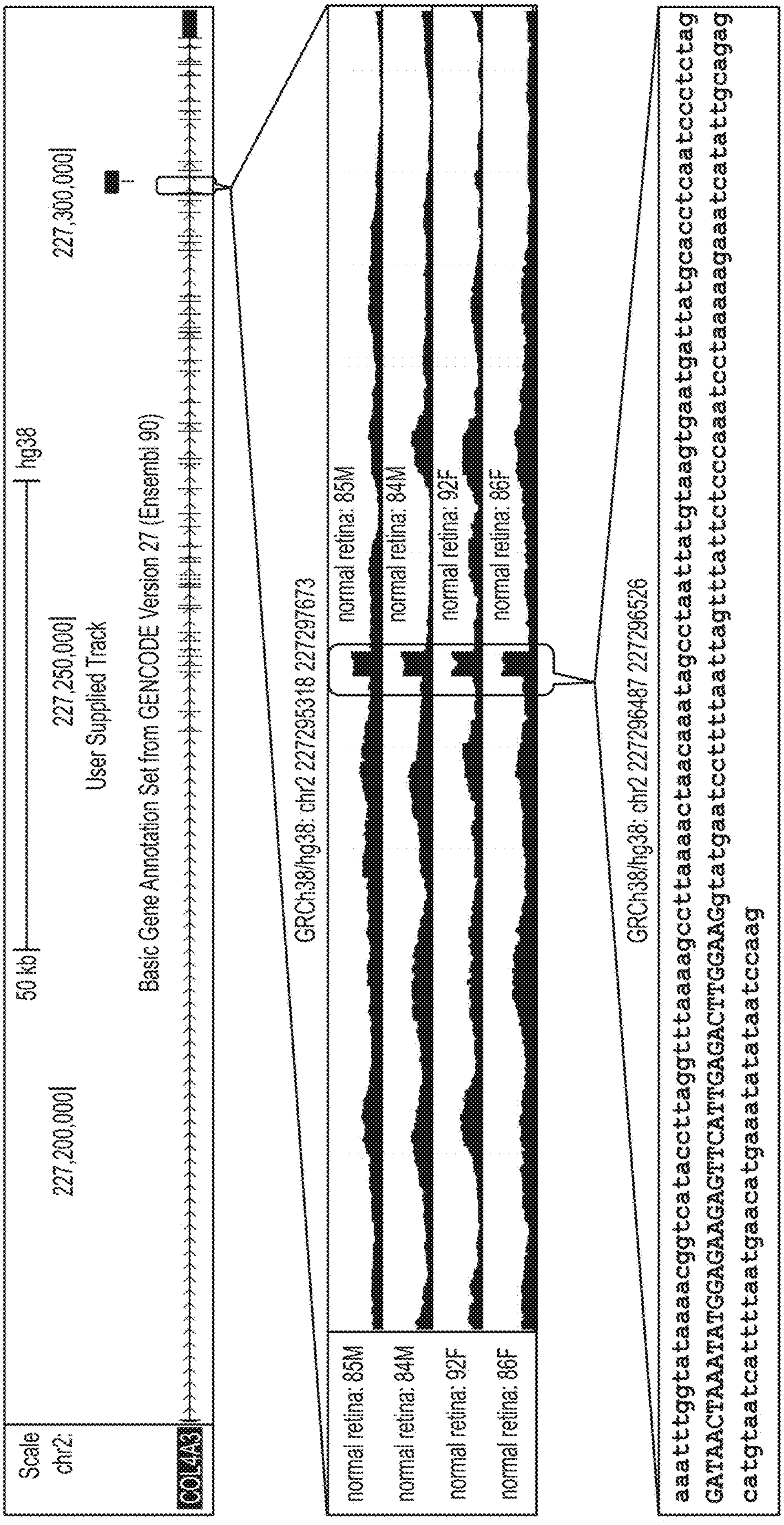
FIG. 11 depicts identification of an exemplary nonsense-mediated mRNA decay (NMD)-inducing exon in the COL4A3 gene. The identification of the NMD-inducing exon in the COL4A3 gene using RNA sequencing is shown, visualized in the UCSC genome browser. The upper panel shows a graphic representation of the COL4A3 gene to scale. Peaks corresponding to RNA sequencing reads were identified in intron GRCh38/hg38: chr2 227295318 227297673, shown in the middle panel. Bioinformatic analysis identified an exon-like sequence (bottom panel, sequence highlighted in uppercase) flanked by 3' and 5' splice sites. Inclusion of this exon leads to the introduction of a premature termination codon rendering the transcript a target of NMD.
Figure 12:
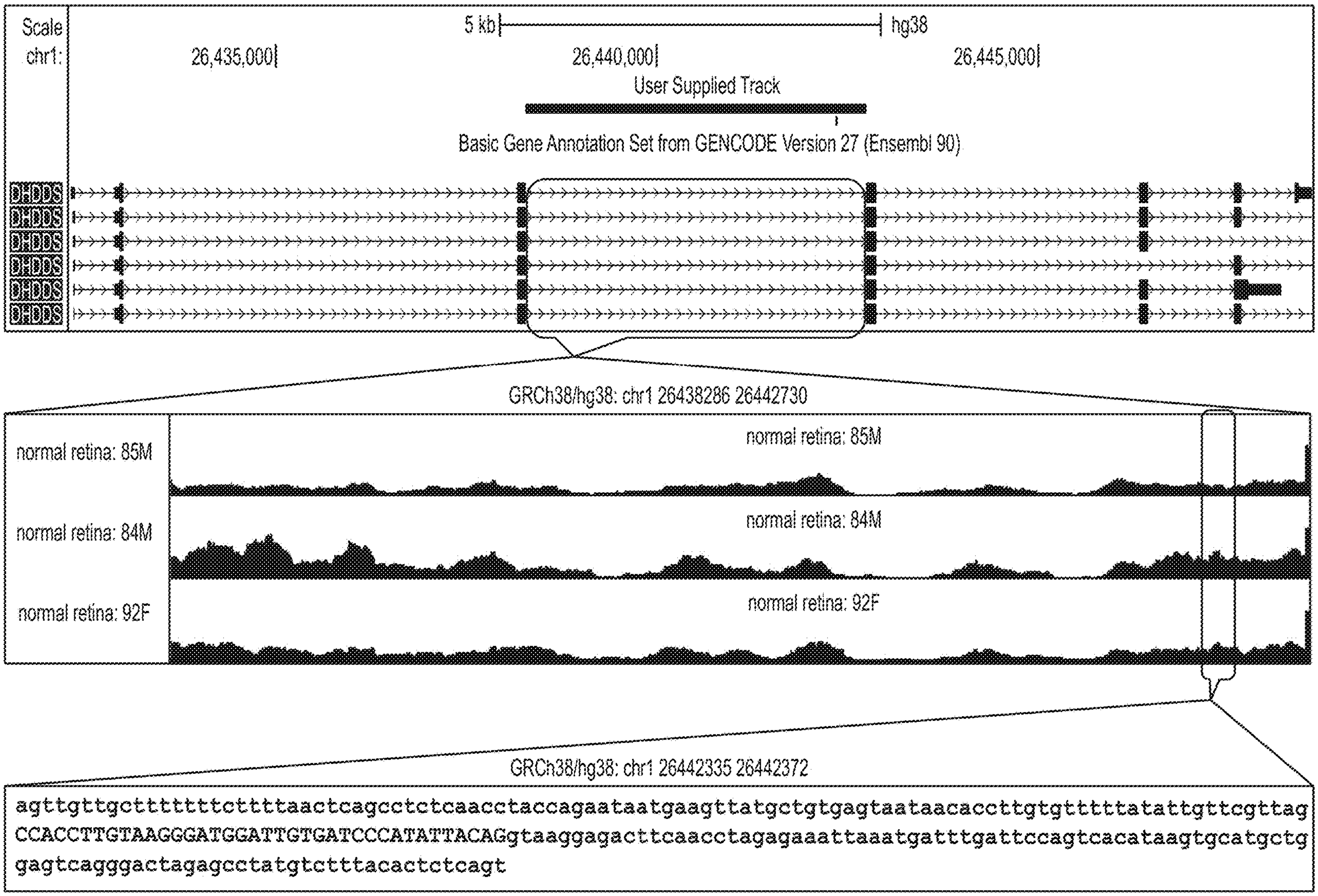
FIG. 12 depicts identification of an exemplary nonsense-mediated mRNA decay (NMD)-inducing exon in the DHDDS gene. The identification of the NMD-inducing exon in the DHDDS gene using RNA sequencing is shown, visualized in the UCSC genome browser. The upper panel shows a graphic representation of the DHDDS gene to scale. Peaks corresponding to RNA sequencing reads were identified in intron GRCh38/hg38: chr1 26438286 26442730, shown in the middle panel. Bioinformatic analysis identified an exon-like sequence (bottom panel, sequence highlighted in uppercase) flanked by 3' and 5' splice sites. Inclusion of this exon leads to the introduction of a premature termination codon rendering the transcript a target of NMD.
Figure 13:
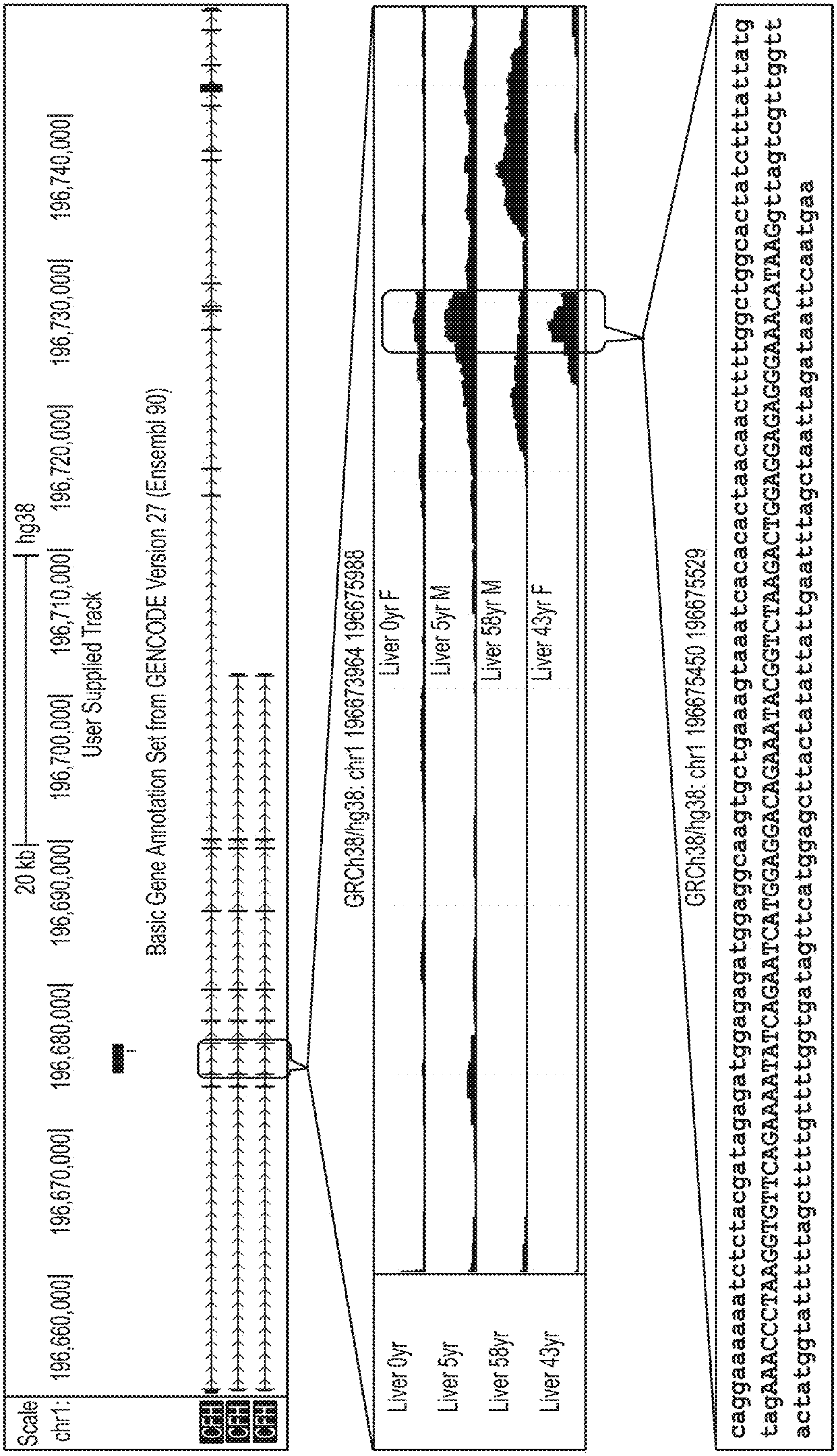
FIG. 13 depicts identification of an exemplary nonsense-mediated mRNA decay (NMD)-inducing exon in the CFH gene. The identification of the NMD-inducing exon in the CFH gene using RNA sequencing is shown, visualized in the UCSC genome browser. The upper panel shows a graphic representation of the CFH gene to scale. Peaks corresponding to RNA sequencing reads were identified in intron GRCh38/hg38: chr1 196673964 196675988, shown in the middle panel. Bioinformatic analysis identified an exon-like sequence (bottom panel, sequence highlighted in uppercase) flanked by 3' and 5' splice sites. Inclusion of this exon leads to the introduction of a premature termination codon rendering the transcript a target of NMD.
Figure 14:
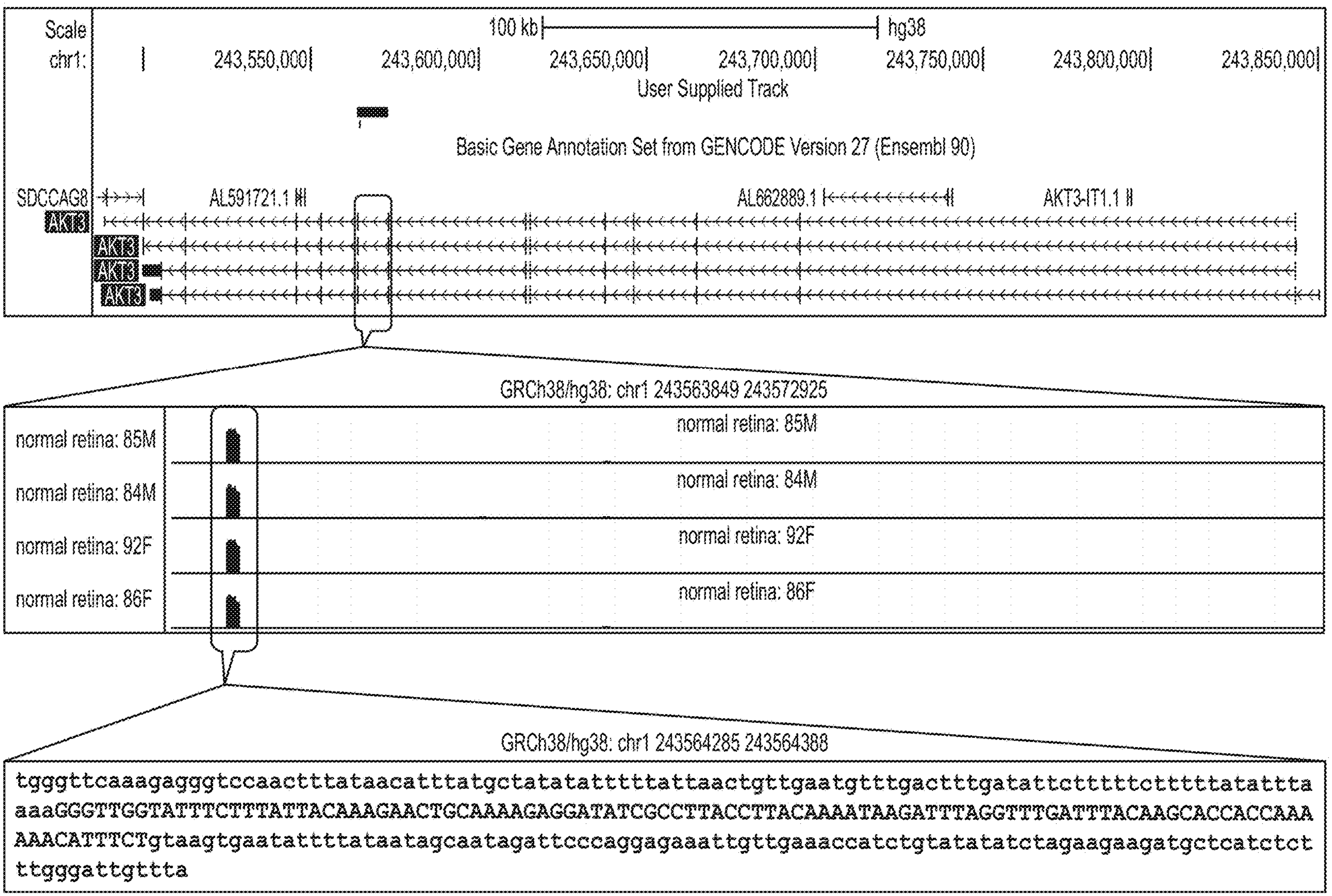
FIG. 14 depicts identification of an exemplary nonsense-mediated mRNA decay (NMD)-inducing exon in the AKT3 gene. The identification of the NMD-inducing exon in the AKT3 gene using RNA sequencing is shown, visualized in the UCSC genome browser. The upper panel shows a graphic representation of the AKT3 gene to scale. Peaks corresponding to RNA sequencing reads were identified in intron GRCh38/hg38: chr1 243563849 243572925, shown in the middle panel. Bioinformatic analysis identified an exon-like sequence (bottom panel, sequence highlighted in uppercase) flanked by 3' and 5' splice sites. Inclusion of this exon leads to the introduction of a premature termination codon rendering the transcript a target of NMD.
Figure 15:
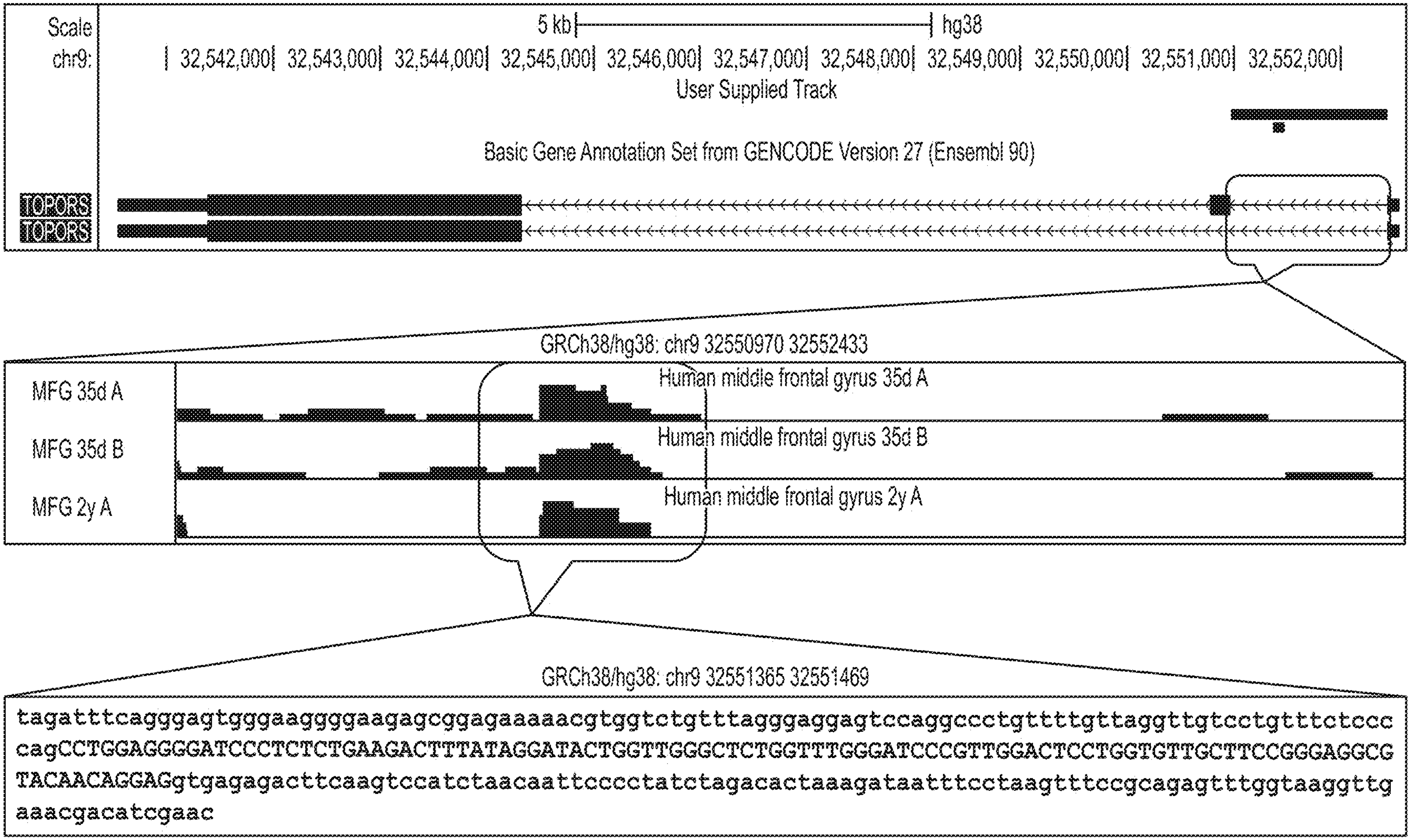
FIG. 15 depicts identification of an exemplary nonsense-mediated mRNA decay (NMD)-inducing exon in the TOPORS gene. The identification of the NMD-inducing exon in the TOPORS gene using RNA sequencing is shown, visualized in the UCSC genome browser. The upper panel shows a graphic representation of the TOPORS gene to scale. Peaks corresponding to RNA sequencing reads were identified in intron GRCh38/hg38: chr9 32550970 32552433, shown in the middle panel. Bioinformatic analysis identified an exon-like sequence (bottom panel, sequence highlighted in uppercase) flanked by 3' and 5' splice sites. Inclusion of this exon leads to the introduction of a premature termination codon rendering the transcript a target of NMD.
Figure 16:
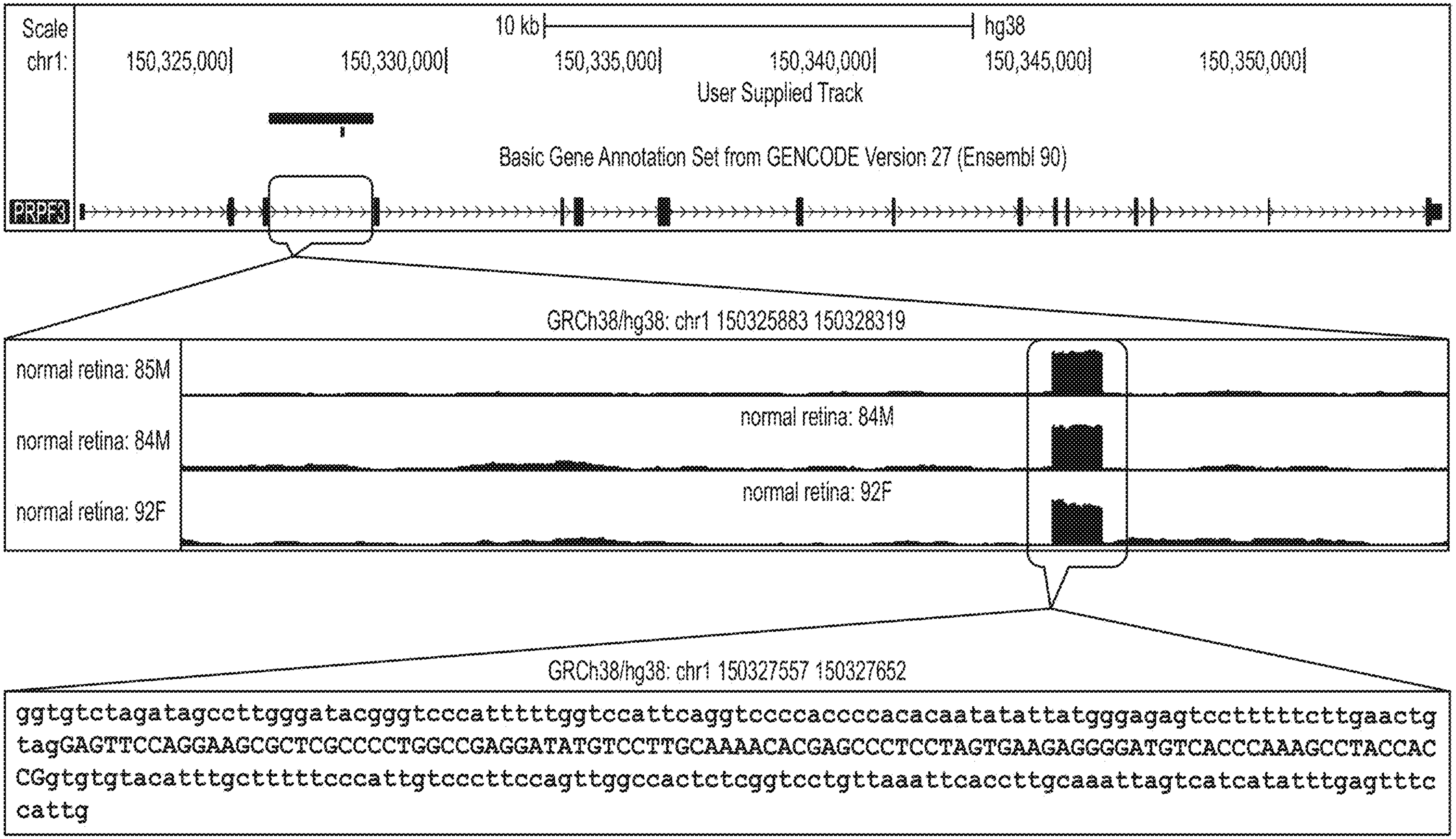
FIG. 16 depicts identification of an exemplary nonsense-mediated mRNA decay (NMD)-inducing exon in the PRPF3 gene. The identification of the NMD-inducing exon in the PRPF3 gene using RNA sequencing is shown, visualized in the UCSC genome browser. The upper panel shows a graphic representation of the PRPF3 gene to scale. Peaks corresponding to RNA sequencing reads were identified in intron GRCh38/hg38: chr1 150325883 150328319, shown in the middle panel. Bioinformatic analysis identified an exon-like sequence (bottom panel, sequence highlighted in uppercase) flanked by 3' and 5' splice sites. Inclusion of this exon leads to the introduction of a premature termination codon rendering the transcript a target of NMD.
Figure 17:
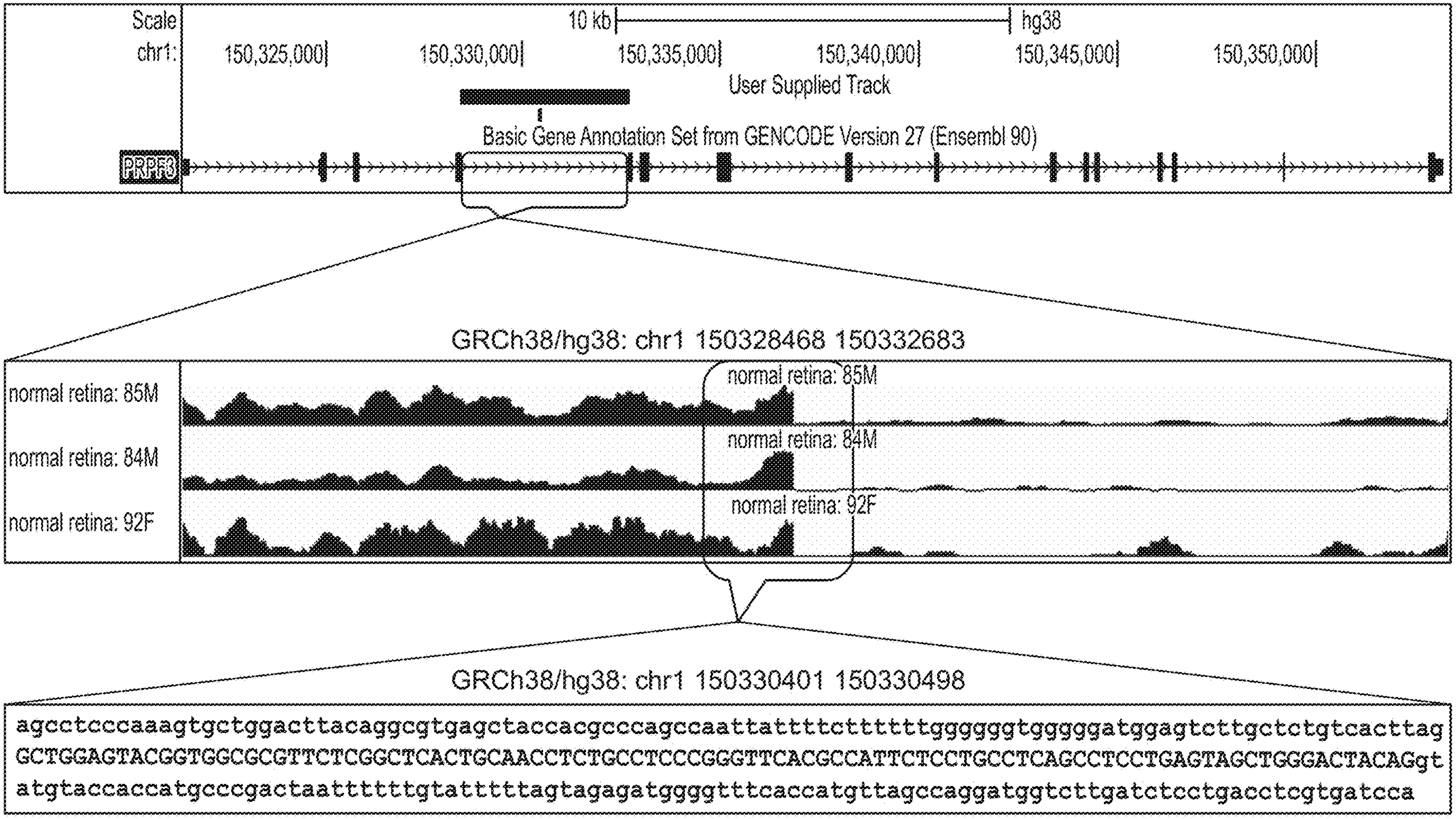
FIG. 17 depicts identification of an exemplary nonsense-mediated mRNA decay (NMD)-inducing exon in the PRPF3 gene. The identification of the NMD-inducing exon in the PRPF3 gene using RNA sequencing is shown, visualized in the UCSC genome browser. The upper panel shows a graphic representation of the PRPF3 gene to scale. Peaks corresponding to RNA sequencing reads were identified in intron GRCh38/hg38: chr1 150328468 150332683, shown in the middle panel. Bioinformatic analysis identified an exon-like sequence (bottom panel, sequence highlighted in uppercase) flanked by 3' and 5' splice sites. Inclusion of this exon leads to the introduction of a premature termination codon rendering the transcript a target of NMD.
Figure 18:
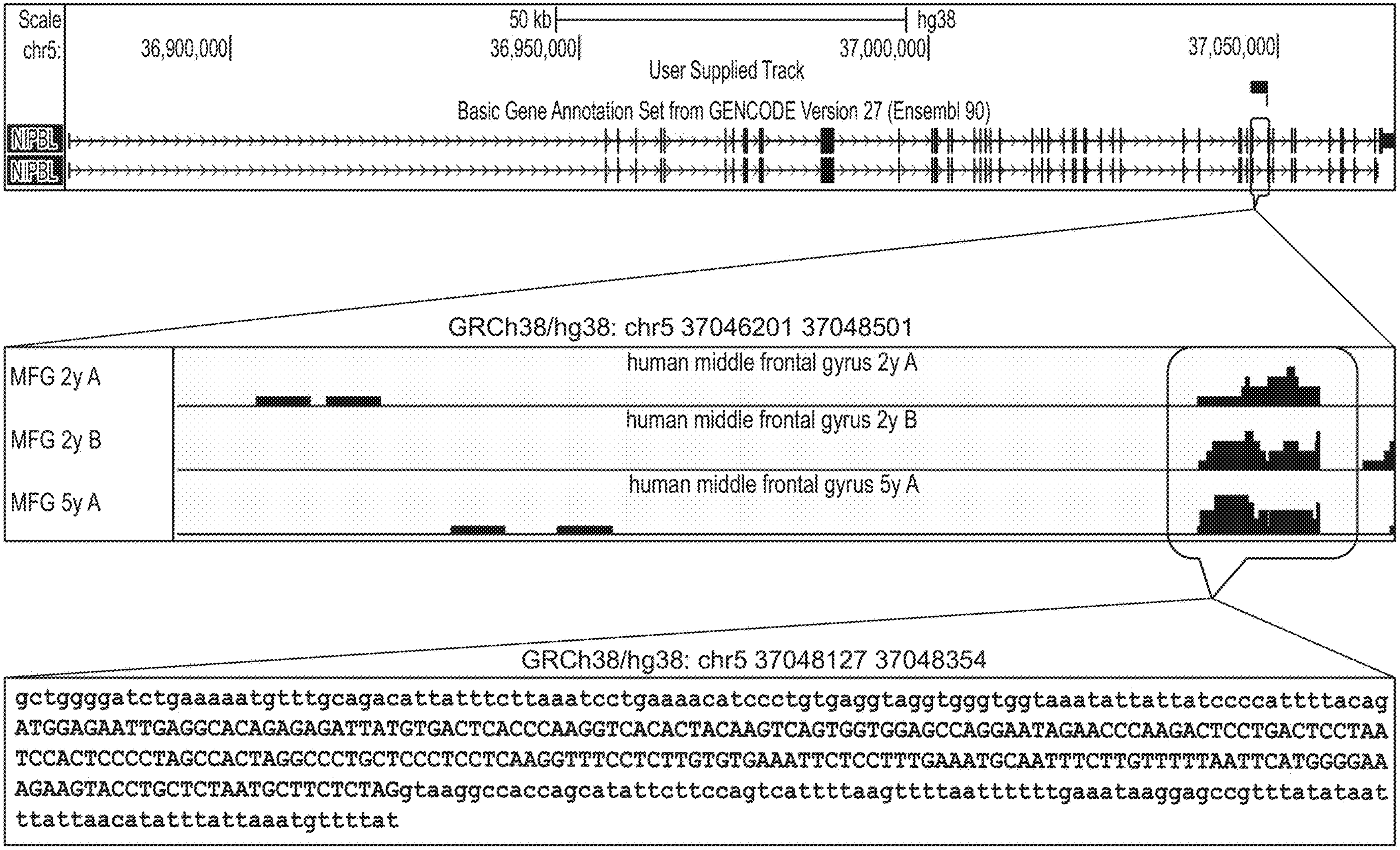
FIG. 18 depicts identification of an exemplary nonsense-mediated mRNA decay (NMD)-inducing exon in the NIPBL gene. The identification of the NMD-inducing exon in the NIPBL gene using RNA sequencing is shown, visualized in the UCSC genome browser. The upper panel shows a graphic representation of the NIPBL gene to scale. Peaks corresponding to RNA sequencing reads were identified in intron GRCh38/hg38: chr5 37046201 37048501, shown in the middle panel. Bioinformatic analysis identified an exon-like sequence (bottom panel, sequence highlighted in uppercase) flanked by 3' and 5' splice sites. Inclusion of this exon leads to the introduction of a premature termination codon rendering the transcript a target of NMD.
Figure 19:
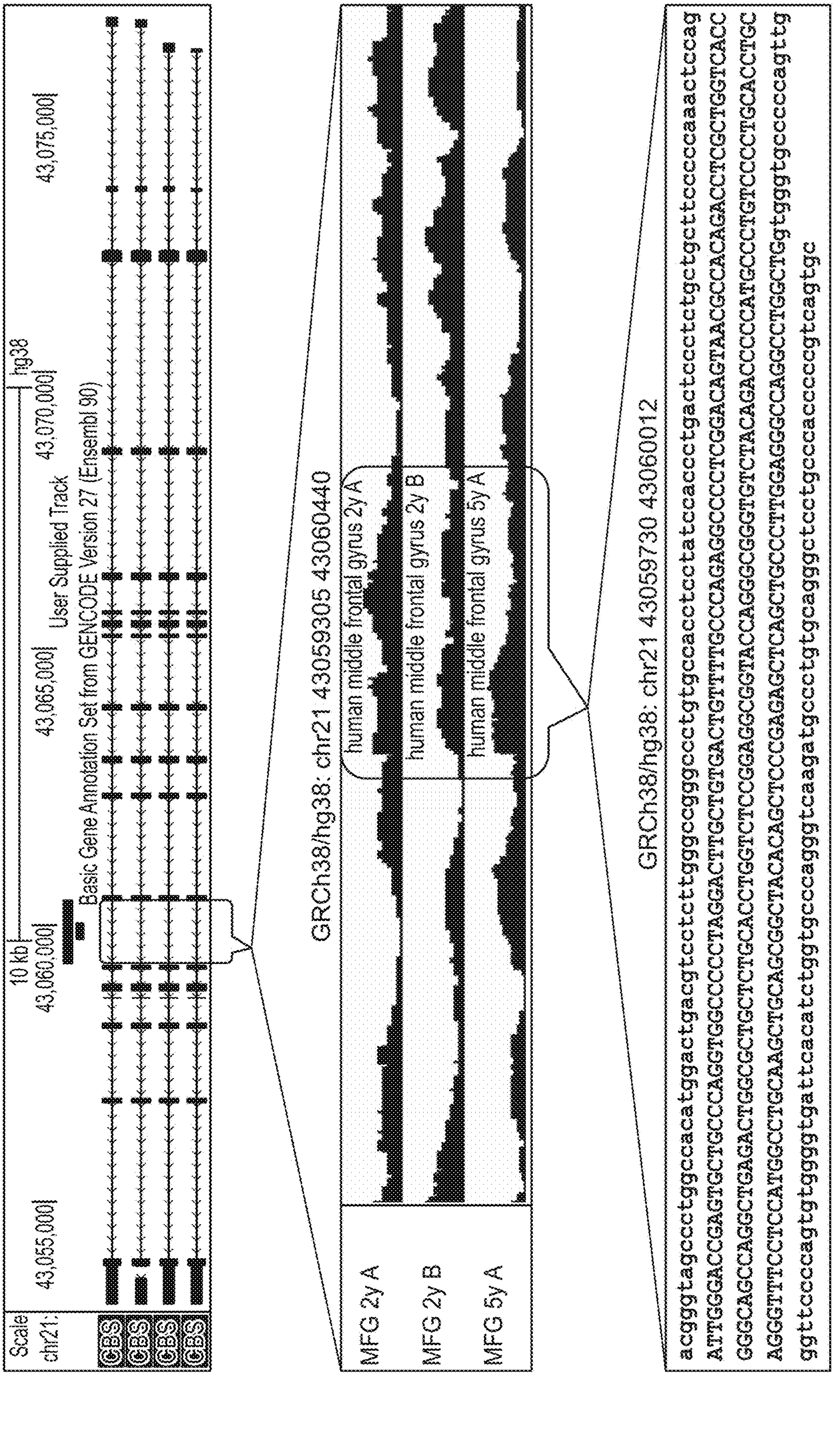
FIG. 19 depicts identification of an exemplary nonsense-mediated mRNA decay (NMD)-inducing exon in the CBS gene. The identification of the NMD-inducing exon in the CBS gene using RNA sequencing is shown, visualized in the UCSC genome browser. The upper panel shows a graphic representation of the CBS gene to scale. Peaks corresponding to RNA sequencing reads were identified in intron GRCh38/hg38: chr21 43059305 43060440, shown in the middle panel. Bioinformatic analysis identified an exon-like sequence (bottom panel, sequence highlighted in uppercase) flanked by 3' and 5' splice sites. Inclusion of this exon leads to the introduction of a premature termination codon rendering the transcript a target of NMD.
Figure 20:
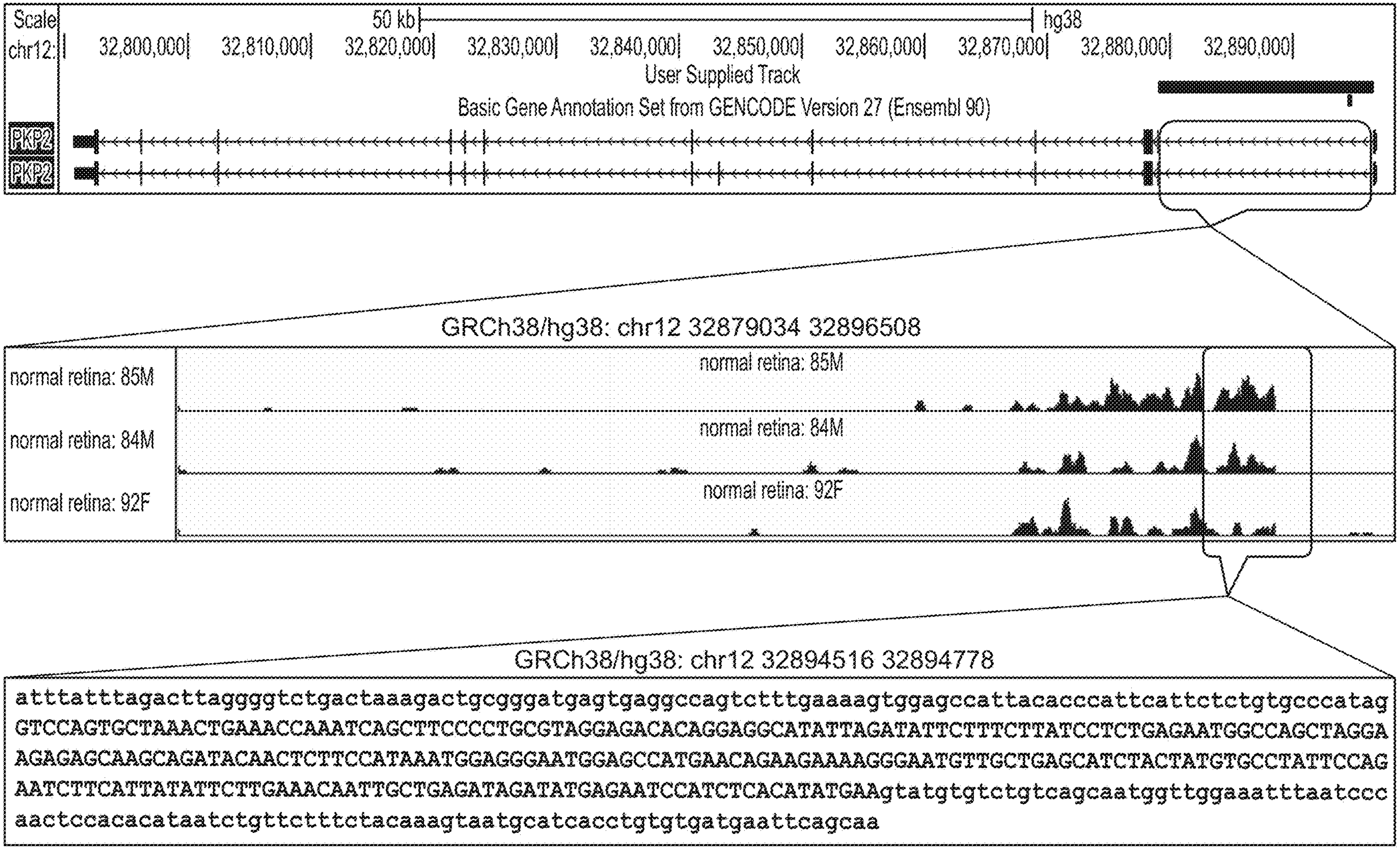
FIG. 20 depicts identification of an exemplary nonsense-mediated mRNA decay (NMD)-inducing exon in the PKP2 gene. The identification of the NMD-inducing exon in the PKP2 gene using RNA sequencing is shown, visualized in the UCSC genome browser. The upper panel shows a graphic representation of the PKP2 gene to scale. Peaks corresponding to RNA sequencing reads were identified in intron GRCh38/hg38: chr12 32879034 32896508, shown in the middle panel. Bioinformatic analysis identified an exon-like sequence (bottom panel, sequence highlighted in uppercase) flanked by 3' and 5' splice sites. Inclusion of this exon leads to the introduction of a premature termination codon rendering the transcript a target of NMD.
Figure 21:
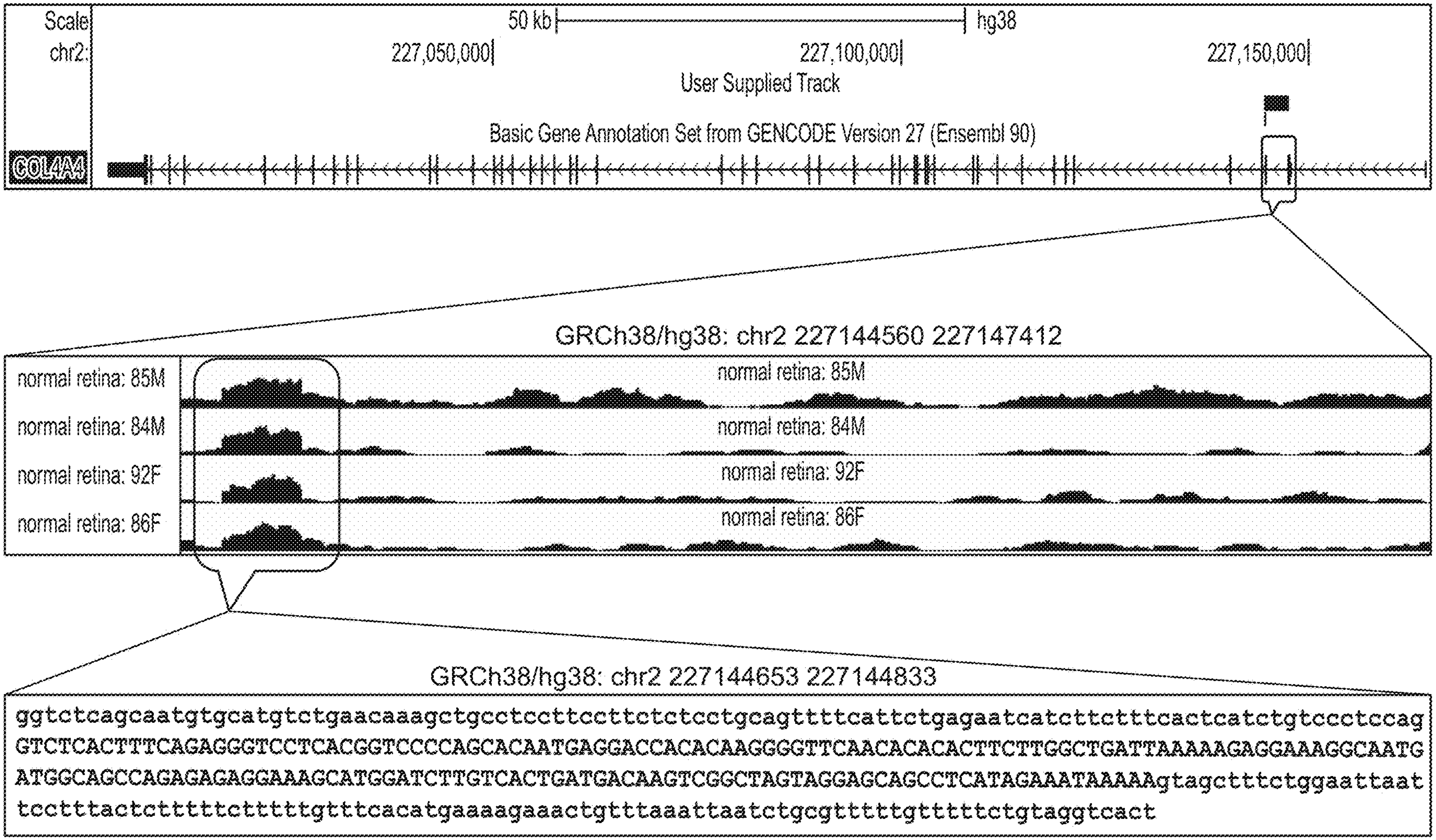
FIG. 21 depicts identification of an exemplary nonsense-mediated mRNA decay (NMD)-inducing exon in the COL4A4 gene. The identification of the NMD-inducing exon in the COL4A4 gene using RNA sequencing is shown, visualized in the UCSC genome browser. The upper panel shows a graphic representation of the COL4A4 gene to scale. Peaks corresponding to RNA sequencing reads were identified in intron GRCh38/hg38: chr2 227144560 227147412, shown in the middle panel. Bioinformatic analysis identified an exon-like sequence (bottom panel, sequence highlighted in uppercase) flanked by 3' and 5' splice sites. Inclusion of this exon leads to the introduction of a premature termination codon rendering the transcript a target of NMD.
Figure 22:
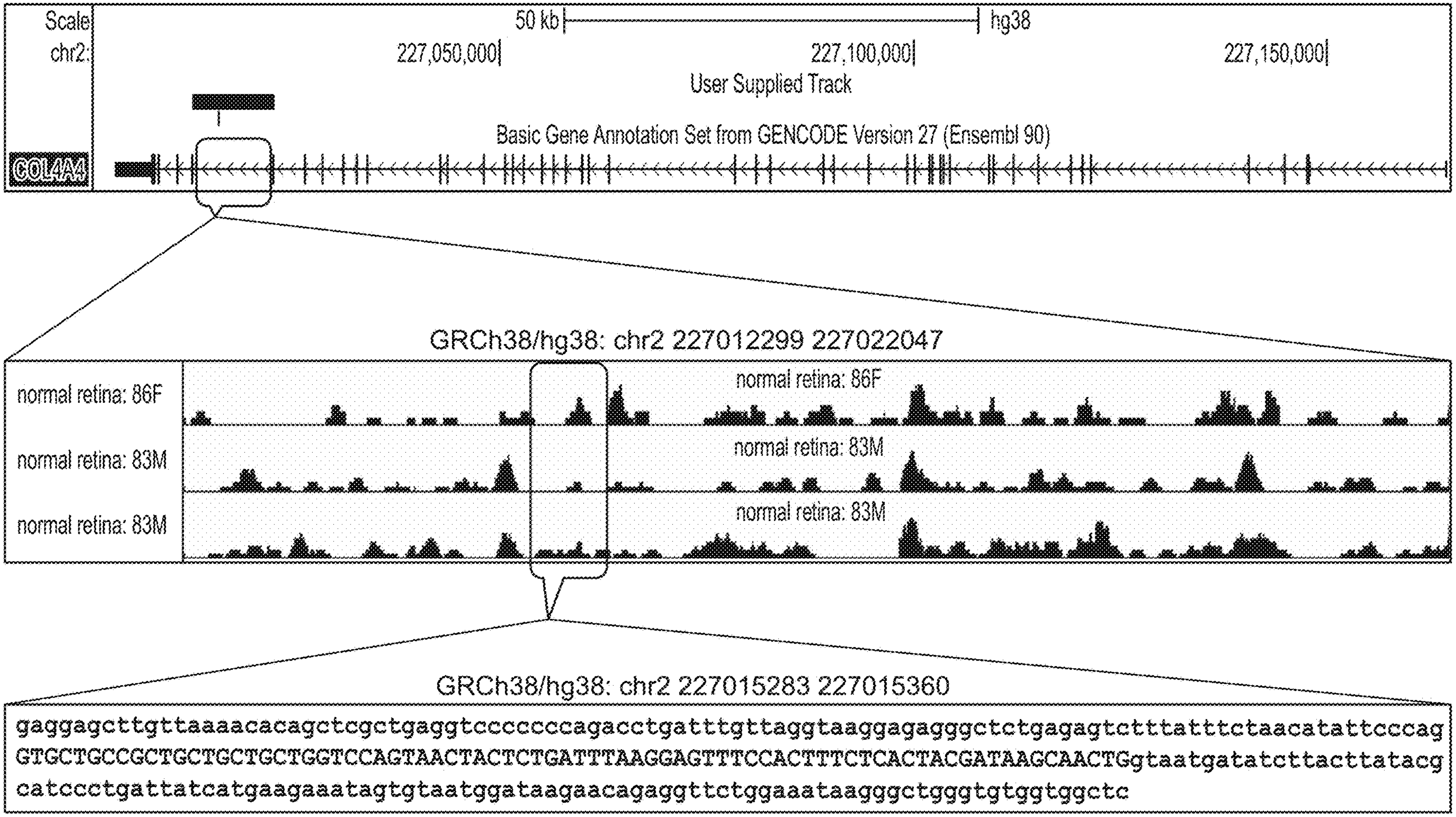
FIG. 22 depicts identification of an exemplary nonsense-mediated mRNA decay (NMD)-inducing exon in the COL4A4 gene. The identification of the NMD-inducing exon in the COL4A4 gene using RNA sequencing is shown, visualized in the UCSC genome browser. The upper panel shows a graphic representation of the COL4A4 gene to scale. Peaks corresponding to RNA sequencing reads were identified in intron GRCh38/hg38: chr2 227012299 227022047, shown in the middle panel. Bioinformatic analysis identified an exon-like sequence (bottom panel, sequence highlighted in uppercase) flanked by 3' and 5' splice sites. Inclusion of this exon leads to the introduction of a premature termination codon rendering the transcript a target of NMD.
Figure 23:
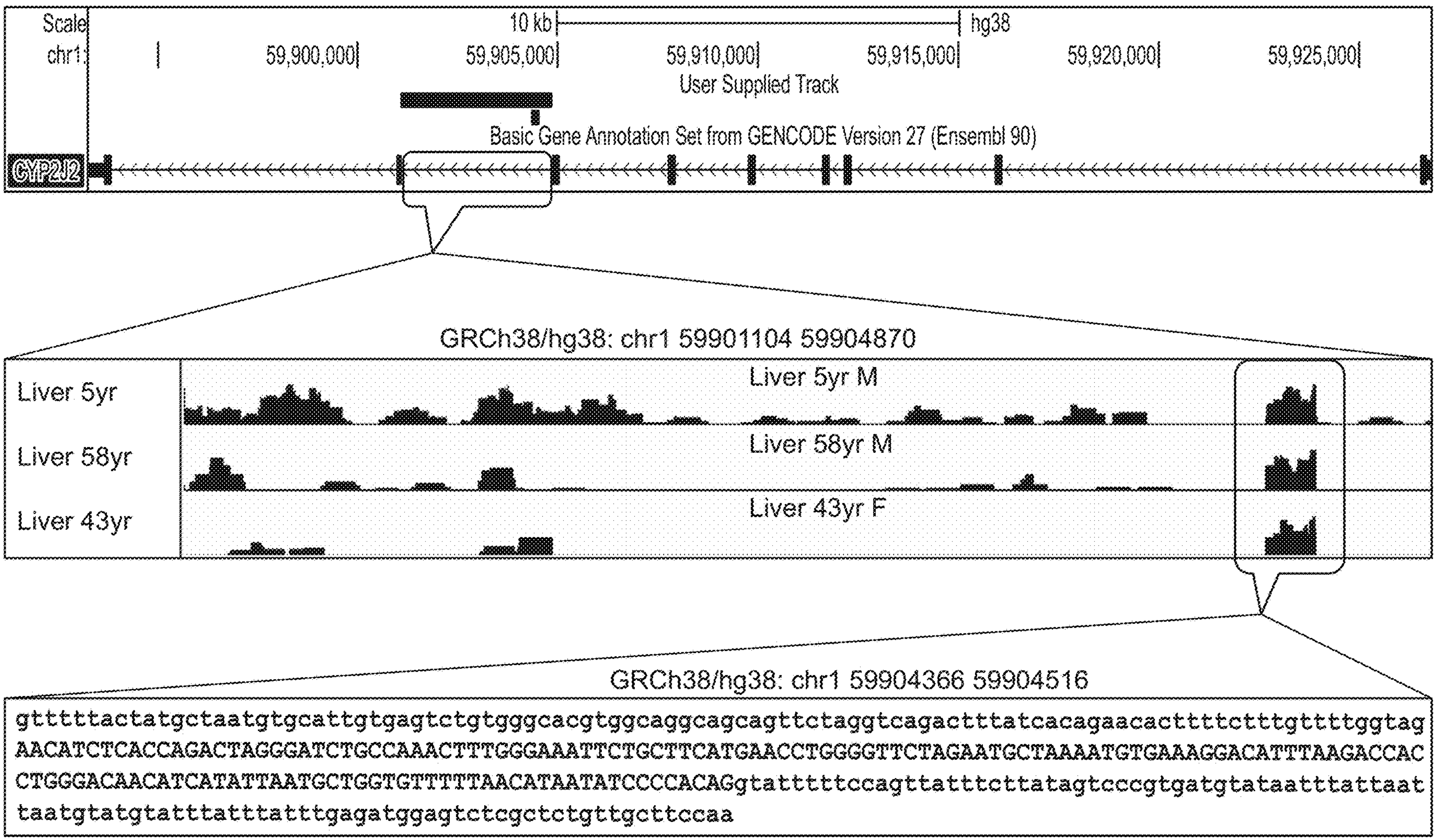
FIG. 23 depicts identification of an exemplary nonsense-mediated mRNA decay (NMD)-inducing exon in the CYP2J2 gene. The identification of the NMD-inducing exon in the CYP2J2 gene using RNA sequencing is shown, visualized in the UCSC genome browser. The upper panel shows a graphic representation of the CYP2J2 gene to scale. Peaks corresponding to RNA sequencing reads were identified in intron GRCh38/hg38: chr1 59901104 59904870, shown in the middle panel. Bioinformatic analysis identified an exon-like sequence (bottom panel, sequence highlighted in uppercase) flanked by 3' and 5' splice sites. Inclusion of this exon leads to the introduction of a premature termination codon rendering the transcript a target of NMD.
Figure 24:
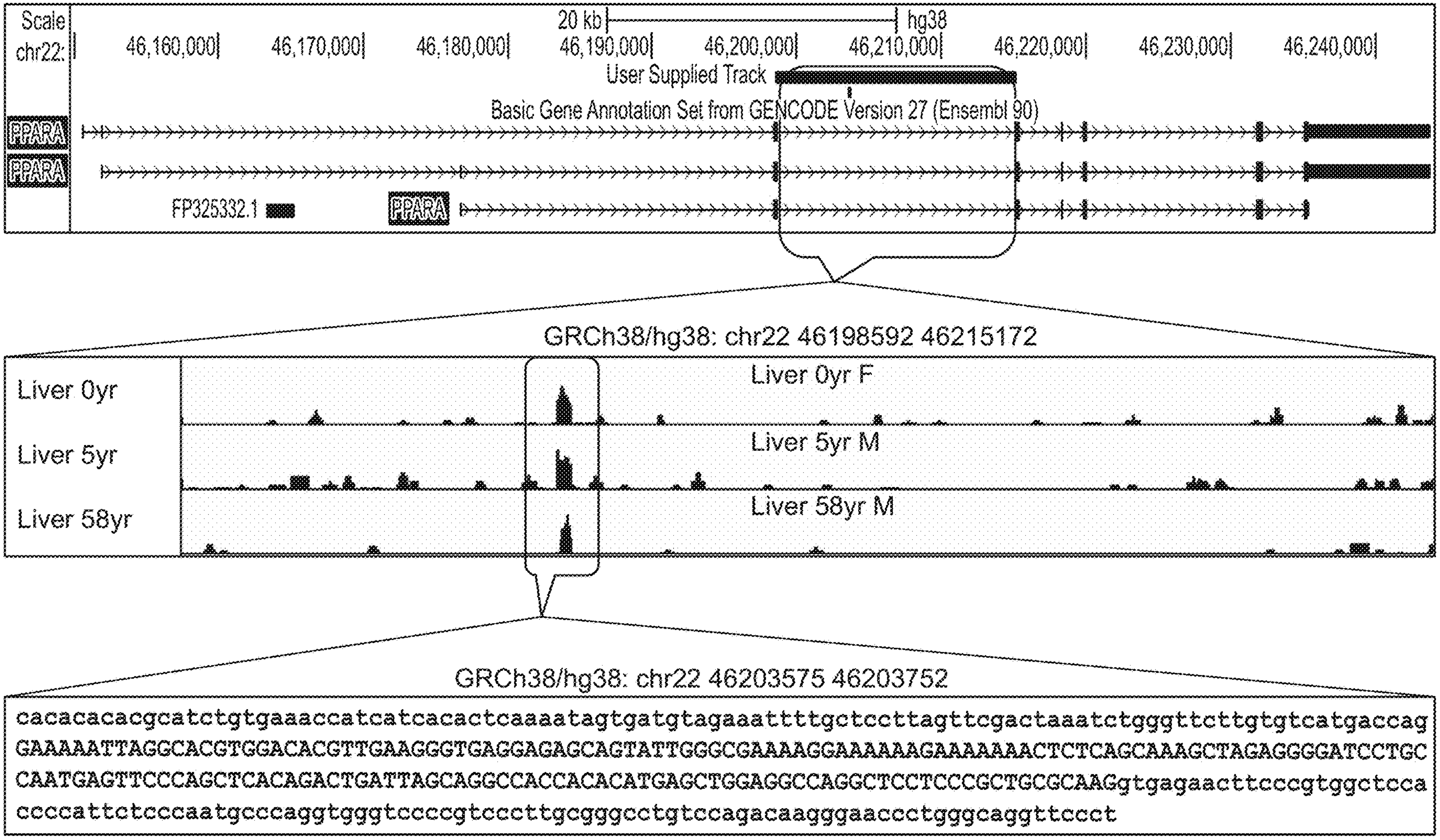
FIG. 24 depicts identification of an exemplary nonsense-mediated mRNA decay (NMD)-inducing exon in the PPARA gene. The identification of the NMD-inducing exon in the PPARA gene using RNA sequencing is shown, visualized in the UCSC genome browser. The upper panel shows a graphic representation of the PPARA gene to scale. Peaks corresponding to RNA sequencing reads were identified in intron GRCh38/hg38: chr22 46198592 46215172, shown in the middle panel. Bioinformatic analysis identified an exon-like sequence (bottom panel, sequence highlighted in uppercase) flanked by 3' and 5' splice sites. Inclusion of this exon leads to the introduction of a premature termination codon rendering the transcript a target of NMD.
Figure 25:
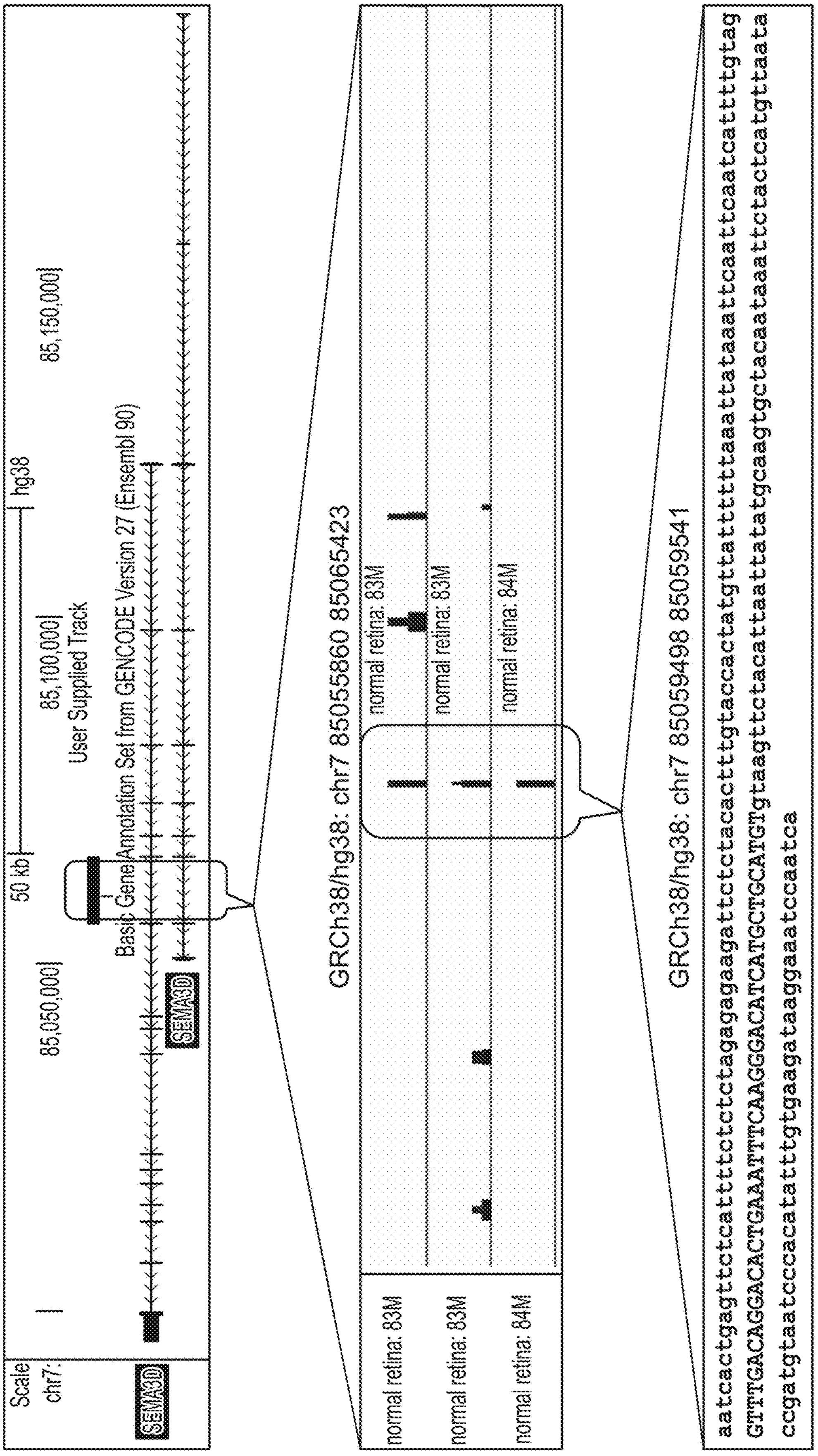
FIG. 25 depicts identification of an exemplary nonsense-mediated mRNA decay (NMD)-inducing exon in the SEMA3D gene. The identification of the NMD-inducing exon in the SEMA3D gene using RNA sequencing is shown, visualized in the UCSC genome browser. The upper panel shows a graphic representation of the SEMA3D gene to scale. Peaks corresponding to RNA sequencing reads were identified in intron GRCh38/hg38: chr7 85055860 85065423, shown in the middle panel. Bioinformatic analysis identified an exon-like sequence (bottom panel, sequence highlighted in uppercase) flanked by 3' and 5' splice sites. Inclusion of this exon leads to the introduction of a premature termination codon rendering the transcript a target of NMD.
Figure 26:
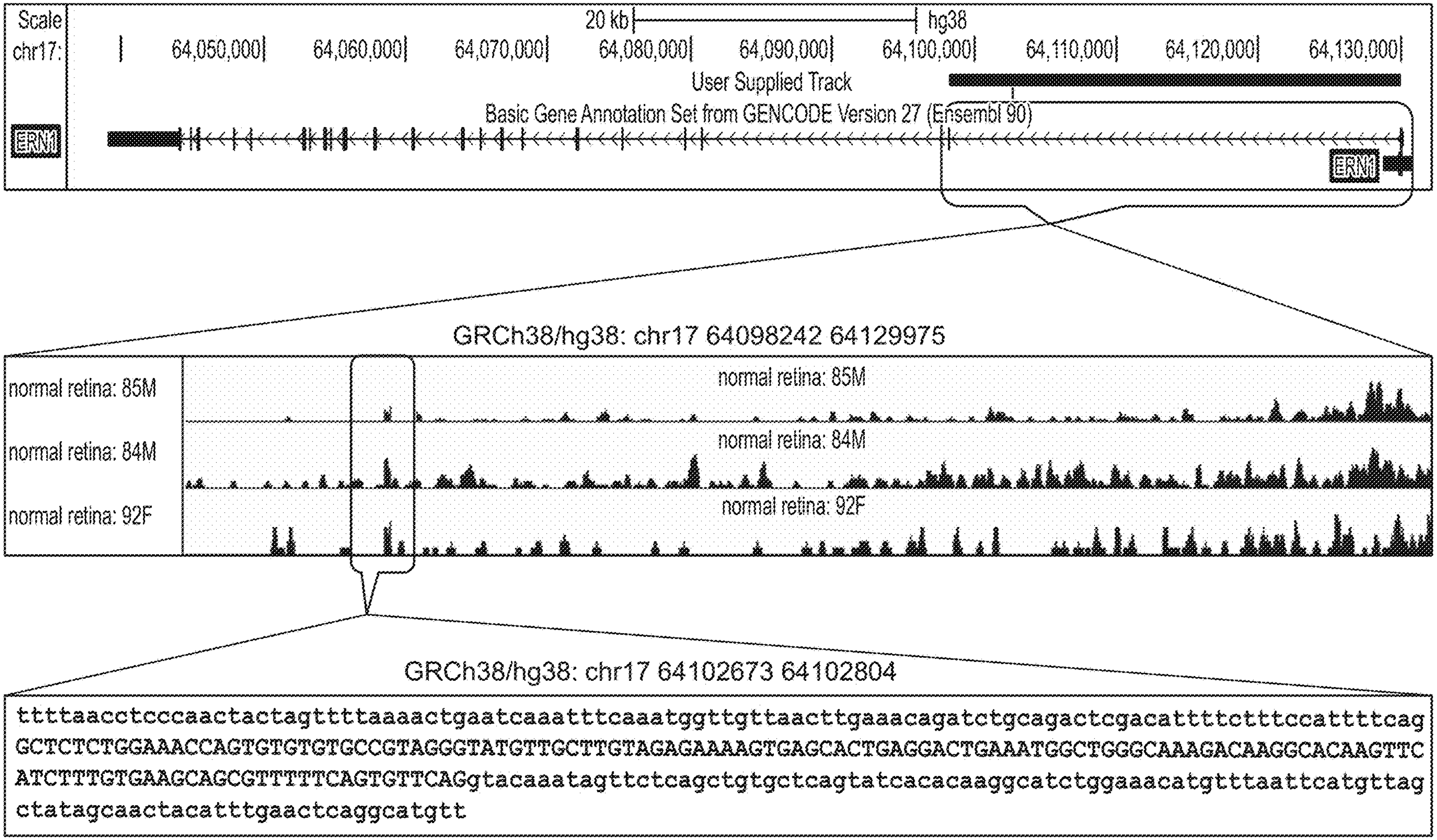
FIG. 26 depicts identification of an exemplary nonsense-mediated mRNA decay (NMD)-inducing exon in the ERN1 gene. The identification of the NMD-inducing exon in the ERN1 gene using RNA sequencing is shown, visualized in the UCSC genome browser. The upper panel shows a graphic representation of the ERN1 gene to scale. Peaks corresponding to RNA sequencing reads were identified in intron GRCh38/hg38: chr17 64098242 64129975, shown in the middle panel. Bioinformatic analysis identified an exon-like sequence (bottom panel, sequence highlighted in uppercase) flanked by 3' and 5' splice sites. Inclusion of this exon leads to the introduction of a premature termination codon rendering the transcript a target of NMD.
Figure 27:
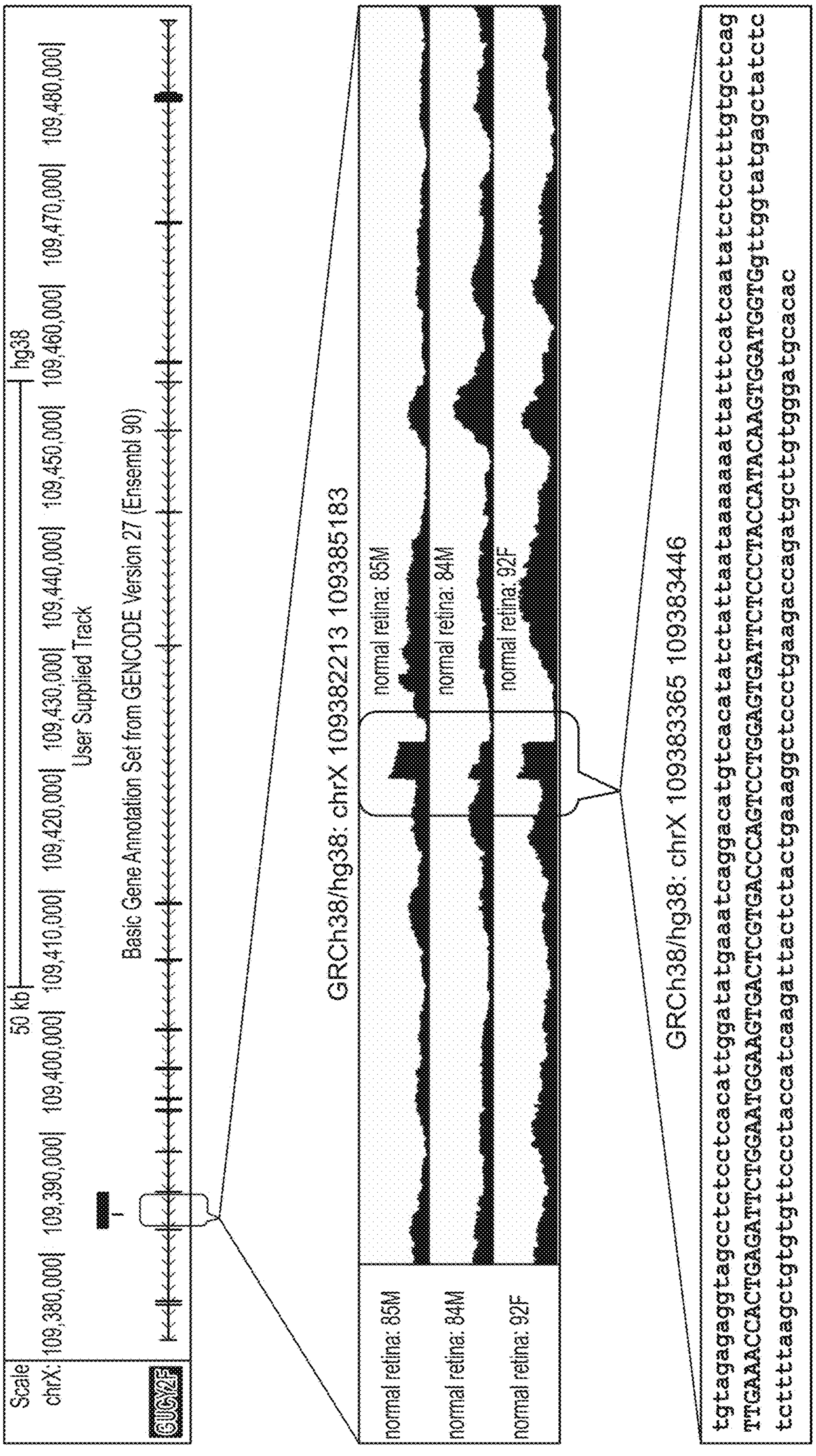
FIG. 27 depicts identification of an exemplary nonsense-mediated mRNA decay (NMD)-inducing exon in the GUCY2F gene. The identification of the NMD-inducing exon in the GUCY2F gene using RNA sequencing is shown, visualized in the UCSC genome browser. The upper panel shows a graphic representation of the GUCY2F gene to scale. Peaks corresponding to RNA sequencing reads were identified in intron GRCh38/hg38: chrX 109382213 109385183, shown in the middle panel. Bioinformatic analysis identified an exon-like sequence (bottom panel, sequence highlighted in uppercase) flanked by 3' and 5' splice sites. Inclusion of this exon leads to the introduction of a premature termination codon rendering the transcript a target of NMD.
Figure 28:
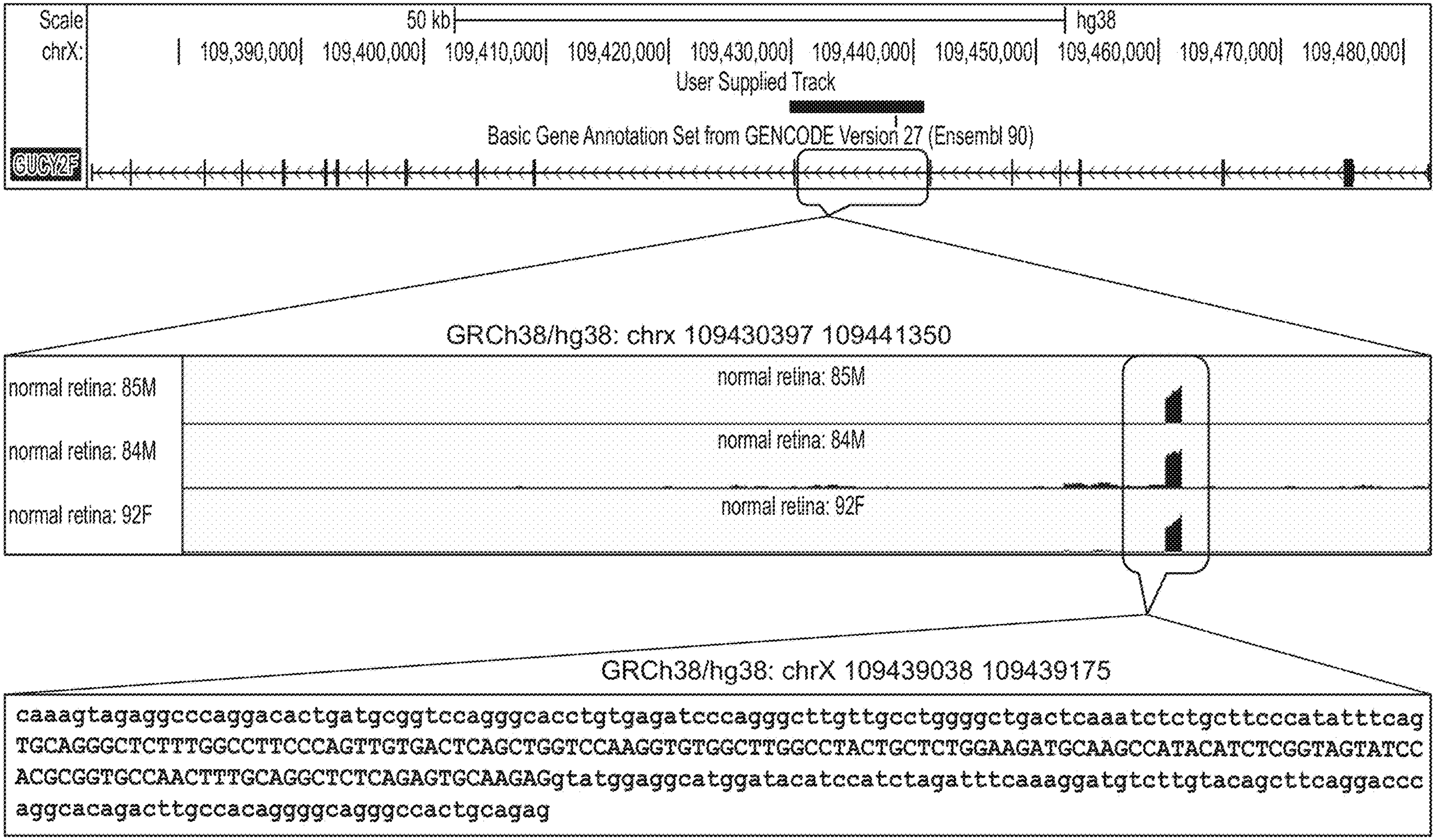
FIG. 28 depicts identification of an exemplary nonsense-mediated mRNA decay (NMD)-inducing exon in the GUCY2F gene. The identification of the NMD-inducing exon in the GUCY2F gene using RNA sequencing is shown, visualized in the UCSC genome browser. The upper panel shows a graphic representation of the GUCY2F gene to scale. Peaks corresponding to RNA sequencing reads were identified in intron GRCh38/hg38: chrx 109430397 109441350, shown in the middle panel. Bioinformatic analysis identified an exon-like sequence (bottom panel, sequence highlighted in uppercase) flanked by 3' and 5' splice sites. Inclusion of this exon leads to the introduction of a premature termination codon rendering the transcript a target of NMD.
Figure 29:
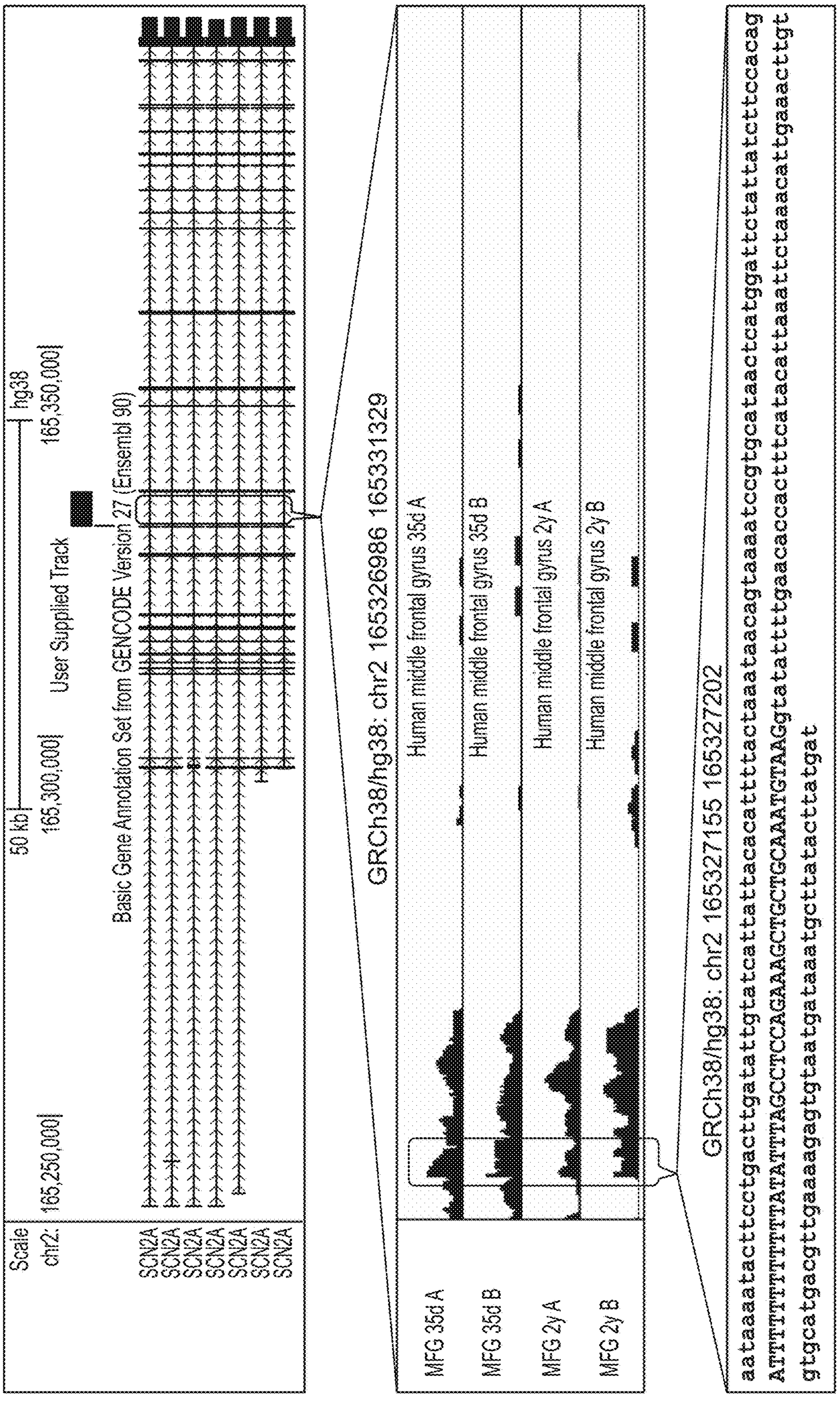
FIG. 29 depicts identification of an exemplary nonsense-mediated mRNA decay (NMD)-inducing exon in the SCN2A gene. The identification of the NMD-inducing exon in the SCN2A gene using RNA sequencing is shown, visualized in the UCSC genome browser. The upper panel shows a graphic representation of the SCN2A gene to scale. Peaks corresponding to RNA sequencing reads were identified in intron GRCh38/hg38: chr2 165326986 165331329, shown in the middle panel. Bioinformatic analysis identified an exon-like sequence (bottom panel, sequence highlighted in uppercase) flanked by 3' and 5' splice sites. Inclusion of this exon leads to the introduction of a premature termination codon rendering the transcript a target of NMD.
Figure 30:
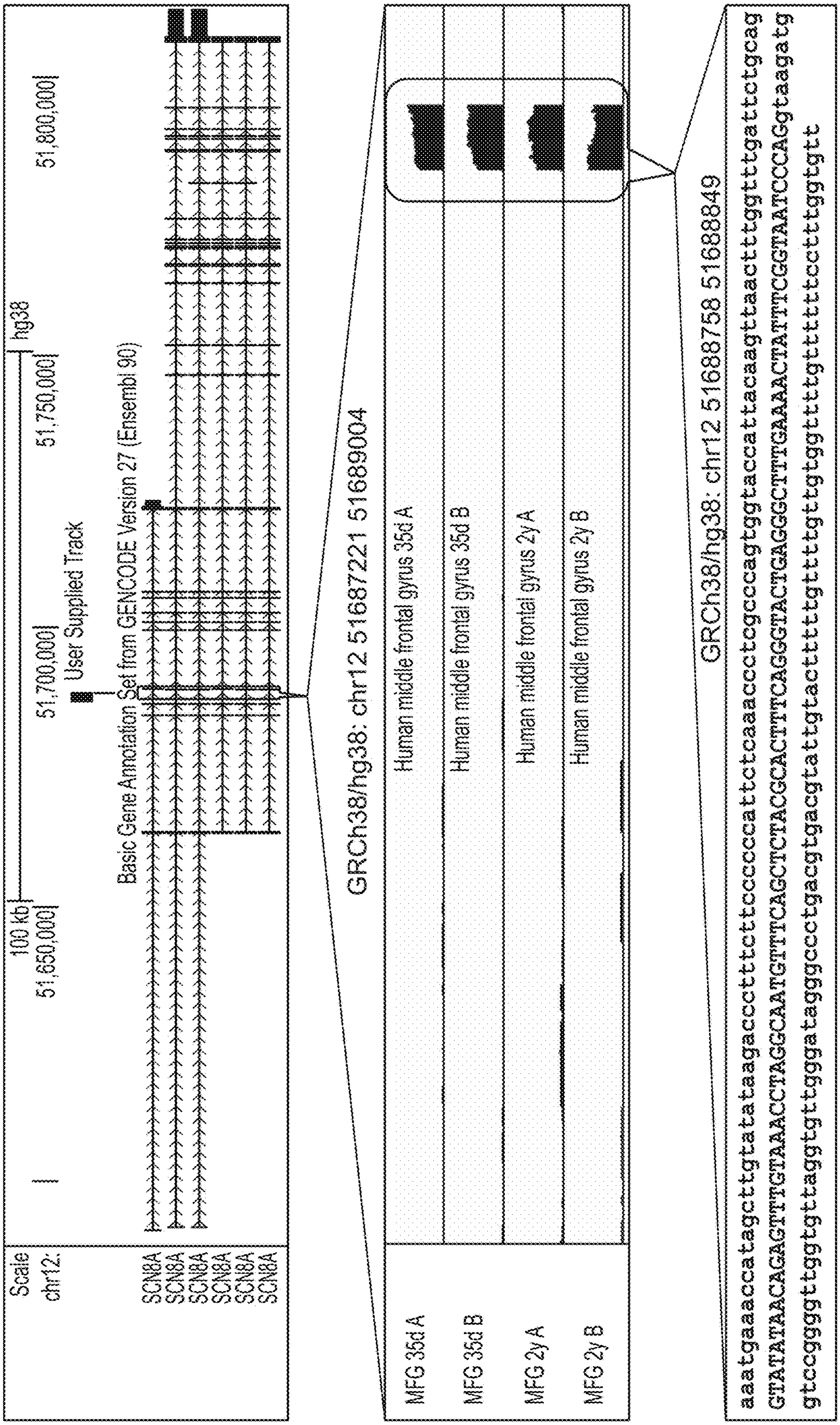
FIG. 30 depicts identification of an exemplary nonsense-mediated mRNA decay (NMD)-inducing exon in the SCN8A gene. The identification of the NMD-inducing exon in the SCN8A gene using RNA sequencing is shown, visualized in the UCSC genome browser. The upper panel shows a graphic representation of the SCN8A gene to scale. Peaks corresponding to RNA sequencing reads were identified in intron GRCh38/hg38: chr12 51687221 51689004, shown in the middle panel. Bioinformatic analysis identified an exon-like sequence (bottom panel, sequence highlighted in uppercase) flanked by 3' and 5' splice sites. Inclusion of this exon leads to the introduction of a premature termination codon rendering the transcript a target of NMD.
Figure 31:
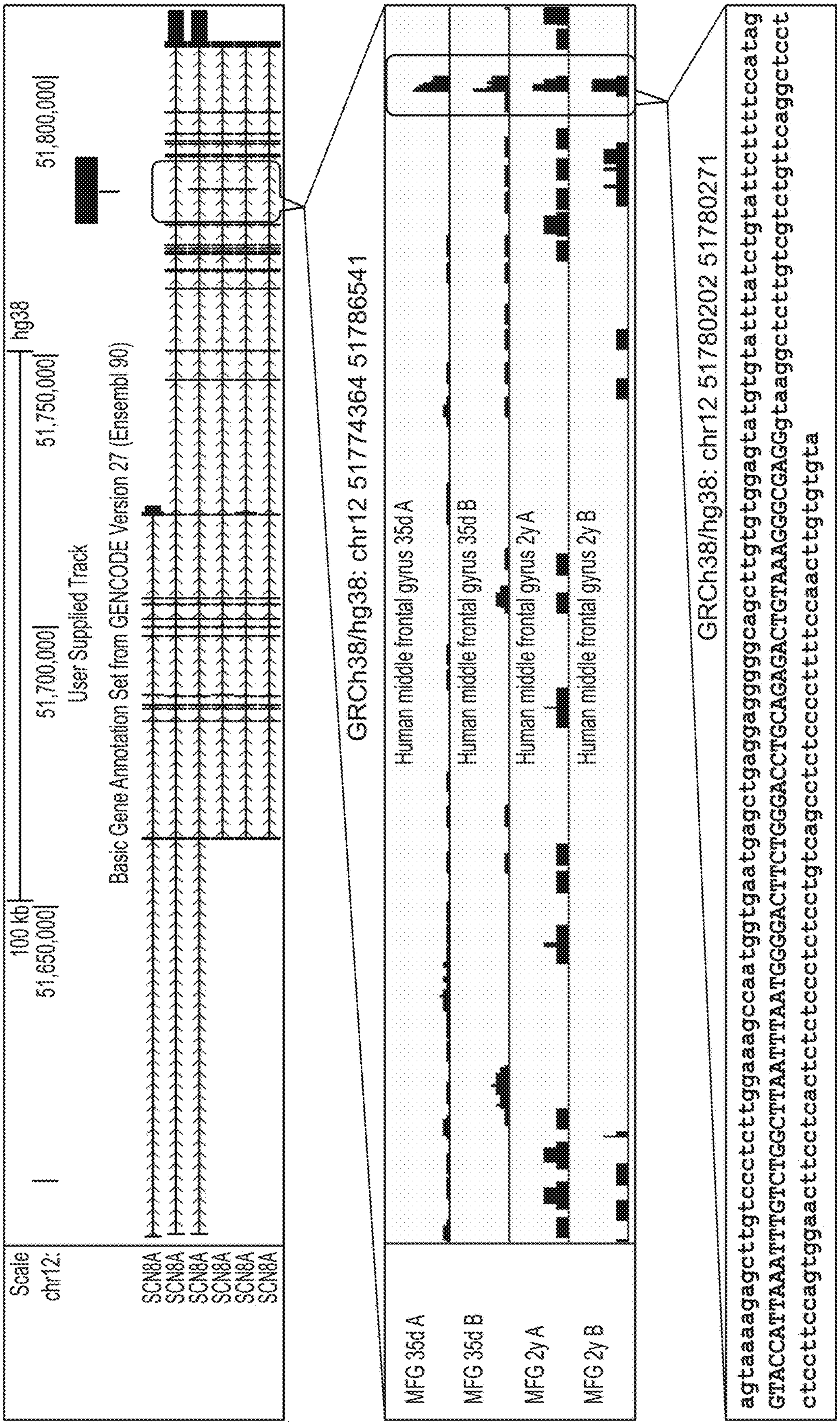
FIG. 31 depicts identification of an exemplary nonsense-mediated mRNA decay (NMD)-inducing exon in the SCN8A gene. The identification of the NMD-inducing exon in the SCN8A gene using RNA sequencing is shown, visualized in the UCSC genome browser. The upper panel shows a graphic representation of the SCN8A gene to scale. Peaks corresponding to RNA sequencing reads were identified in intron GRCh38/hg38: chr12 51774364 51786541, shown in the middle panel. Bioinformatic analysis identified an exon-like sequence (bottom panel, sequence highlighted in uppercase) flanked by 3' and 5' splice sites. Inclusion of this exon leads to the introduction of a premature termination codon rendering the transcript a target of NMD.
Figure 32:
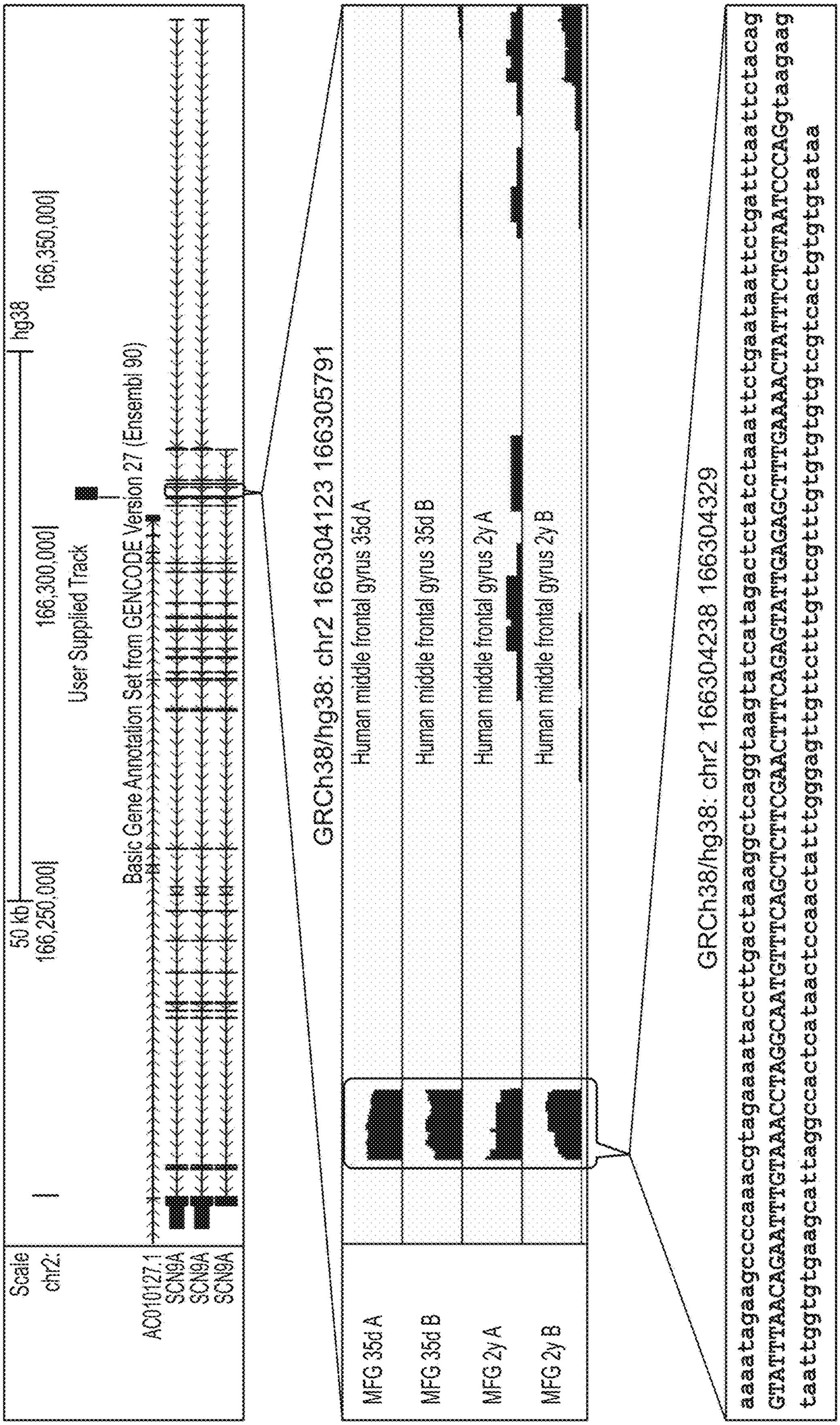
FIG. 32 depicts identification of an exemplary nonsense-mediated mRNA decay (NMD)-inducing exon in the SCN9A gene. The identification of the NMD-inducing exon in the SCN9A gene using RNA sequencing is shown, visualized in the UCSC genome browser. The upper panel shows a graphic representation of the SCN9A gene to scale. Peaks corresponding to RNA sequencing reads were identified in intron GRCh38/hg38: chr2 166304123 166305791, shown in the middle panel. Bioinformatic analysis identified an exon-like sequence (bottom panel, sequence highlighted in uppercase) flanked by 3' and 5' splice sites. Inclusion of this exon leads to the introduction of a premature termination codon rendering the transcript a target of NMD.
Figure 33:
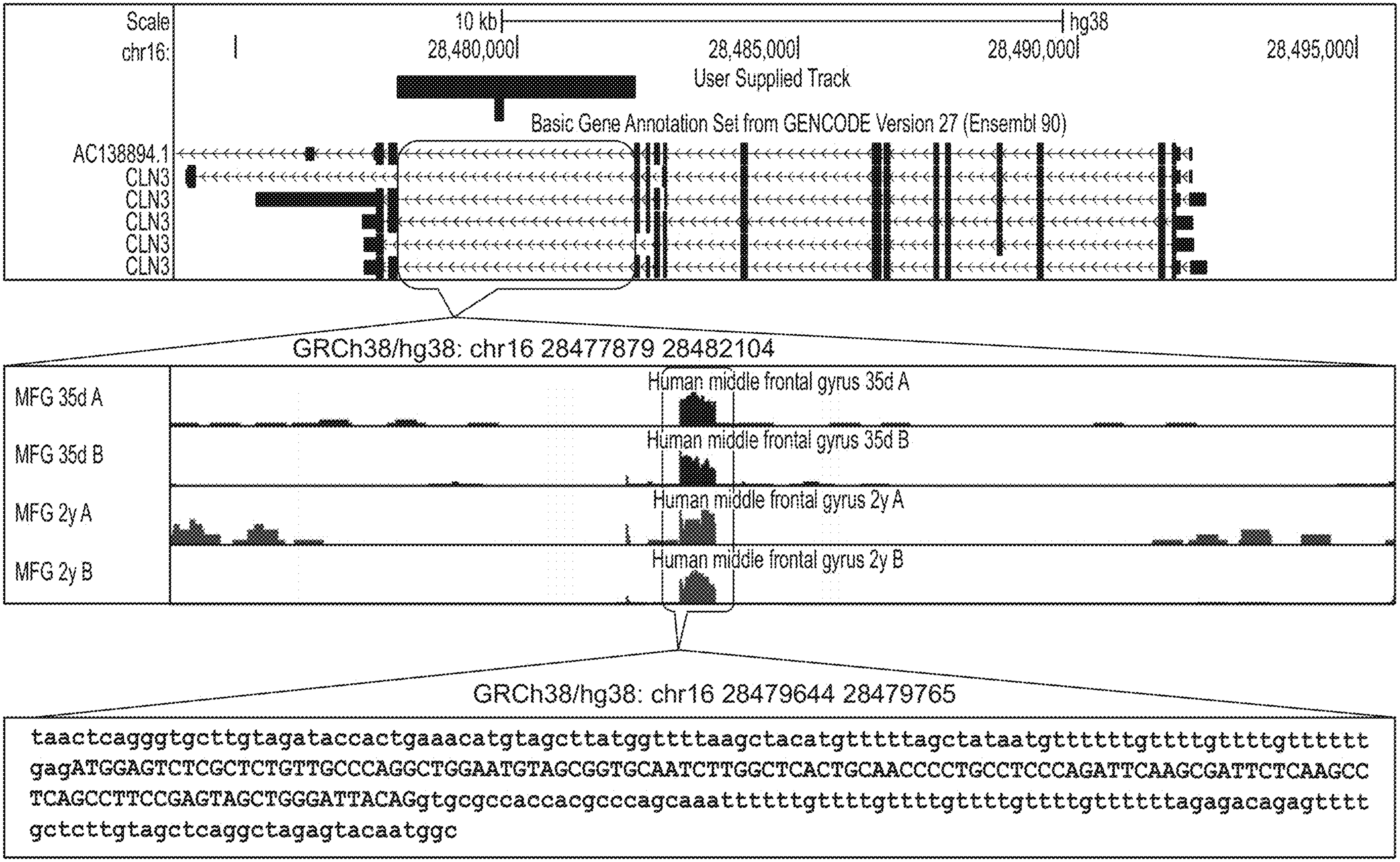
FIG. 33 depicts identification of an exemplary nonsense-mediated mRNA decay (NMD)-inducing exon in the CLN3 gene. The identification of the NMD-inducing exon in the CLN3 gene using RNA sequencing is shown, visualized in the UCSC genome browser. The upper panel shows a graphic representation of the CLN3 gene to scale. Peaks corresponding to RNA sequencing reads were identified in intron GRCh38/hg38: chr16 28477879 28482104, shown in the middle panel. Bioinformatic analysis identified an exon-like sequence (bottom panel, sequence highlighted in uppercase) flanked by 3' and 5' splice sites. Inclusion of this exon leads to the introduction of a premature termination codon rendering the transcript a target of NMD.
Figure 34:
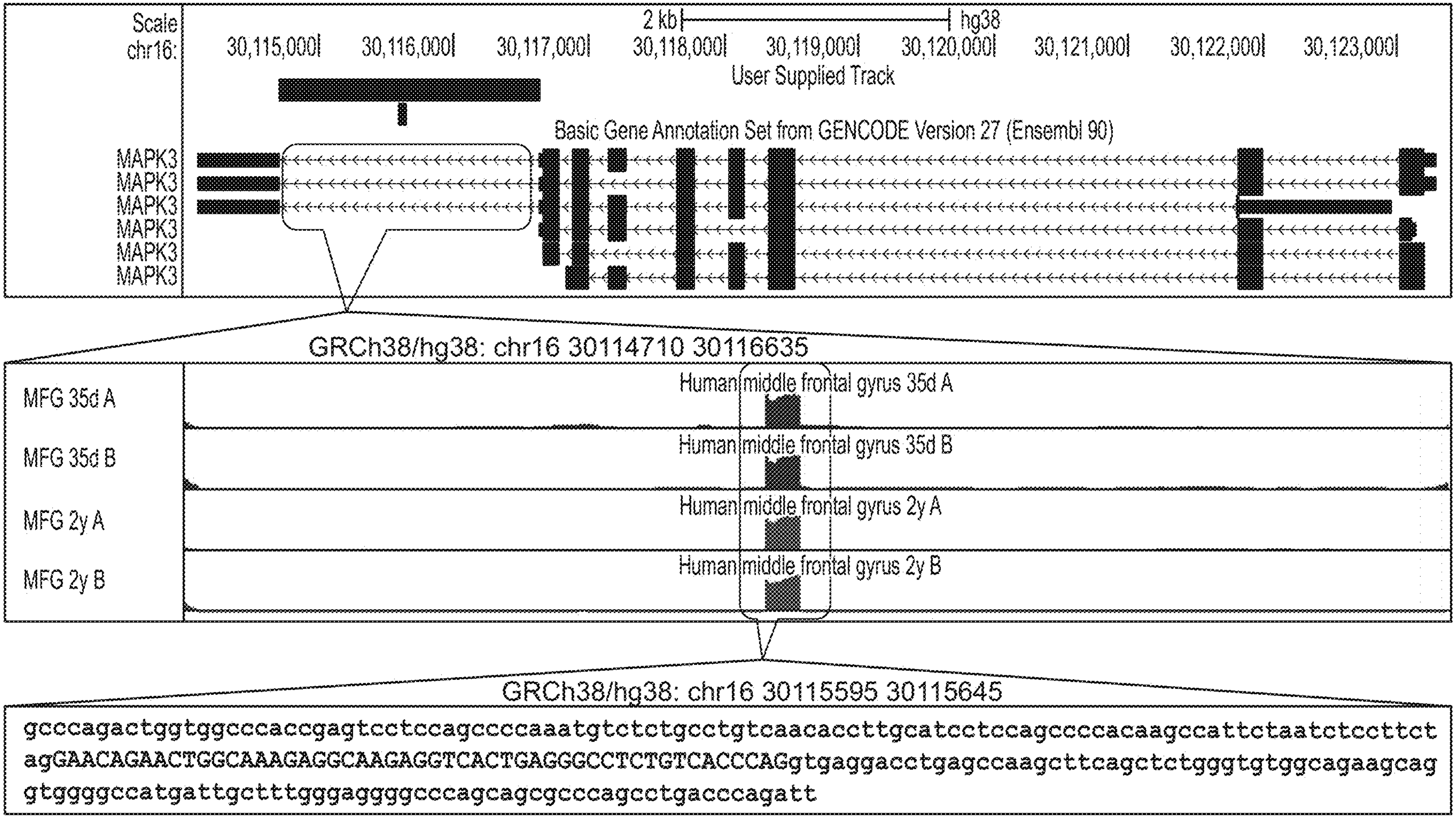
FIG. 34 depicts identification of an exemplary nonsense-mediated mRNA decay (NMD)-inducing exon in the MAPK3 gene. The identification of the NMD-inducing exon in the MAPK3 gene using RNA sequencing is shown, visualized in the UCSC genome browser. The upper panel shows a graphic representation of the MAPK3 gene to scale. Peaks corresponding to RNA sequencing reads were identified in intron GRCh38/hg38: chr16 30114710 30116635, shown in the middle panel. Bioinformatic analysis identified an exon-like sequence (bottom panel, sequence highlighted in uppercase) flanked by 3' and 5' splice sites. Inclusion of this exon leads to the introduction of a premature termination codon rendering the transcript a target of NMD.
Figure 35:
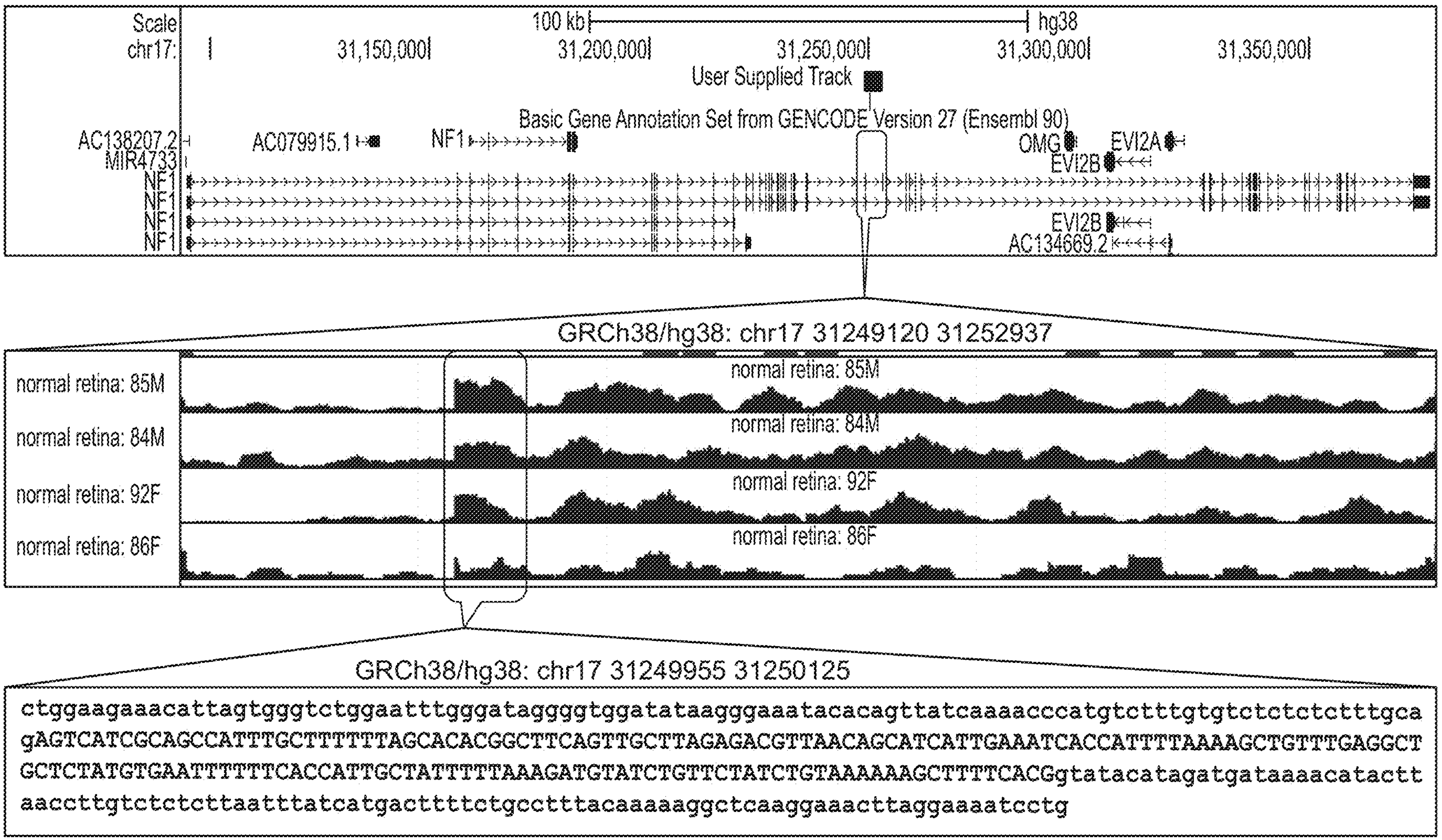
FIG. 35 depicts identification of an exemplary nonsense-mediated mRNA decay (NMD)-inducing exon in the NF1 gene. The identification of the NMD-inducing exon in the NF1 gene using RNA sequencing is shown, visualized in the UCSC genome browser. The upper panel shows a graphic representation of the NF1 gene to scale. Peaks corresponding to RNA sequencing reads were identified in intron GRCh38/hg38: chr17 31249120 31252937, shown in the middle panel. Bioinformatic analysis identified an exon-like sequence (bottom panel, sequence highlighted in uppercase) flanked by 3' and 5' splice sites. Inclusion of this exon leads to the introduction of a premature termination codon rendering the transcript a target of NMD.
Figure 36:
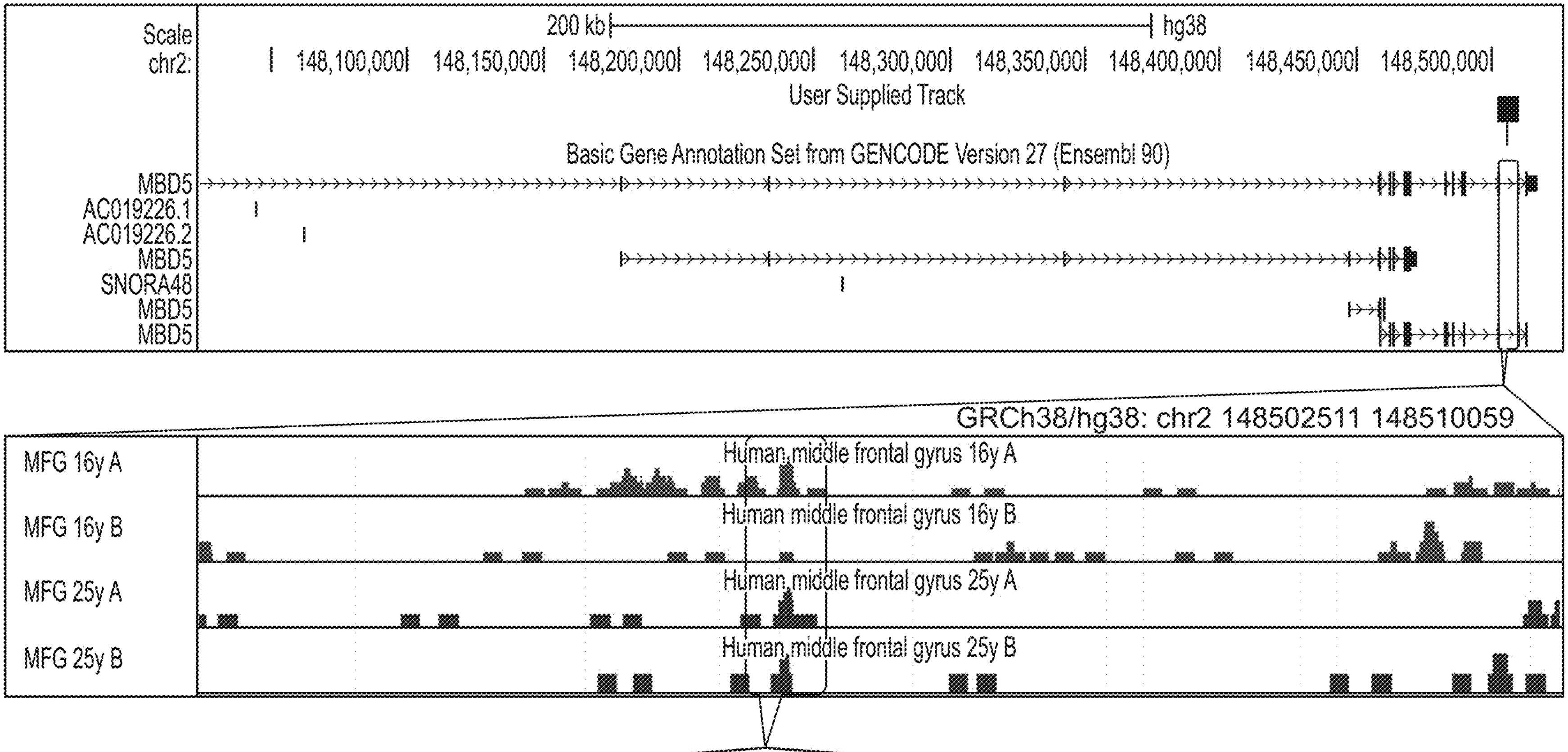
FIG. 36 depicts identification of an exemplary nonsense-mediated mRNA decay (NMD)-inducing exon in the MBD5 gene. The identification of the NMD-inducing exon in the MBD5 gene using RNA sequencing is shown, visualized in the UCSC genome browser. The upper panel shows a graphic representation of the MBD5 gene to scale. Peaks corresponding to RNA sequencing reads were identified in intron GRCh38/hg38: chr2 148502511 148510059, shown in the middle panel. Bioinformatic analysis identified an exon-like sequence (bottom panel, sequence highlighted in uppercase) flanked by 3' and 5' splice sites. Inclusion of this exon leads to the introduction of a premature termination codon rendering the transcript a target of NMD.
Figure 37:
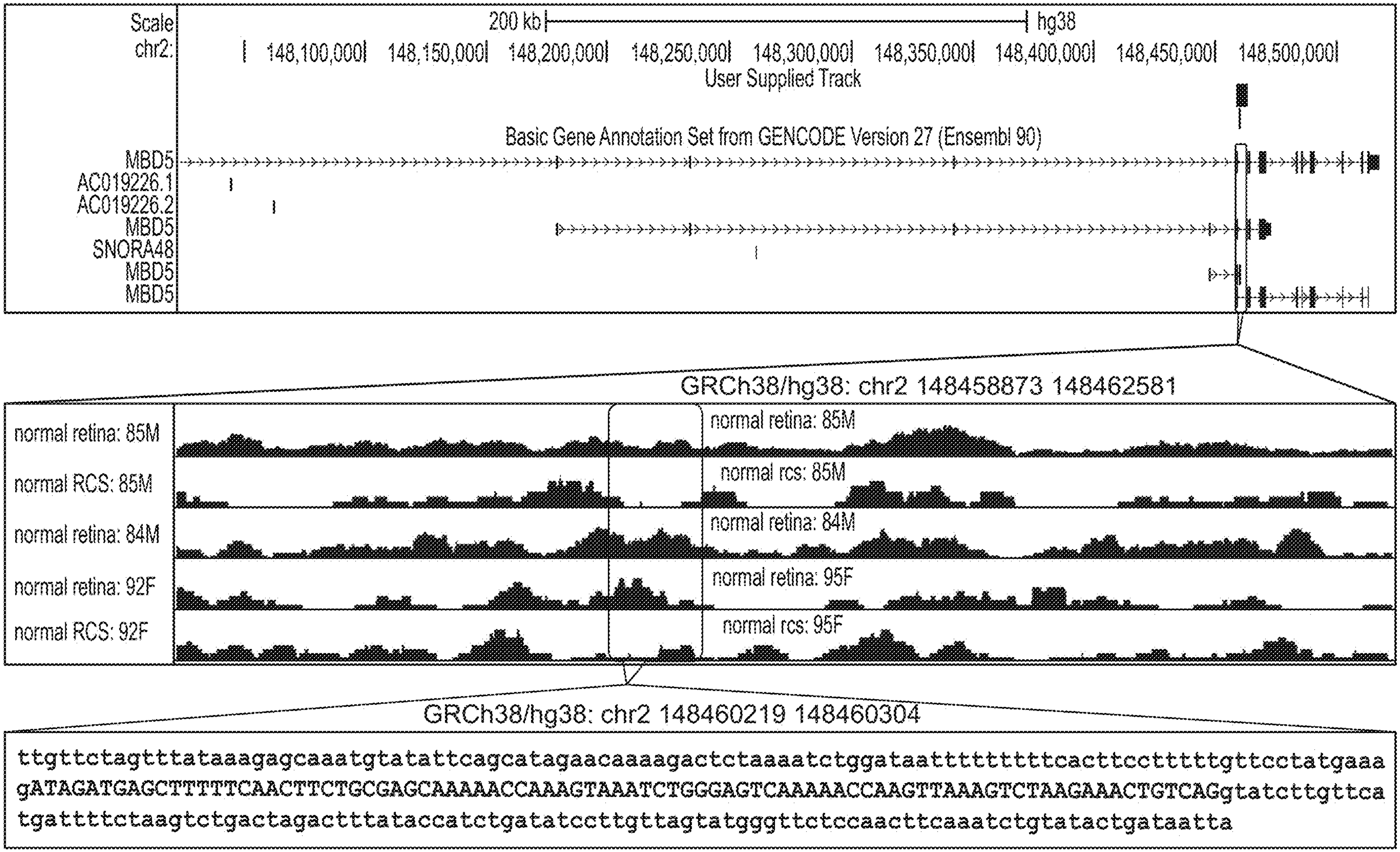
FIG. 37 depicts identification of an exemplary nonsense-mediated mRNA decay (NMD)-inducing exon in the MBD5 gene. The identification of the NMD-inducing exon in the MBD5 gene using RNA sequencing is shown, visualized in the UCSC genome browser. The upper panel shows a graphic representation of the MBD5 gene to scale. Peaks corresponding to RNA sequencing reads were identified in intron GRCh38/hg38: chr2 148458873 148462581, shown in the middle panel. Bioinformatic analysis identified an exon-like sequence (bottom panel, sequence highlighted in uppercase) flanked by 3' and 5' splice sites. Inclusion of this exon leads to the introduction of a premature termination codon rendering the transcript a target of NMD.
Figure 38:
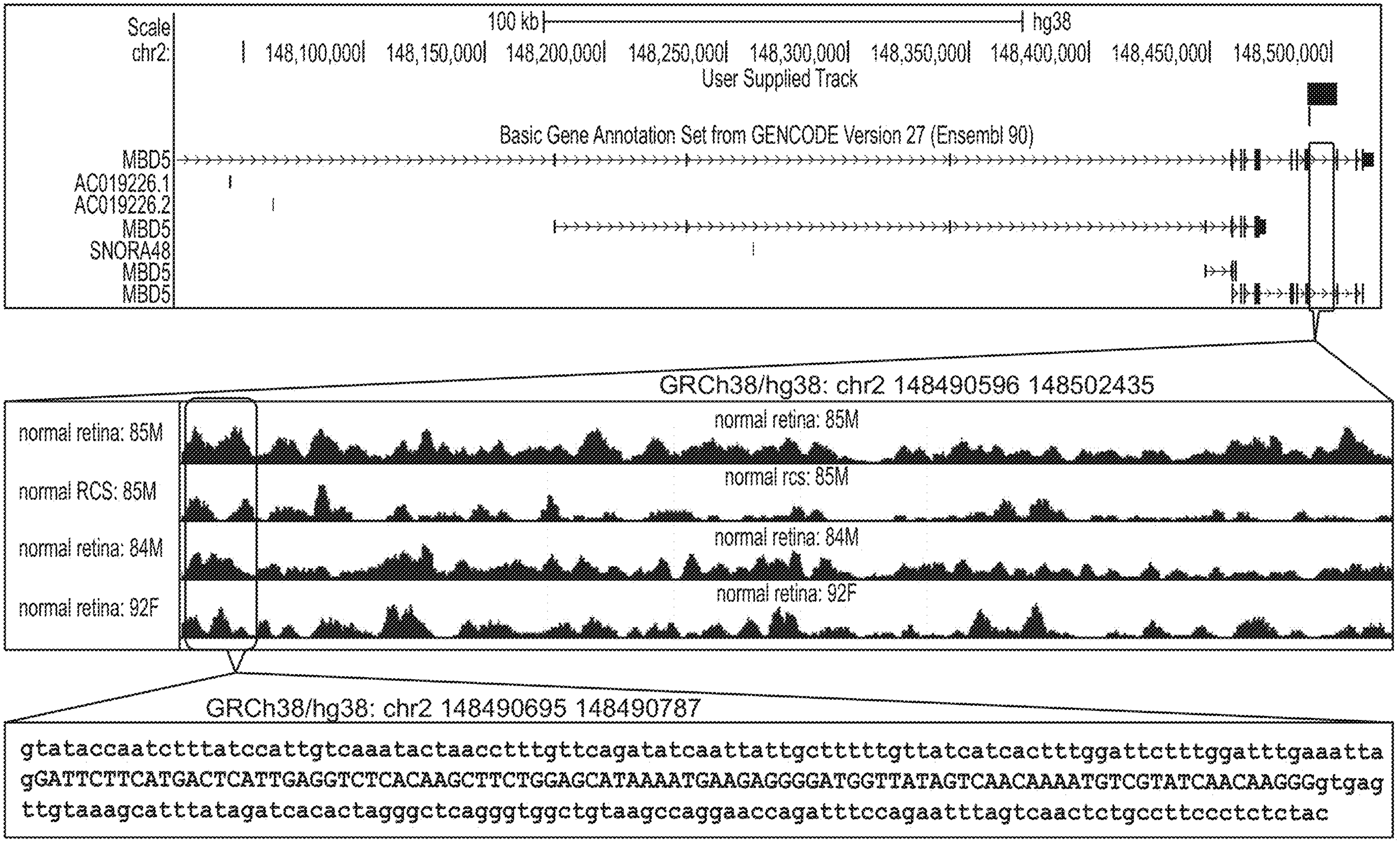
FIG. 38 depicts identification of an exemplary nonsense-mediated mRNA decay (NMD)-inducing exon in the MBD5 gene. The identification of the NMD-inducing exon in the MBD5 gene using RNA sequencing is shown, visualized in the UCSC genome browser. The upper panel shows a graphic representation of the MBD5 gene to scale. Peaks corresponding to RNA sequencing reads were identified in intron GRCh38/hg38: chr2 148490596 148502435, shown in the middle panel. Bioinformatic analysis identified an exon-like sequence (bottom panel, sequence highlighted in uppercase) flanked by 3' and 5' splice sites. Inclusion of this exon leads to the introduction of a premature termination codon rendering the transcript a target of NMD.
Figure 40:
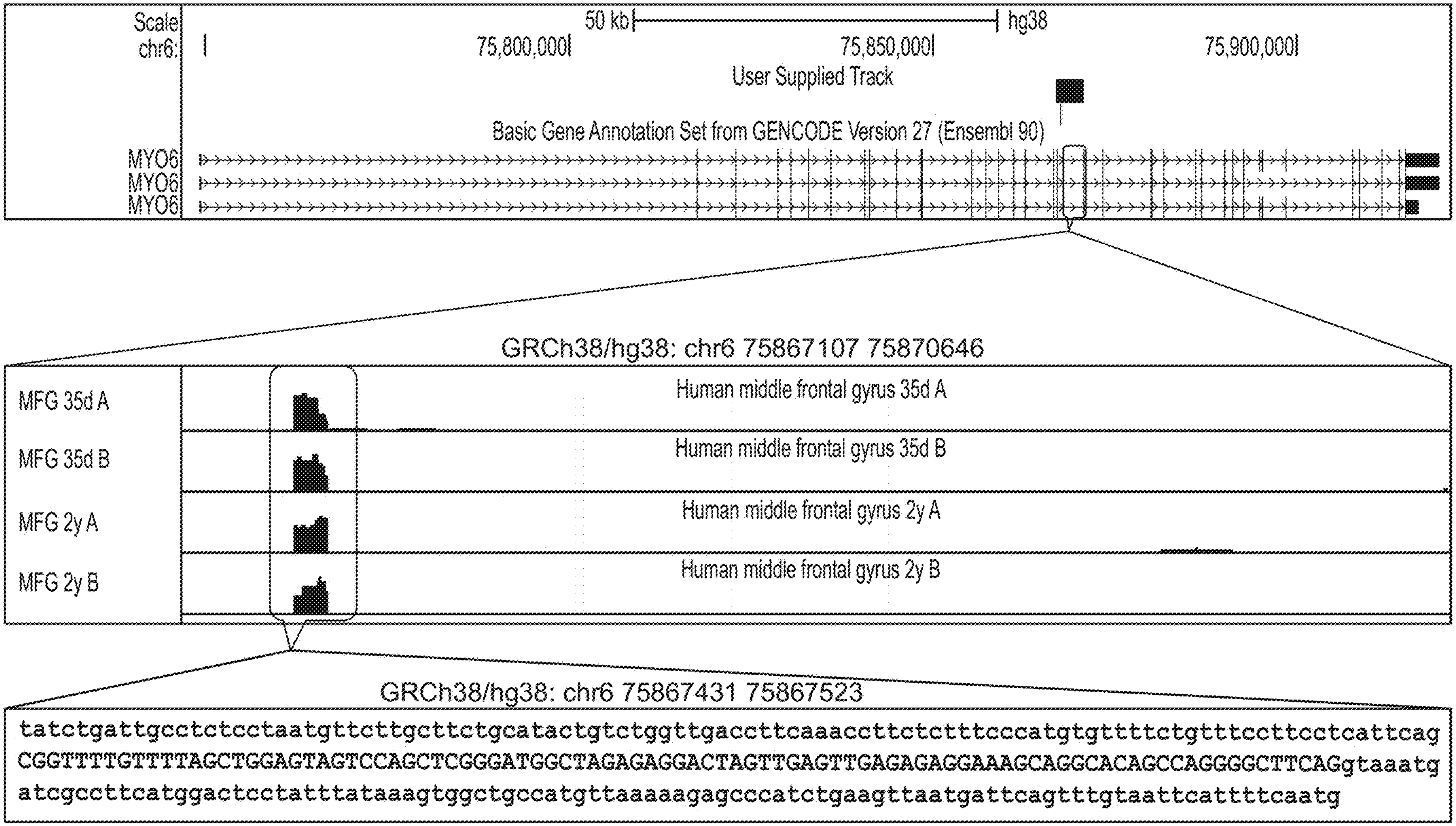
FIG. 40 depicts identification of an exemplary nonsense-mediated mRNA decay (NMD)-inducing exon in the MYO6 gene. The identification of the NMD-inducing exon in the MYO6 gene using RNA sequencing is shown, visualized in the UCSC genome browser. The upper panel shows a graphic representation of the MYO6 gene to scale. Peaks corresponding to RNA sequencing reads were identified in intron GRCh38/hg38: chr6 75867107 75870646, shown in the middle panel. Bioinformatic analysis identified an exon-like sequence (bottom panel, sequence highlighted in uppercase) flanked by 3' and 5' splice sites. Inclusion of this exon leads to the introduction of a premature termination codon rendering the transcript a target of NMD.
Figure 41:
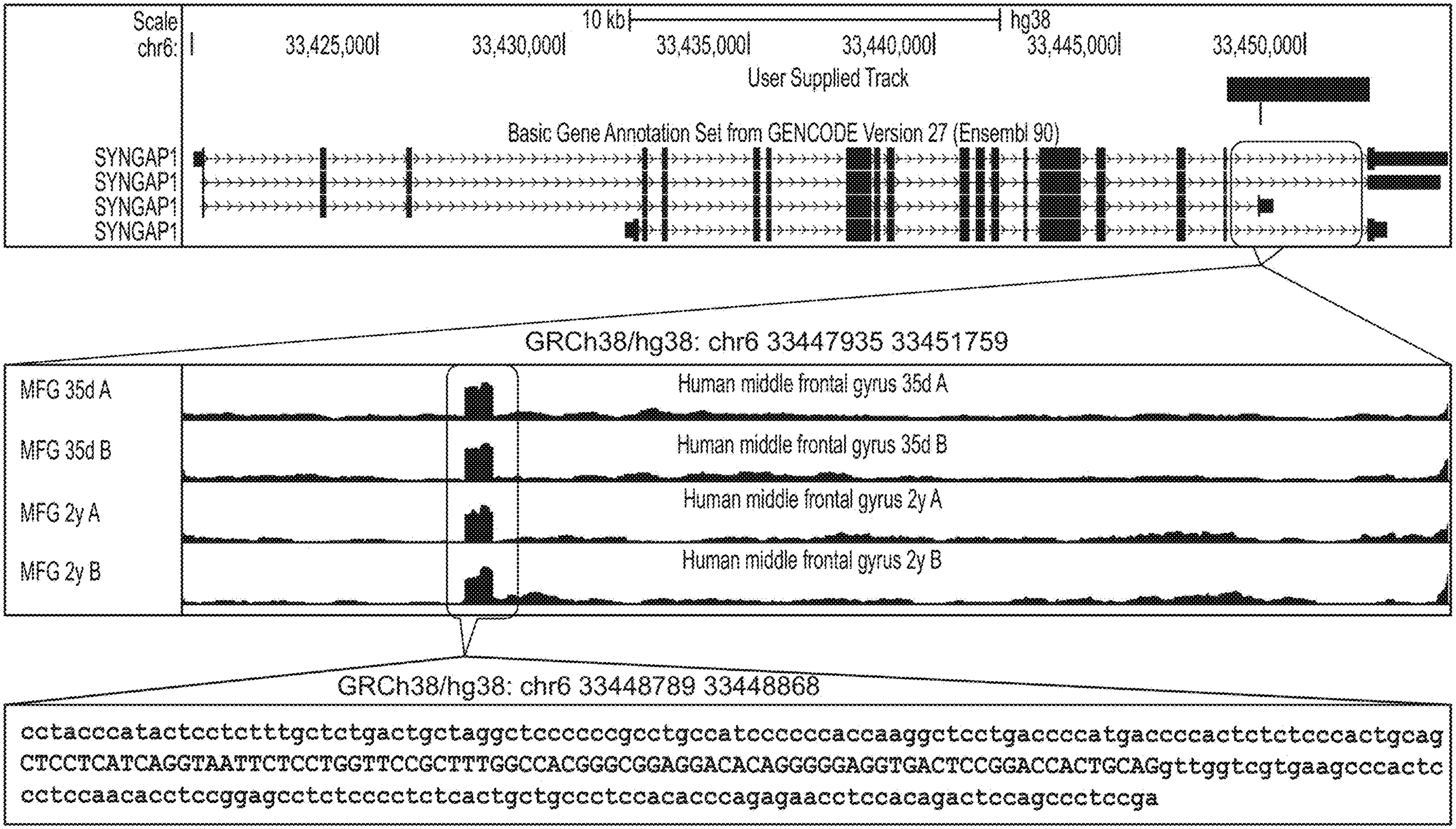
FIG. 41 depicts identification of an exemplary nonsense-mediated mRNA decay (NMD)-inducing exon in the SYNGAP1 gene. The identification of the NMD-inducing exon in the SYNGAP1 gene using RNA sequencing is shown, visualized in the UCSC genome browser. The upper panel shows a graphic representation of the SYNGAP1 gene to scale. Peaks corresponding to RNA sequencing reads were identified in intron GRCh38/hg38: chr6 33447935 33451759, shown in the middle panel. Bioinformatic analysis identified an exon-like sequence (bottom panel, sequence highlighted in uppercase) flanked by 3' and 5' splice sites. Inclusion of this exon leads to the introduction of a premature termination codon rendering the transcript a target of NMD.
Figure 43:
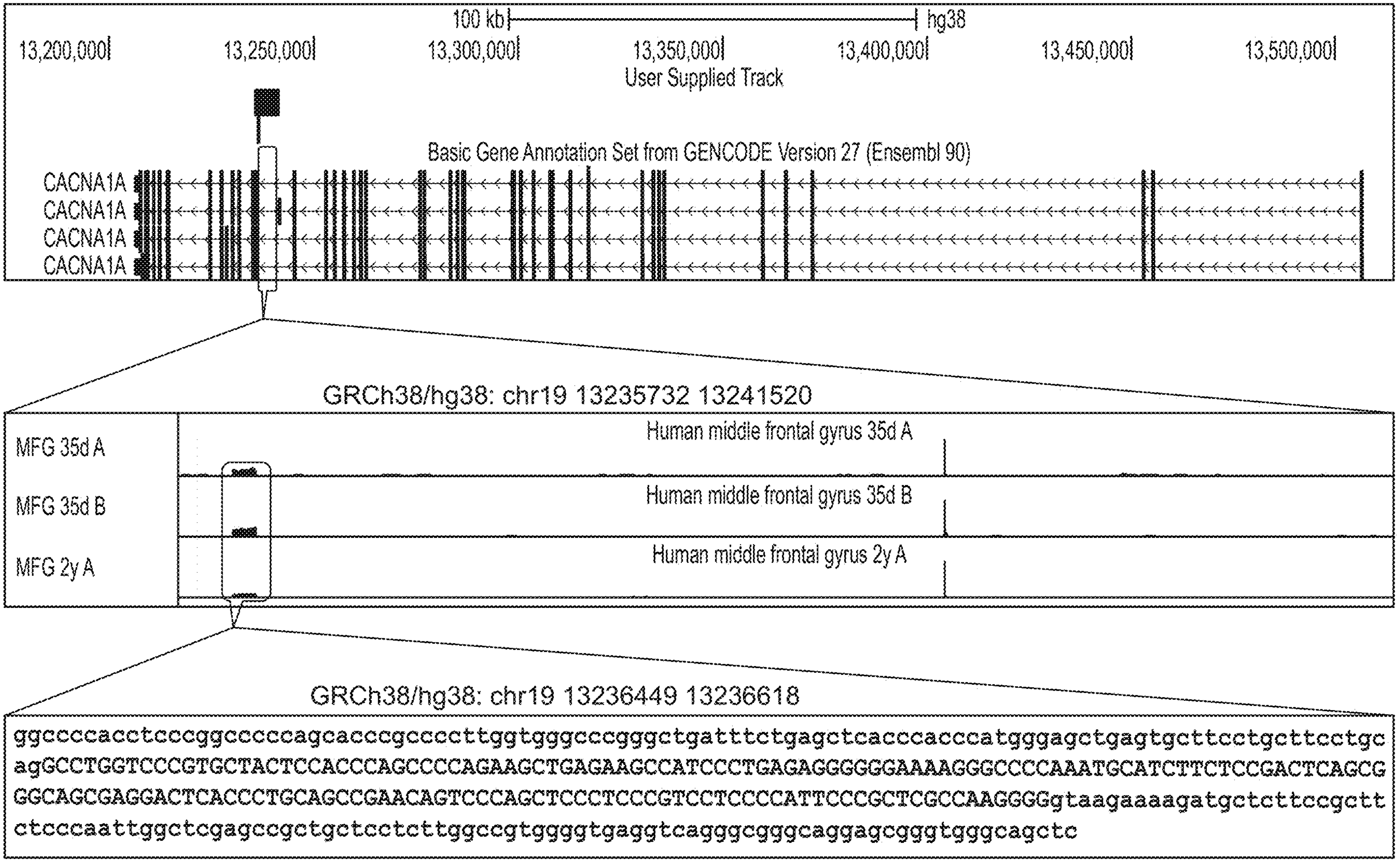
FIG. 43 depicts identification of an exemplary nonsense-mediated mRNA decay (NMD)-inducing exon in the CACNA1A gene. The identification of the NMD-inducing exon in the CACNA1A gene using RNA sequencing is shown, visualized in the UCSC genome browser. The upper panel shows a graphic representation of the CACNA1A gene to scale. Peaks corresponding to RNA sequencing reads were identified in intron GRCh38/hg38: chr19 13235732 13241520, shown in the middle panel. Bioinformatic analysis identified an exon-like sequence (bottom panel, sequence highlighted in uppercase) flanked by 3' and 5' splice sites. Inclusion of this exon leads to the introduction of a premature termination codon rendering the transcript a target of NMD.
Figure 44:
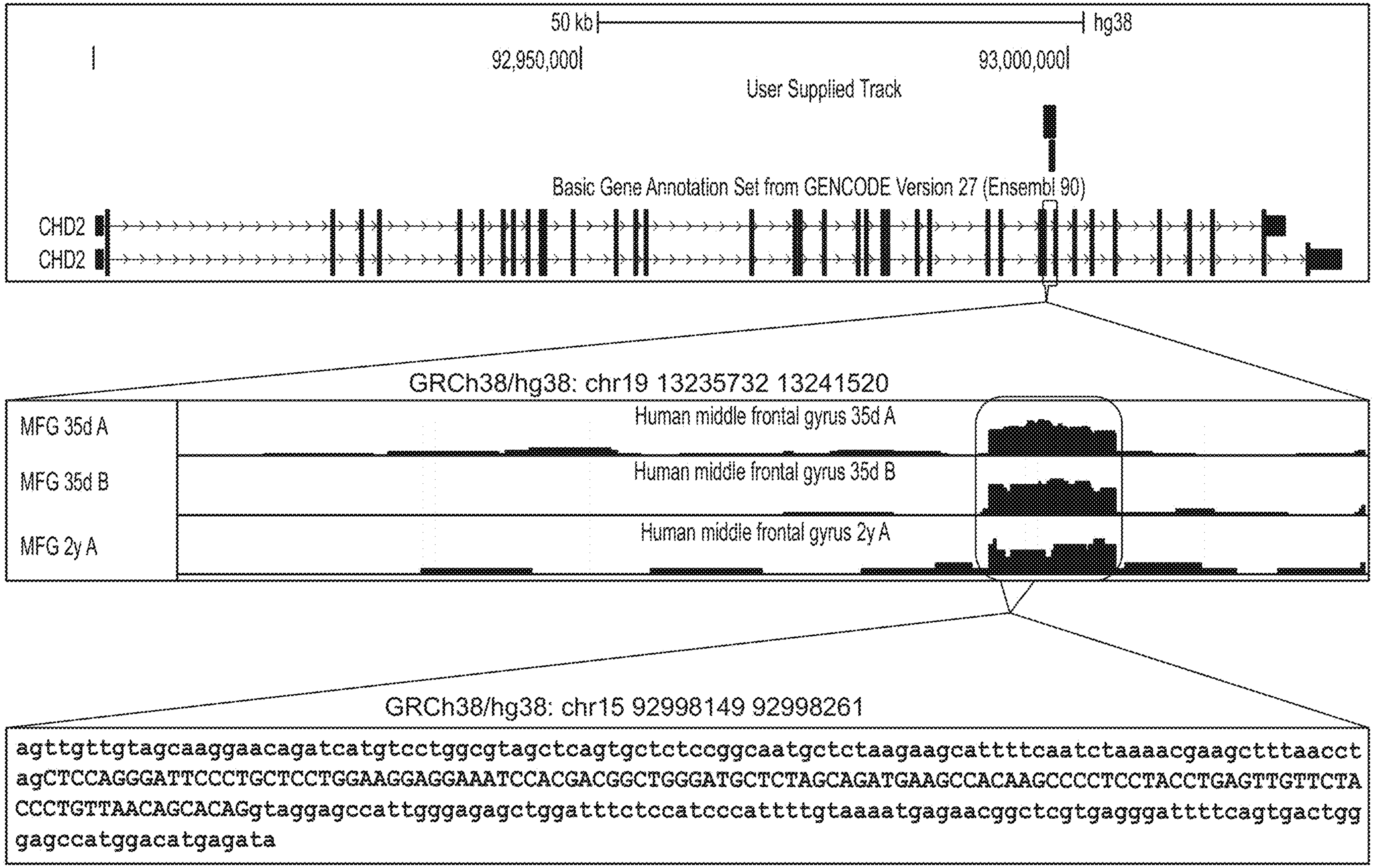
FIG. 44 depicts identification of an exemplary nonsense-mediated mRNA decay (NMD)-inducing exon in the CHD2 gene. The identification of the NMD-inducing exon in the CHD2 gene using RNA sequencing is shown, visualized in the UCSC genome browser. The upper panel shows a graphic representation of the CHD2 gene to scale. Peaks corresponding to RNA sequencing reads were identified in intron GRCh38/hg38: chr15 92997404 92998498, shown in the middle panel. Bioinformatic analysis identified an exon-like sequence (bottom panel, sequence highlighted in uppercase) flanked by 3' and 5' splice sites. Inclusion of this exon leads to the introduction of a premature termination codon rendering the transcript a target of NMD.
Figure 45:
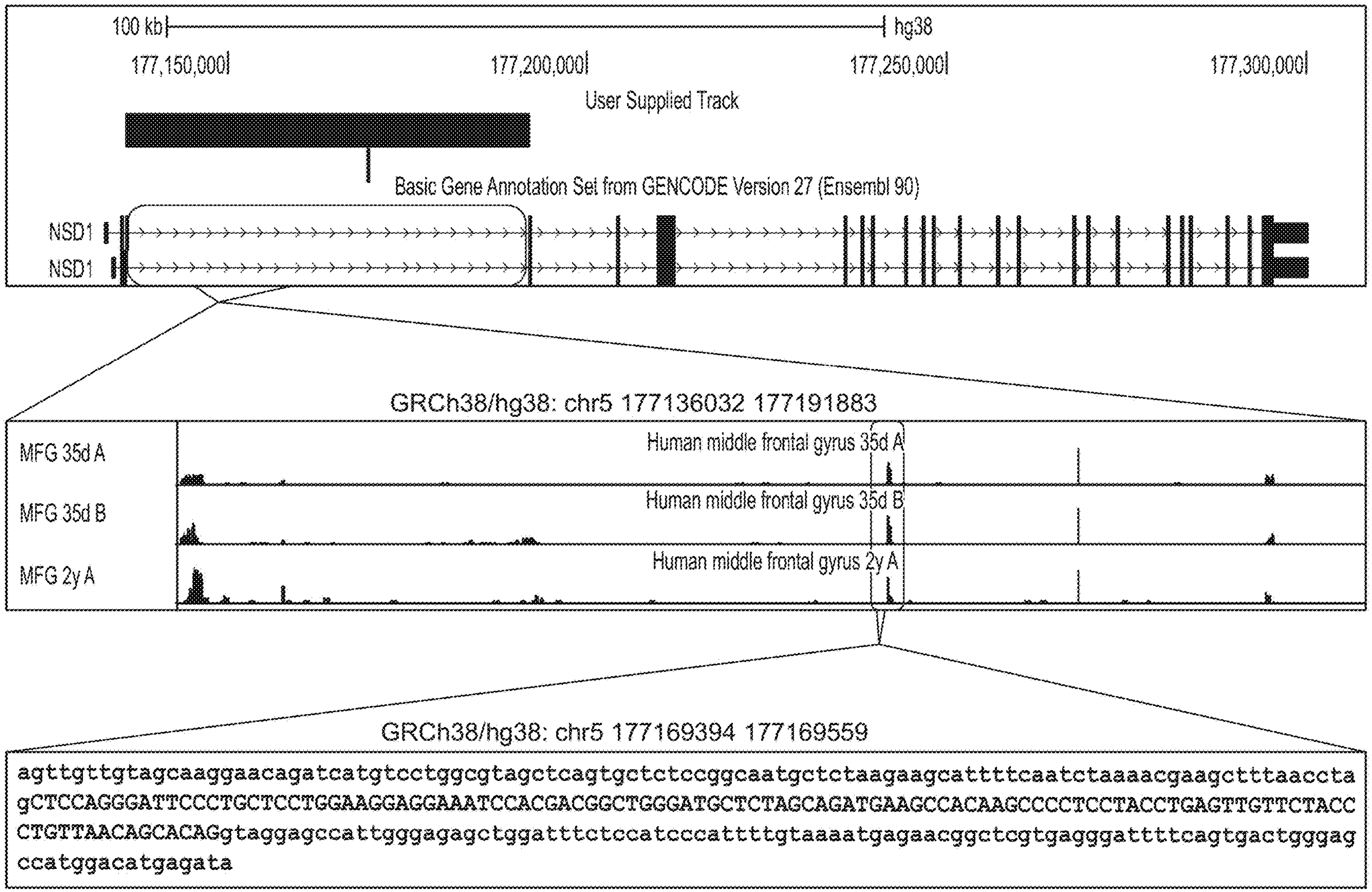
FIG. 45 depicts identification of an exemplary nonsense-mediated mRNA decay (NMD)-inducing exon in the NSD1 gene. The identification of the NMD-inducing exon in the NSD1 gene using RNA sequencing is shown, visualized in the UCSC genome browser. The upper panel shows a graphic representation of the NSD1 gene to scale. Peaks corresponding to RNA sequencing reads were identified in intron GRCh38/hg38: chr5 177136032 177191883, shown in the middle panel. Bioinformatic analysis identified an exon-like sequence (bottom panel, sequence highlighted in uppercase) flanked by 3' and 5' splice sites. Inclusion of this exon leads to the introduction of a premature termination codon rendering the transcript a target of NMD.
Figure 46:
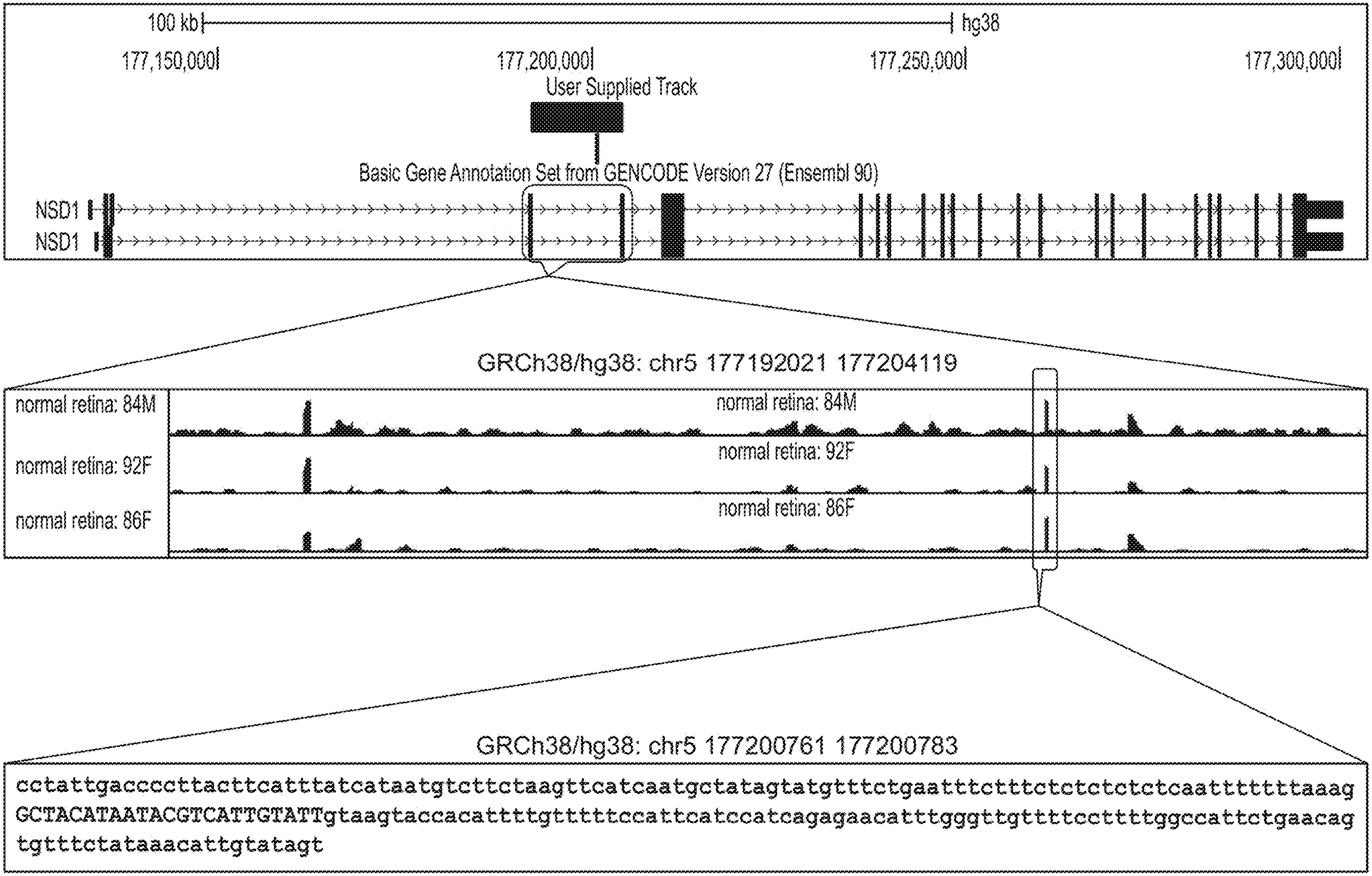
FIG. 46 depicts identification of an exemplary nonsense-mediated mRNA decay (NMD)-inducing exon in the NSD1 gene. The identification of the NMD-inducing exon in the NSD1 gene using RNA sequencing is shown, visualized in the UCSC genome browser. The upper panel shows a graphic representation of the NSD1 gene to scale. Peaks corresponding to RNA sequencing reads were identified in intron GRCh38/hg38: chr5 177192021 177204119, shown in the middle panel. Bioinformatic analysis identified an exon-like sequence (bottom panel, sequence highlighted in uppercase) flanked by 3' and 5' splice sites. Inclusion of this exon leads to the introduction of a premature termination codon rendering the transcript a target of NMD.
Figure 47:
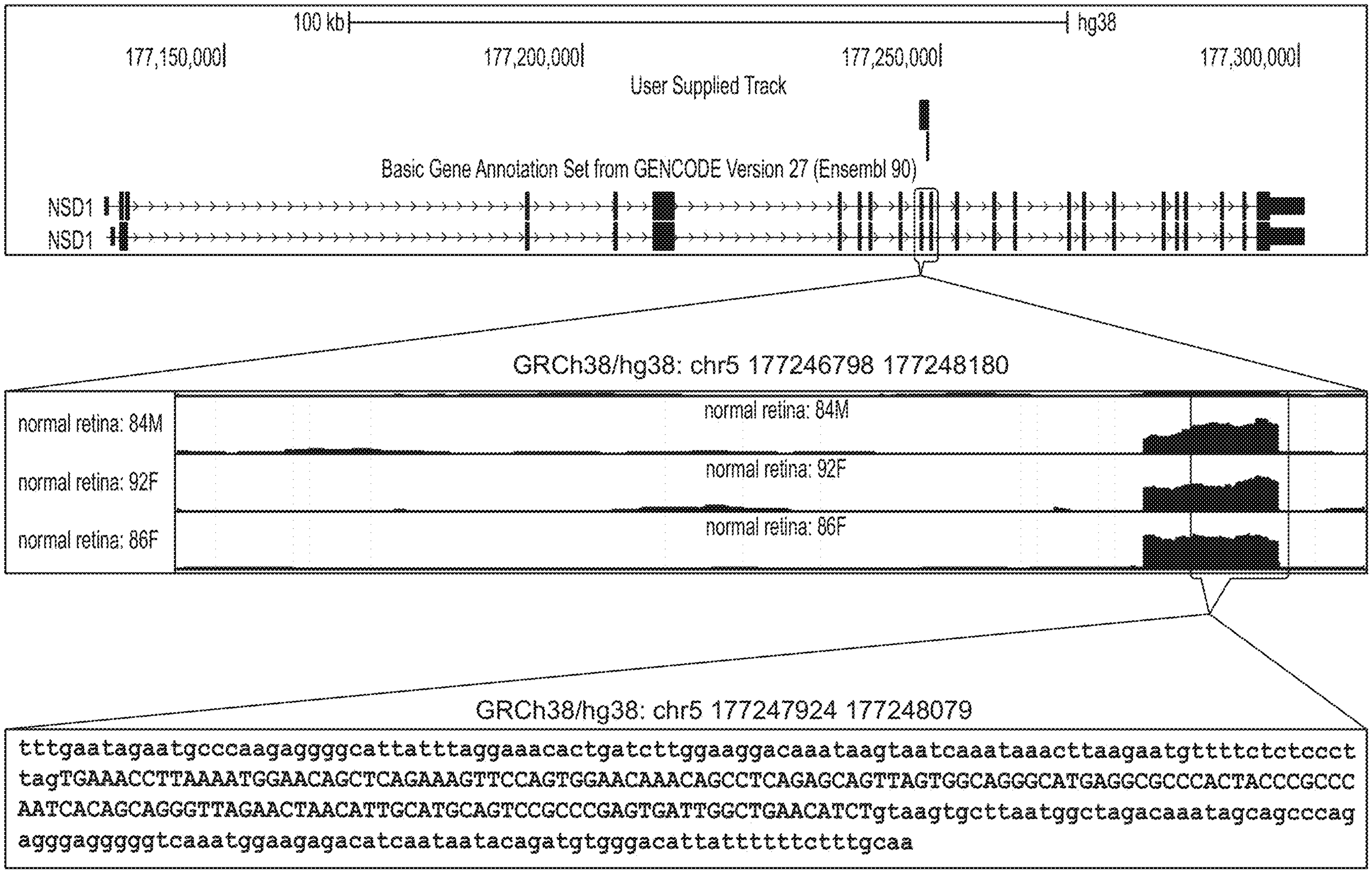
FIG. 47 depicts identification of an exemplary nonsense-mediated mRNA decay (NMD)-inducing exon in the NSD1 gene. The identification of the NMD-inducing exon in the NSD1 gene using RNA sequencing is shown, visualized in the UCSC genome browser. The upper panel shows a graphic representation of the NSD1 gene to scale. Peaks corresponding to RNA sequencing reads were identified in intron GRCh38/hg38: chr5 177246798 177248180, shown in the middle panel. Bioinformatic analysis identified an exon-like sequence (bottom panel, sequence highlighted in uppercase) flanked by 3' and 5' splice sites. Inclusion of this exon leads to the introduction of a premature termination codon rendering the transcript a target of NMD.
Figure 48:
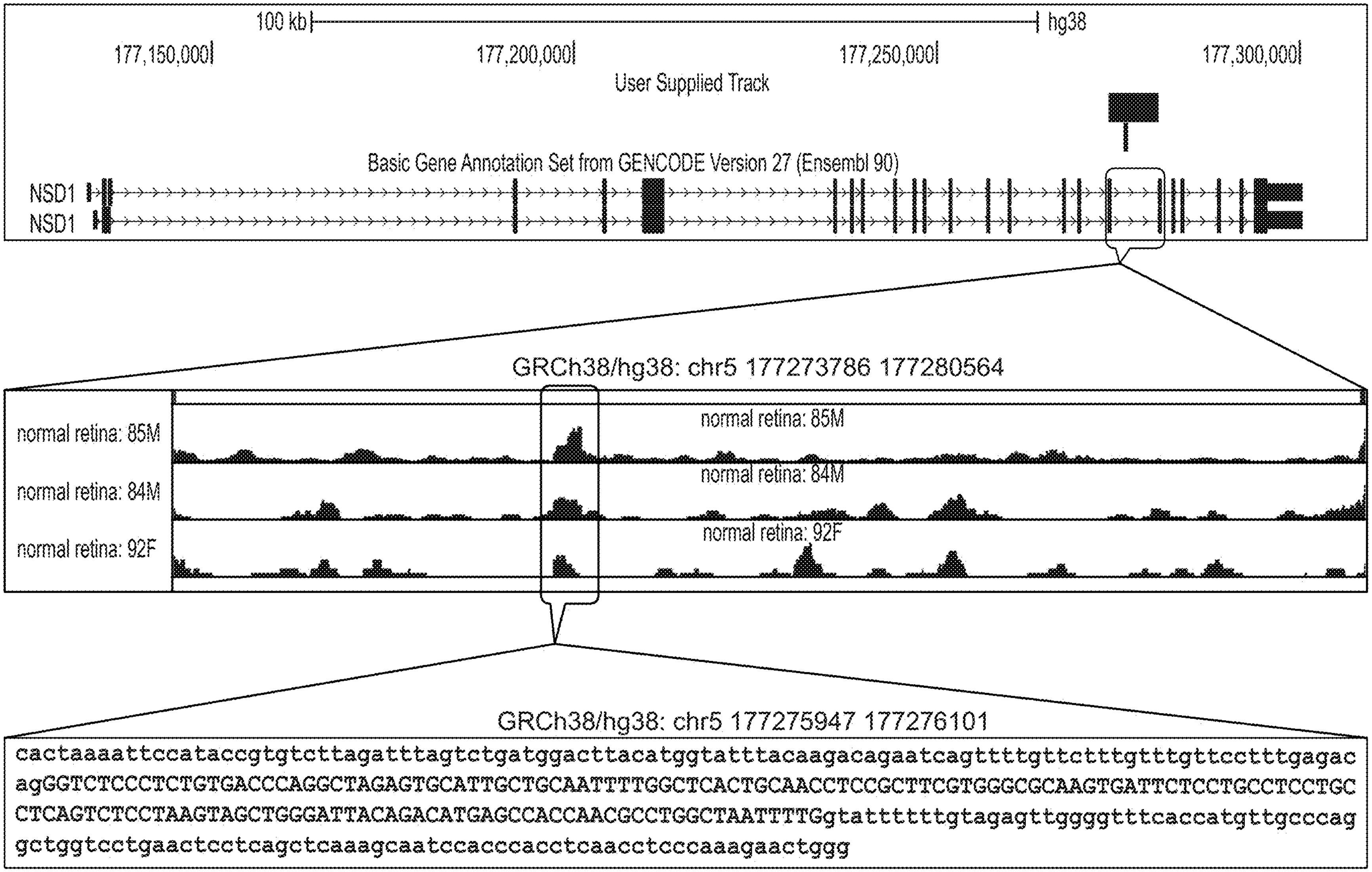
FIG. 48 depicts identification of an exemplary nonsense-mediated mRNA decay (NMD)-inducing exon in the NSD1 gene. The identification of the NMD-inducing exon in the NSD1 gene using RNA sequencing is shown, visualized in the UCSC genome browser. The upper panel shows a graphic representation of the NSD1 gene to scale. Peaks corresponding to RNA sequencing reads were identified in intron GRCh38/hg38: chr5 177273786 177280564, shown in the middle panel. Bioinformatic analysis identified an exon-like sequence (bottom panel, sequence highlighted in uppercase) flanked by 3' and 5' splice sites. Inclusion of this exon leads to the introduction of a premature termination codon rendering the transcript a target of NMD.
Figure 49:
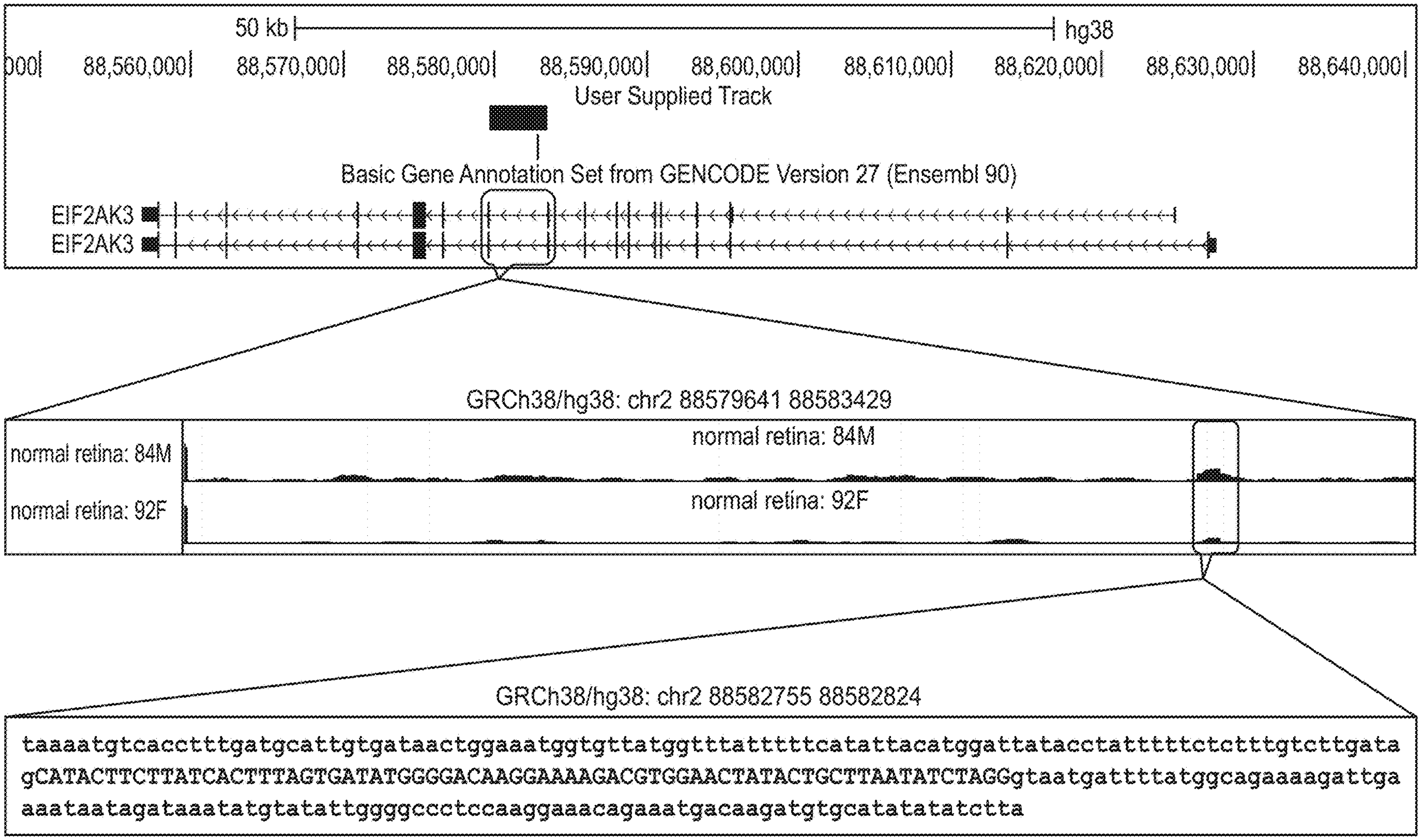
FIG. 49 depicts identification of an exemplary nonsense-mediated mRNA decay (NMD)-inducing exon in the EIF2AK3 gene. The identification of the NMD-inducing exon in the EIF2AK3 gene using RNA sequencing is shown, visualized in the UCSC genome browser. The upper panel shows a graphic representation of the EIF2AK3 gene to scale. Peaks corresponding to RNA sequencing reads were identified in intron GRCh38/hg38: chr2 88579641 88583429, shown in the middle panel. Bioinformatic analysis identified an exon-like sequence (bottom panel, sequence highlighted in uppercase) flanked by 3' and 5' splice sites. Inclusion of this exon leads to the introduction of a premature termination codon rendering the transcript a target of NMD.
Figure 50:
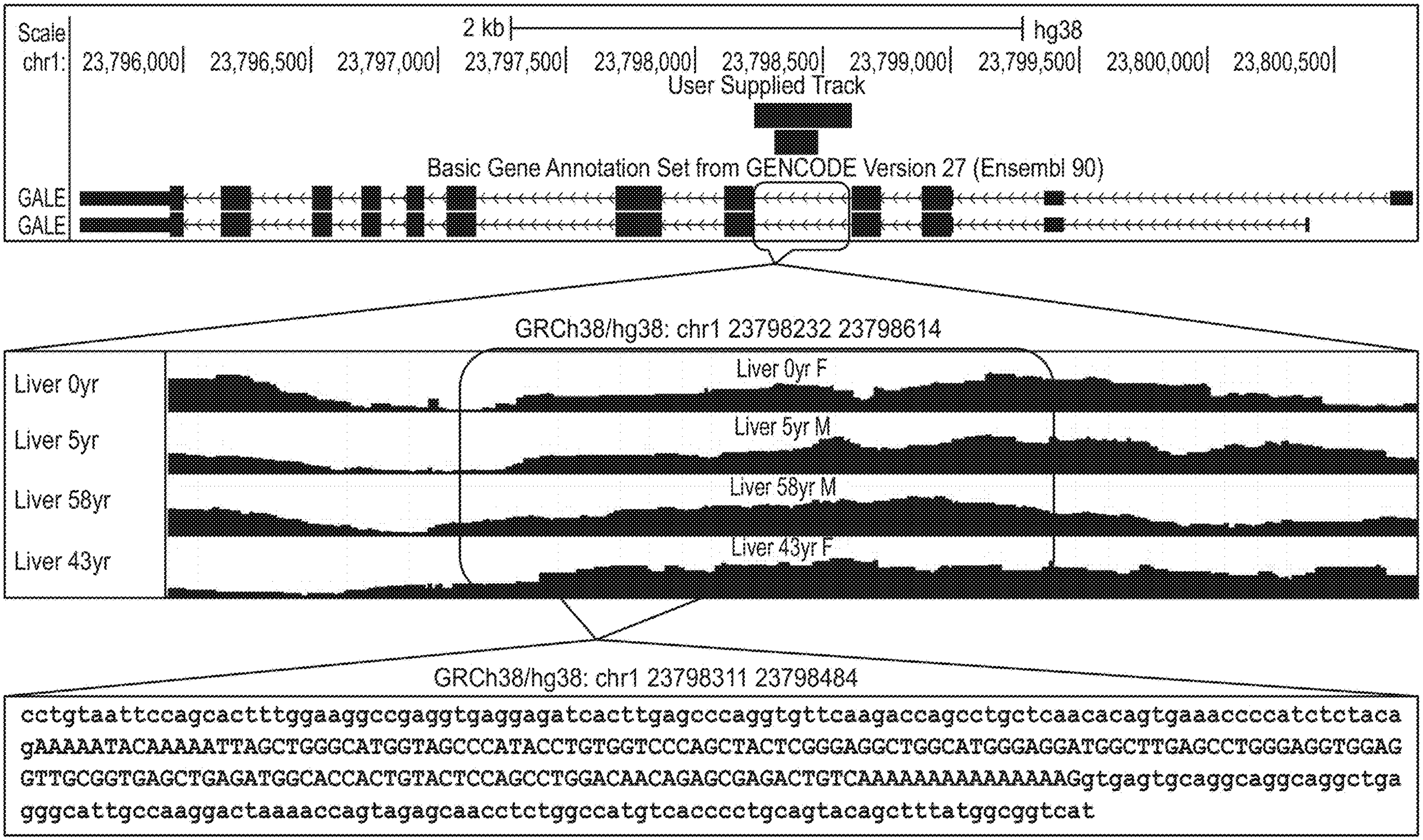
FIG. 50 depicts identification of an exemplary nonsense-mediated mRNA decay (NMD)-inducing exon in the GALE gene. The identification of the NMD-inducing exon in the GALE gene using RNA sequencing is shown, visualized in the UCSC genome browser. The upper panel shows a graphic representation of the GALE gene to scale. Peaks corresponding to RNA sequencing reads were identified in intron GRCh38/hg38: chr1 23798232 23798614, shown in the middle panel. Bioinformatic analysis identified an exon-like sequence (bottom panel, sequence highlighted in uppercase) flanked by 3' and 5' splice sites. Inclusion of this exon leads to the introduction of a premature termination codon rendering the transcript a target of NMD.
Figure 51:
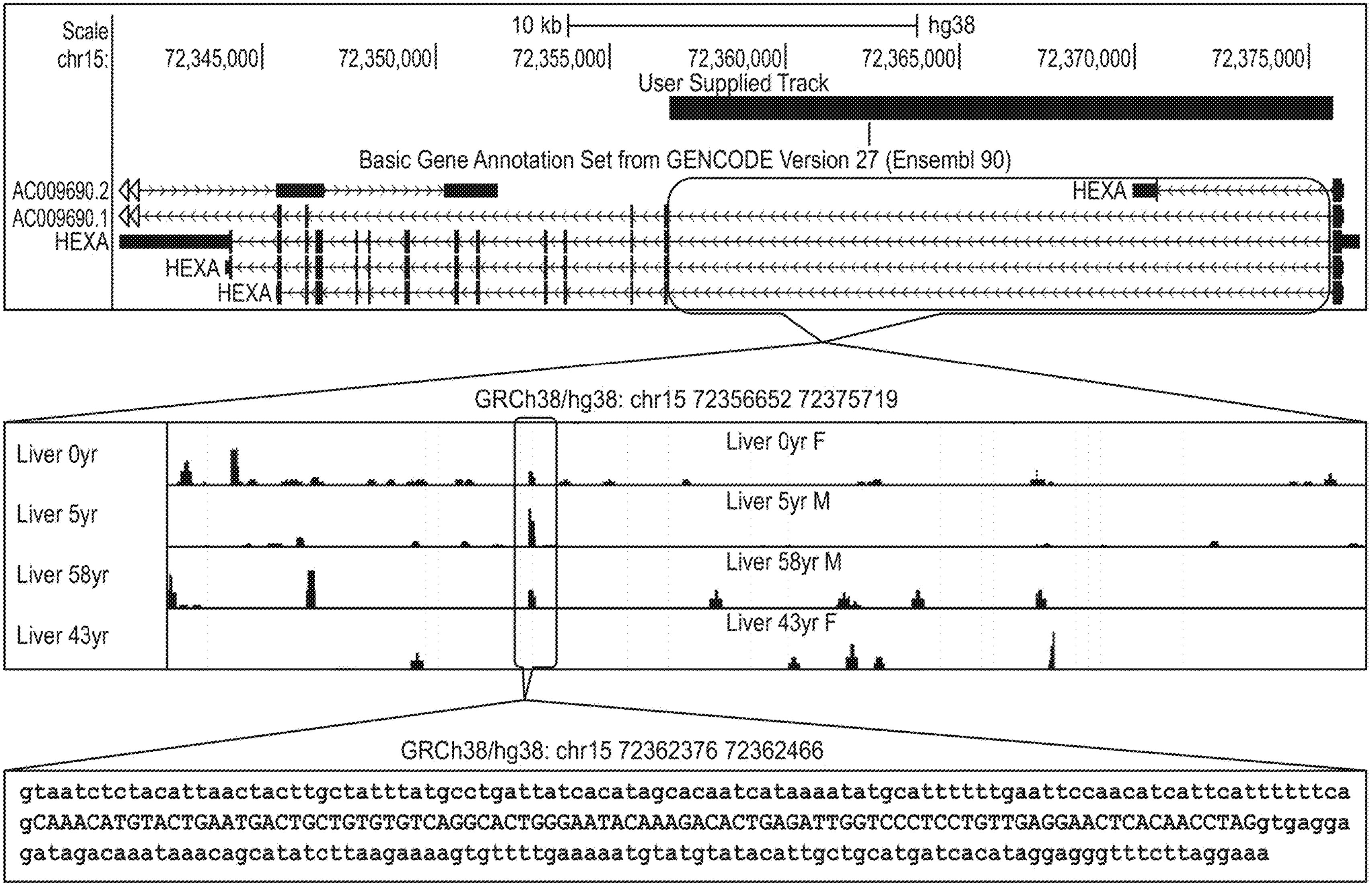
FIG. 51 depicts identification of an exemplary nonsense-mediated mRNA decay (NMD)-inducing exon in the HEXA gene. The identification of the NMD-inducing exon in the HEXA gene using RNA sequencing is shown, visualized in the UCSC genome browser. The upper panel shows a graphic representation of the HEXA gene to scale. Peaks corresponding to RNA sequencing reads were identified in intron GRCh38/hg38: chr15 72356652 72375719, shown in the middle panel. Bioinformatic analysis identified an exon-like sequence (bottom panel, sequence highlighted in uppercase) flanked by 3' and 5' splice sites. Inclusion of this exon leads to the introduction of a premature termination codon rendering the transcript a target of NMD.
Figure 52:
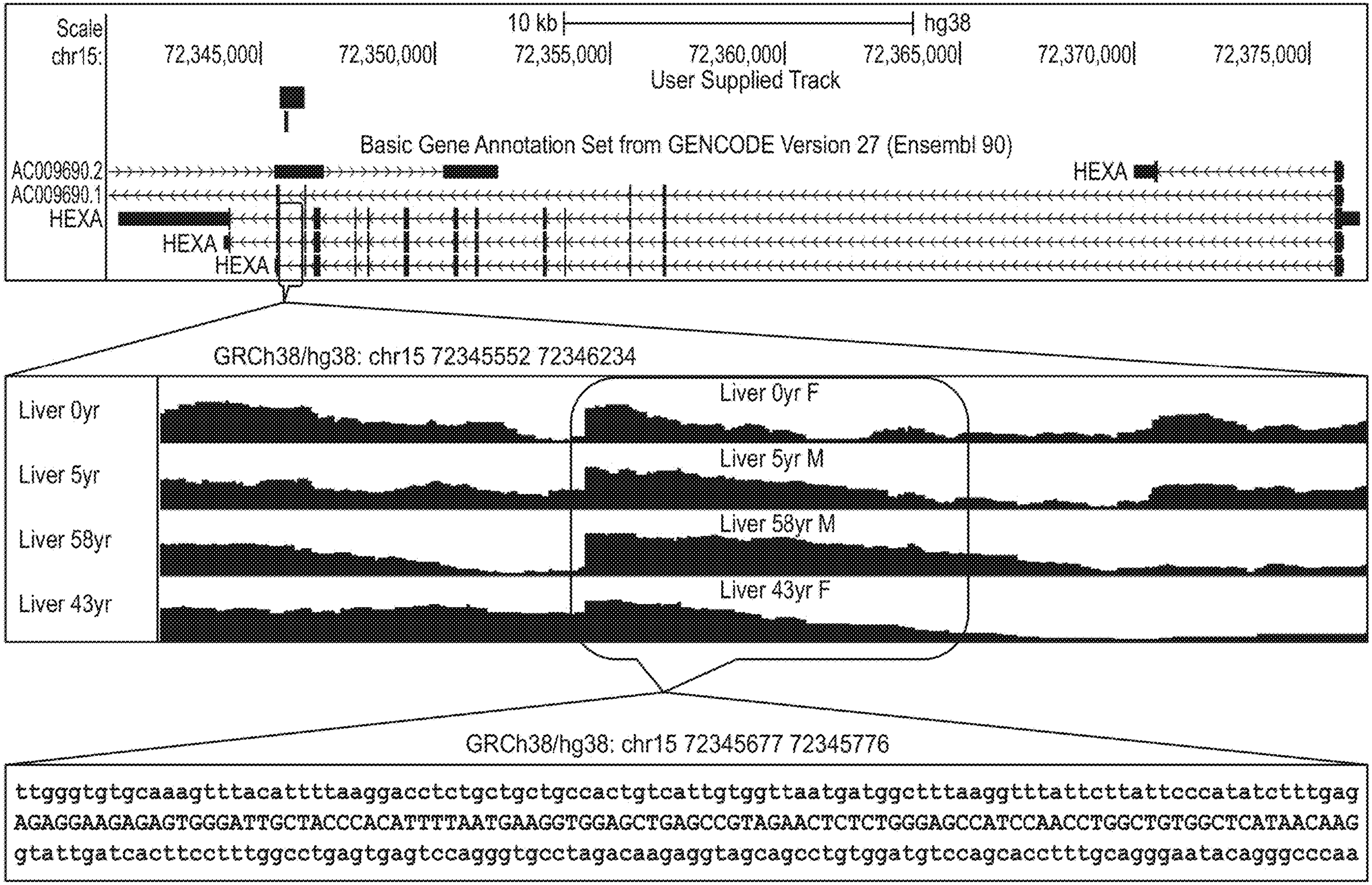
FIG. 52 depicts identification of an exemplary nonsense-mediated mRNA decay (NMD)-inducing exon in the HEXA gene. The identification of the NMD-inducing exon in the HEXA gene using RNA sequencing is shown, visualized in the UCSC genome browser. The upper panel shows a graphic representation of the HEXA gene to scale. Peaks corresponding to RNA sequencing reads were identified in intron GRCh38/hg38: chr15 72345552 72346234, shown in the middle panel. Bioinformatic analysis identified an exon-like sequence (bottom panel, sequence highlighted in uppercase) flanked by 3' and 5' splice sites. Inclusion of this exon leads to the introduction of a premature termination codon rendering the transcript a target of NMD.
Figure 53:
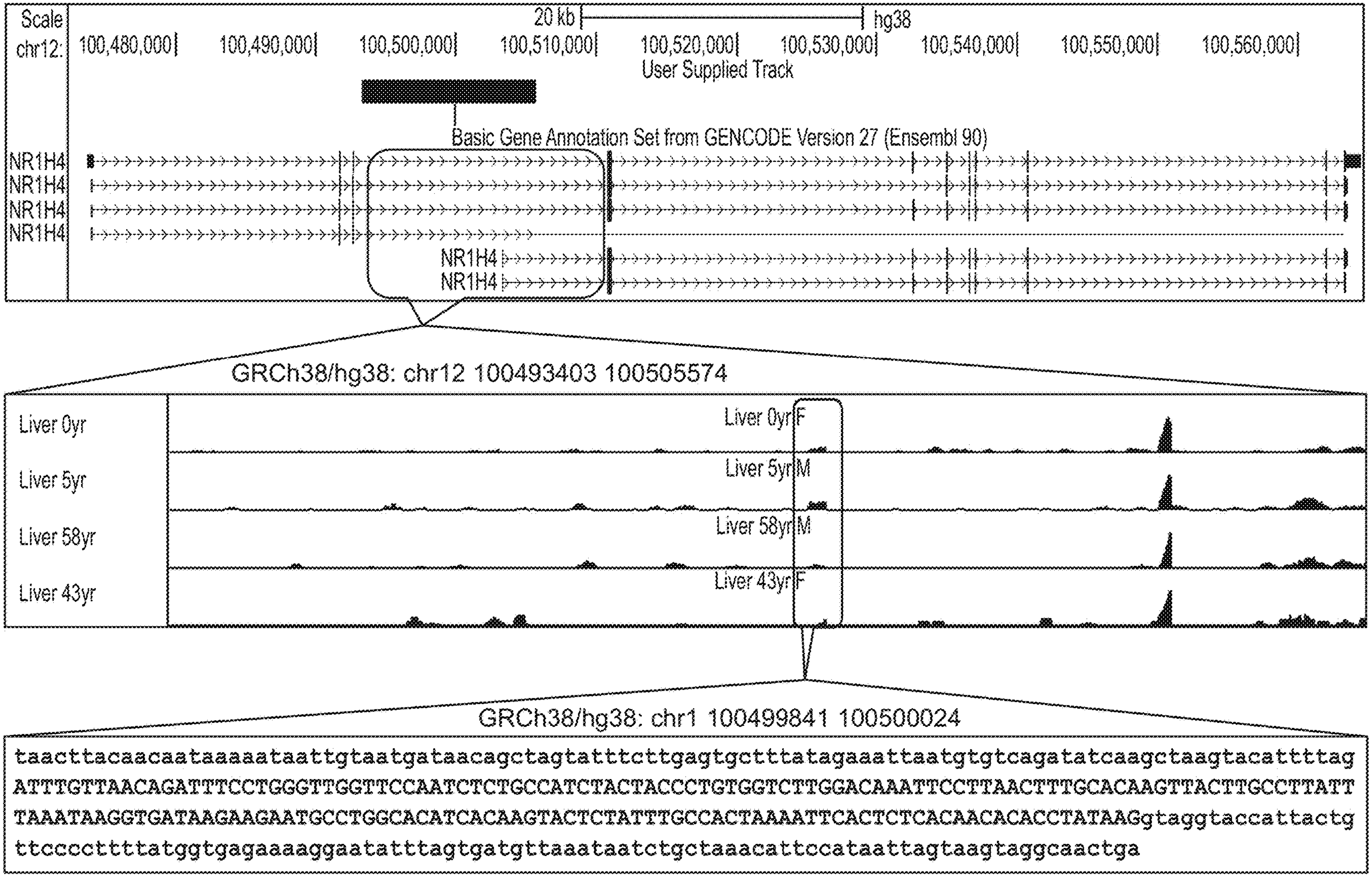
FIG. 53 depicts identification of an exemplary nonsense-mediated mRNA decay (NMD)-inducing exon in the NR1H4 gene. The identification of the NMD-inducing exon in the NR1H4 gene using RNA sequencing is shown, visualized in the UCSC genome browser. The upper panel shows a graphic representation of the NR1H4 gene to scale. Peaks corresponding to RNA sequencing reads were identified in intron GRCh38/hg38: chr12 100493403 100505574, shown in the middle panel. Bioinformatic analysis identified an exon-like sequence (bottom panel, sequence highlighted in uppercase) flanked by 3' and 5' splice sites. Inclusion of this exon leads to the introduction of a premature termination codon rendering the transcript a target of NMD.
Figure 54:
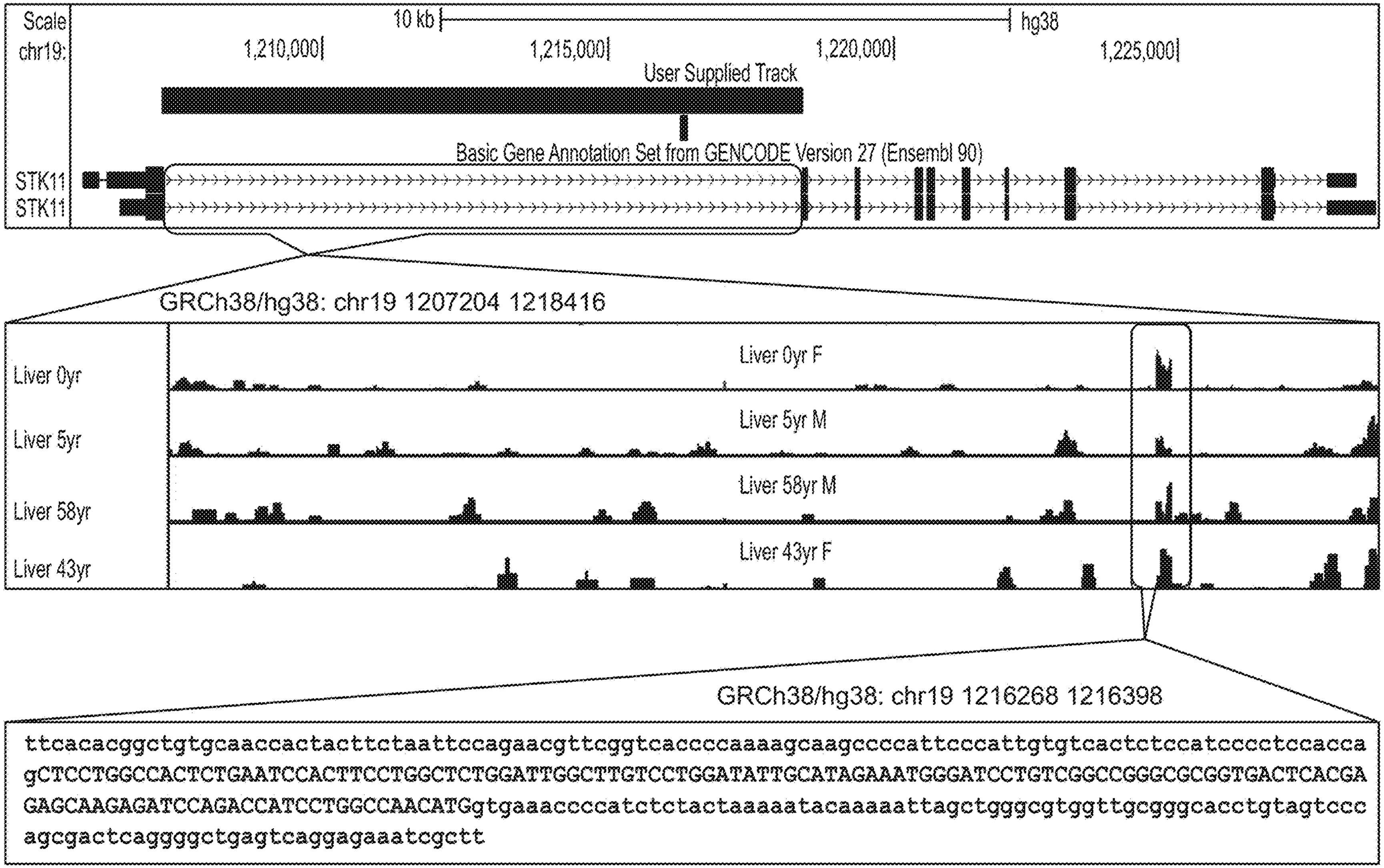
FIG. 54 depicts identification of an exemplary nonsense-mediated mRNA decay (NMD)-inducing exon in the STK11 gene. The identification of the NMD-inducing exon in the STK11 gene using RNA sequencing is shown, visualized in the UCSC genome browser. The upper panel shows a graphic representation of the STK11 gene to scale. Peaks corresponding to RNA sequencing reads were identified in intron GRCh38/hg38: chr19 1207204 1218416, shown in the middle panel. Bioinformatic analysis identified an exon-like sequence (bottom panel, sequence highlighted in uppercase) flanked by 3' and 5' splice sites. Inclusion of this exon leads to the introduction of a premature termination codon rendering the transcript a target of NMD.
Figure 55:
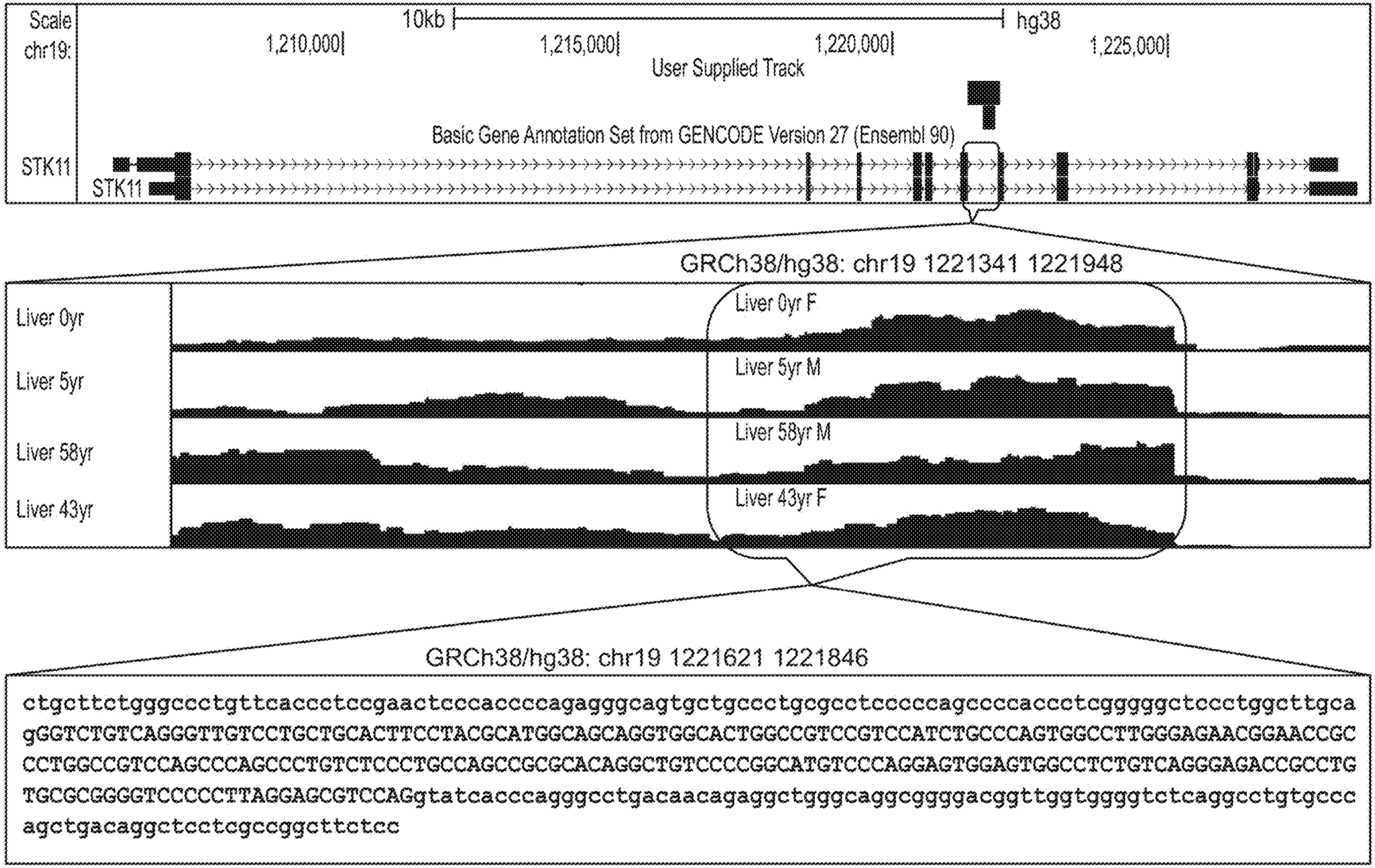
FIG. 55 depicts identification of an exemplary nonsense-mediated mRNA decay (NMD)-inducing exon in the STK11 gene. The identification of the NMD-inducing exon in the STK11 gene using RNA sequencing is shown, visualized in the UCSC genome browser. The upper panel shows a graphic representation of the STK11 gene to scale. Peaks corresponding to RNA sequencing reads were identified in intron GRCh38/hg38: chr19 1221341 1221948, shown in the middle panel. Bioinformatic analysis identified an exon-like sequence (bottom panel, sequence highlighted in uppercase) flanked by 3' and 5' splice sites. Inclusion of this exon leads to the introduction of a premature termination codon rendering the transcript a target of NMD.
Figure 56:
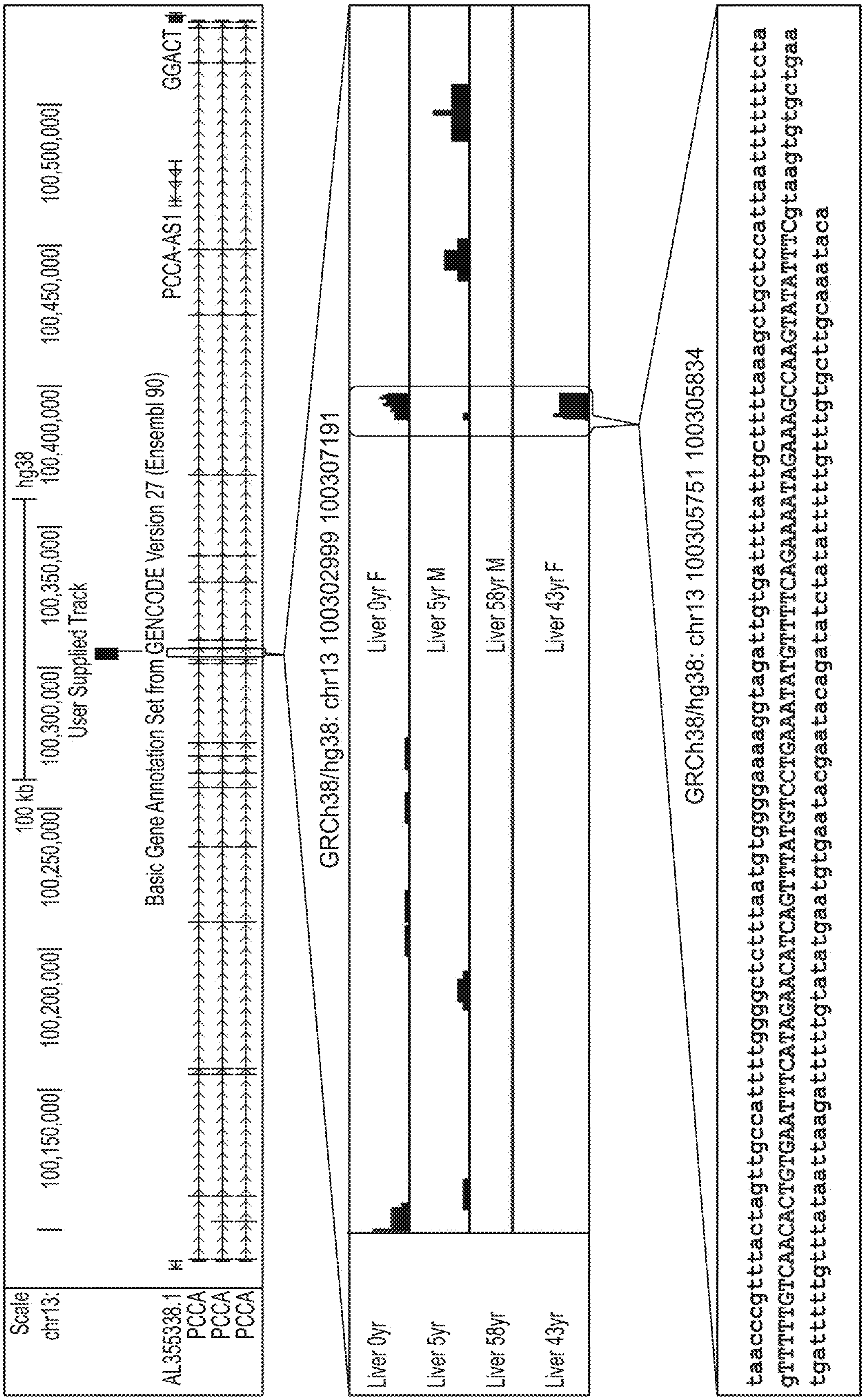
FIG. 56 depicts identification of an exemplary nonsense-mediated mRNA decay (NMD)-inducing exon in the PCCA gene. The identification of the NMD-inducing exon in the PCCA gene using RNA sequencing is shown, visualized in the UCSC genome browser. The upper panel shows a graphic representation of the PCCA gene to scale. Peaks corresponding to RNA sequencing reads were identified in intron GRCh38/hg38: chr13 100302999 100307191, shown in the middle panel. Bioinformatic analysis identified an exon-like sequence (bottom panel, sequence highlighted in uppercase) flanked by 3' and 5' splice sites. Inclusion of this exon leads to the introduction of a premature termination codon rendering the transcript a target of NMD.
Figure 57:
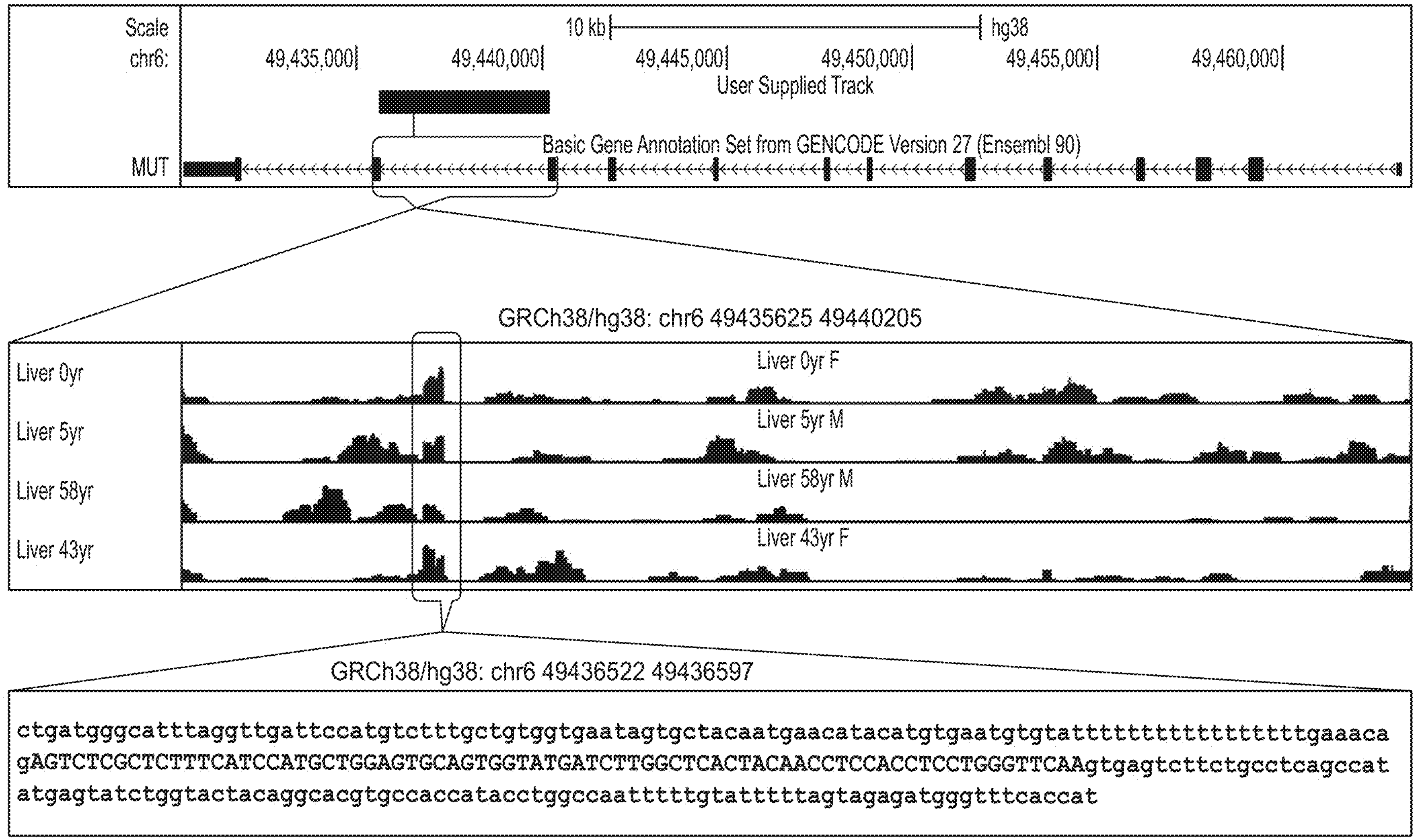
FIG. 57 depicts identification of an exemplary nonsense-mediated mRNA decay (NMD)-inducing exon in the MUT gene. The identification of the NMD-inducing exon in the MUT gene using RNA sequencing is shown, visualized in the UCSC genome browser. The upper panel shows a graphic representation of the MUT gene to scale. Peaks corresponding to RNA sequencing reads were identified in intron GRCh38/hg38: chr6 49435625 49440205, shown in the middle panel. Bioinformatic analysis identified an exon-like sequence (bottom panel, sequence highlighted in uppercase) flanked by 3' and 5' splice sites. Inclusion of this exon leads to the introduction of a premature termination codon rendering the transcript a target of NMD.
Figure 58:
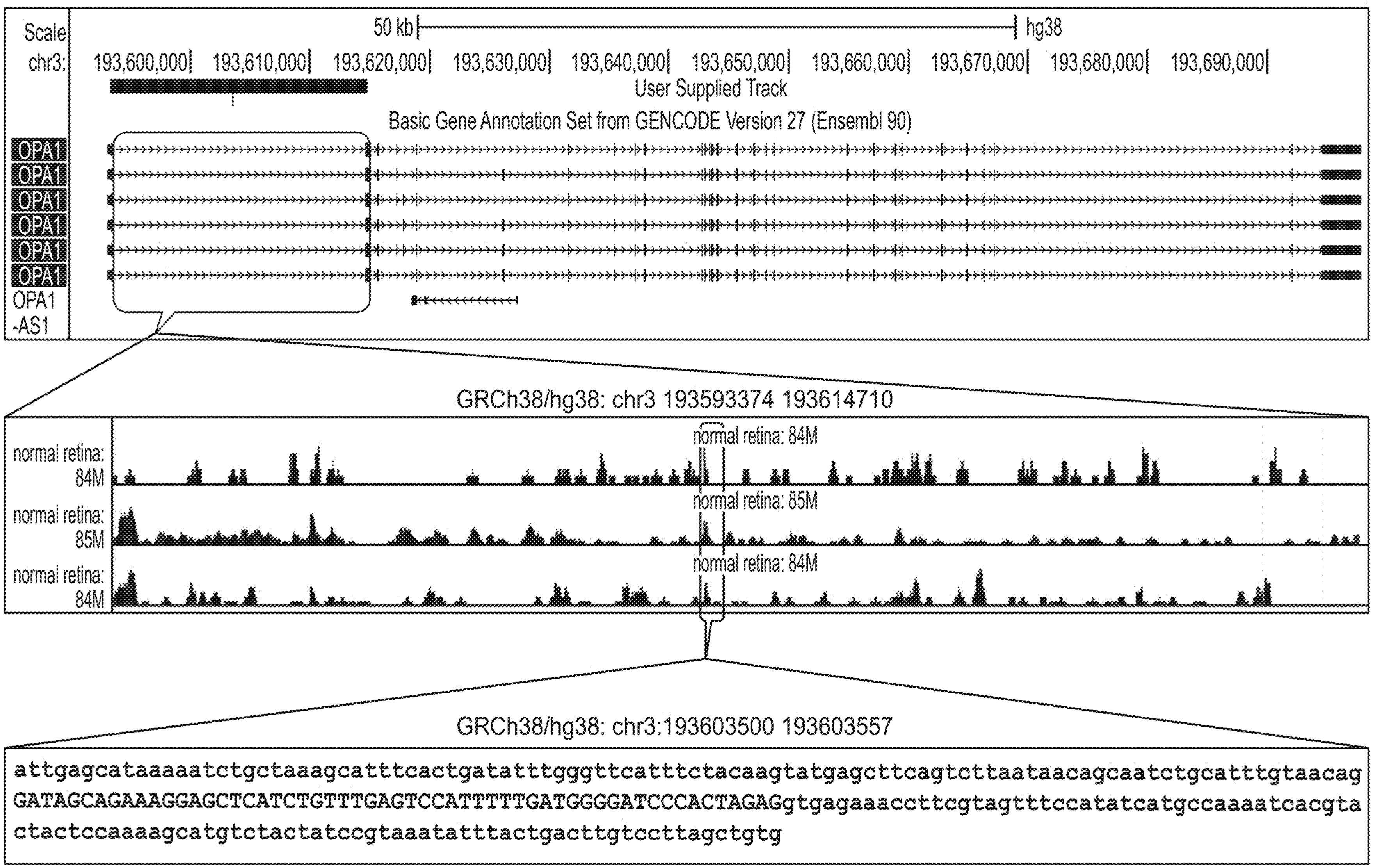
FIG. 58 depicts identification of an exemplary nonsense-mediated mRNA decay (NMD)-inducing exon in the OPA1 gene. The identification of the NMD-inducing exon in the OPA1 gene using RNA sequencing is shown, visualized in the UCSC genome browser. The upper panel shows a graphic representation of the OPA1 gene to scale. Peaks corresponding to RNA sequencing reads were identified in intron GRCh38/hg38: chr3 193593374 193614710, shown in the middle panel. Bioinformatic analysis identified an exon-like sequence (bottom panel, sequence highlighted in uppercase) flanked by 3' and 5' splice sites. Inclusion of this exon leads to the introduction of a premature termination codon rendering the transcript a target of NMD.
Figure 59:
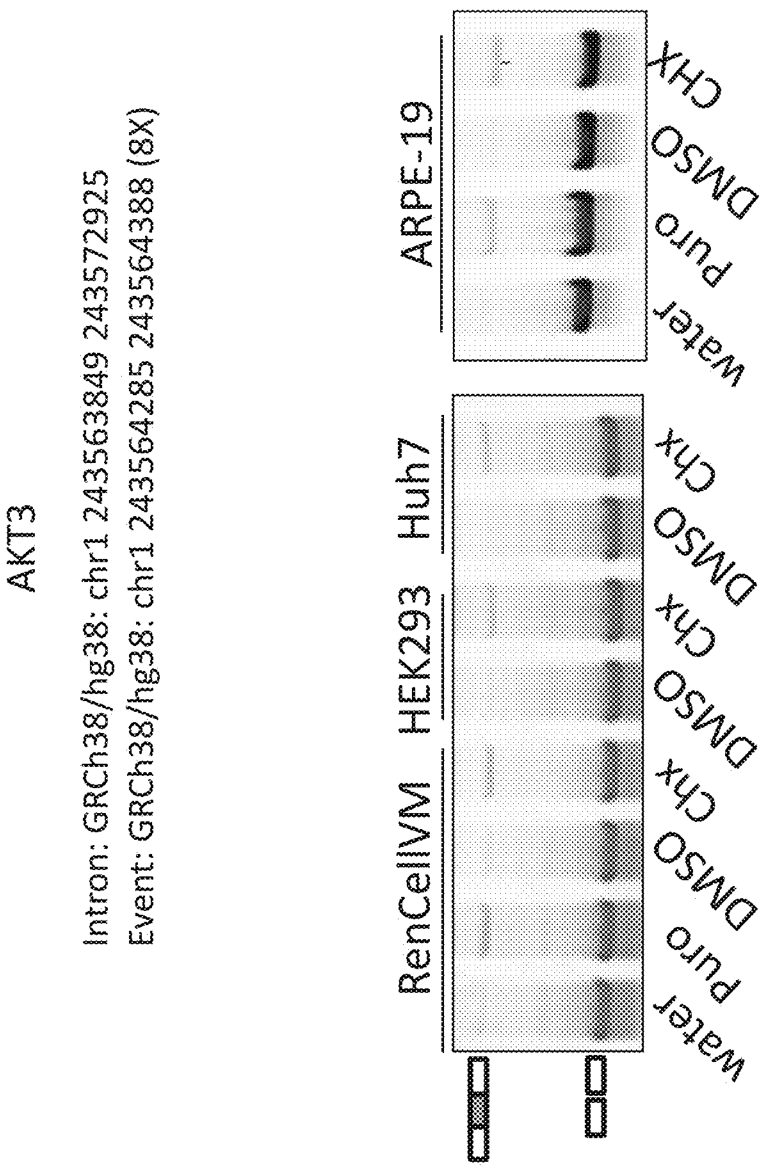
FIG. 59 depicts confirmation of NMD-inducing exon via puromycin or cycloheximide treatment in various cell lines. RT-PCR analysis using total RNA from water-treated, DMSO-treated, puromycin-treated, or cycloheximide-treated cells confirmed the presence of a band corresponding to the NMD-inducing exon 8×(GRCh38/hg38: chrl 243564285 243564388) of AKT3 gene.
Figure 60:
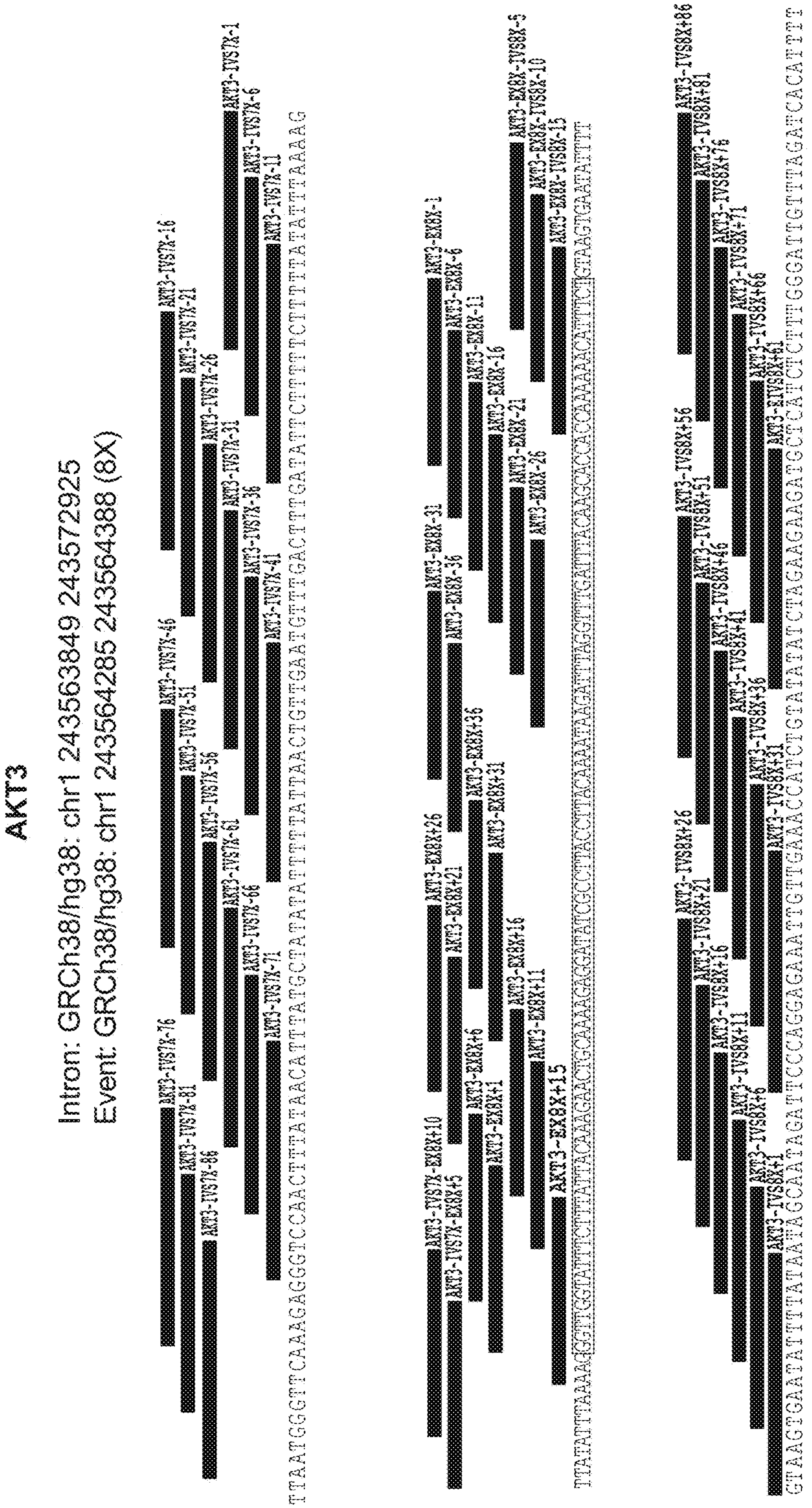
FIG. 60 depicts an exemplary ASO walk around AKT3 exon 8×(GRCh38/hg38: chrl 243564285 243564388) region. A graphic representation of an ASO walk performed for around AKT3 exon 8×(GRCh38/hg38: chrl 243564285 243564388) region targeting sequences upstream of the 3' splice site, across the 3' splice site, exon 8×, across the 5' splice site, and downstream of the 5' splice site is shown. ASOs were designed to cover these regions by shifting 5 nucleotides at a time.
Figure 61:
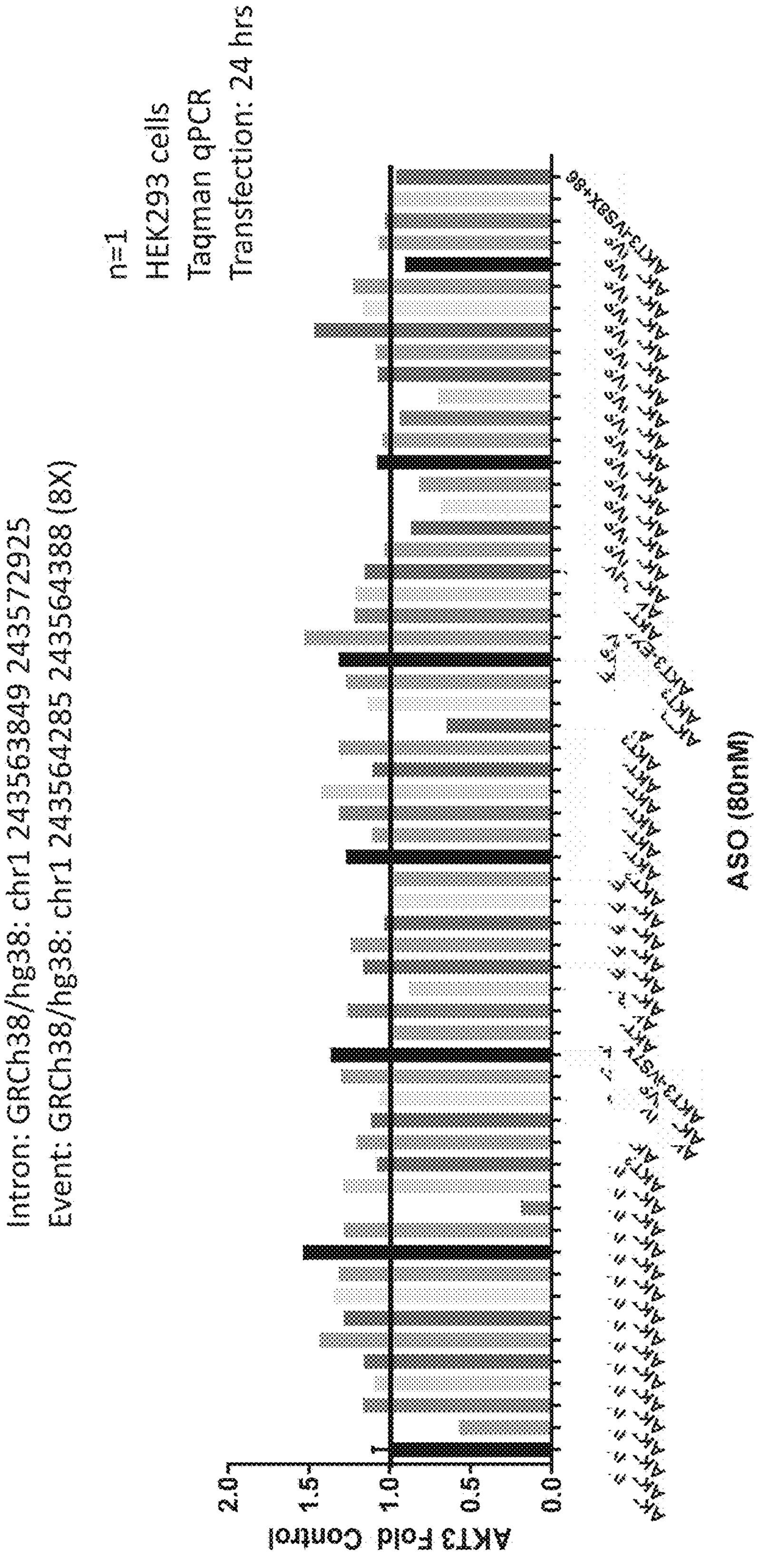
FIG. 61 depicts AKT3 exon 8×(GRCh38/hg38: chrl 243564285 243564388) region ASO walk evaluated by reverse transcription Taqman-qPCR. A graph of fold-change of the AKT3 productive mRNA product relative to Sham is plotted.
Figure 62:
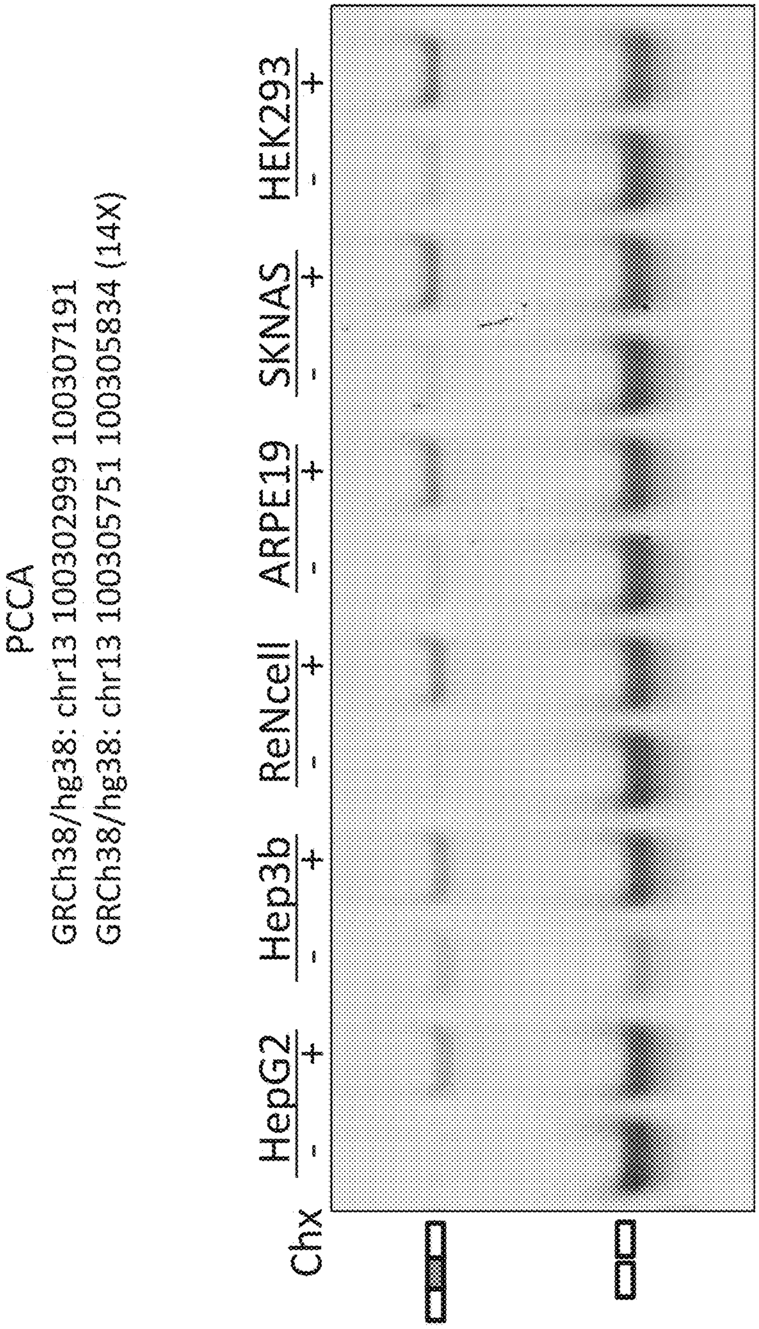
FIG. 62 depicts confirmation of NMD-inducing exon via cycloheximide treatment in various cell lines. RT-PCR analysis using total RNA from DMSO-treated or cycloheximide-treated cells confirmed the presence of a band corresponding to the NMD-inducing exon 14× (GRCh38/hg38: chr13 100305751 100305834) of PCCA gene.
Figure 63:
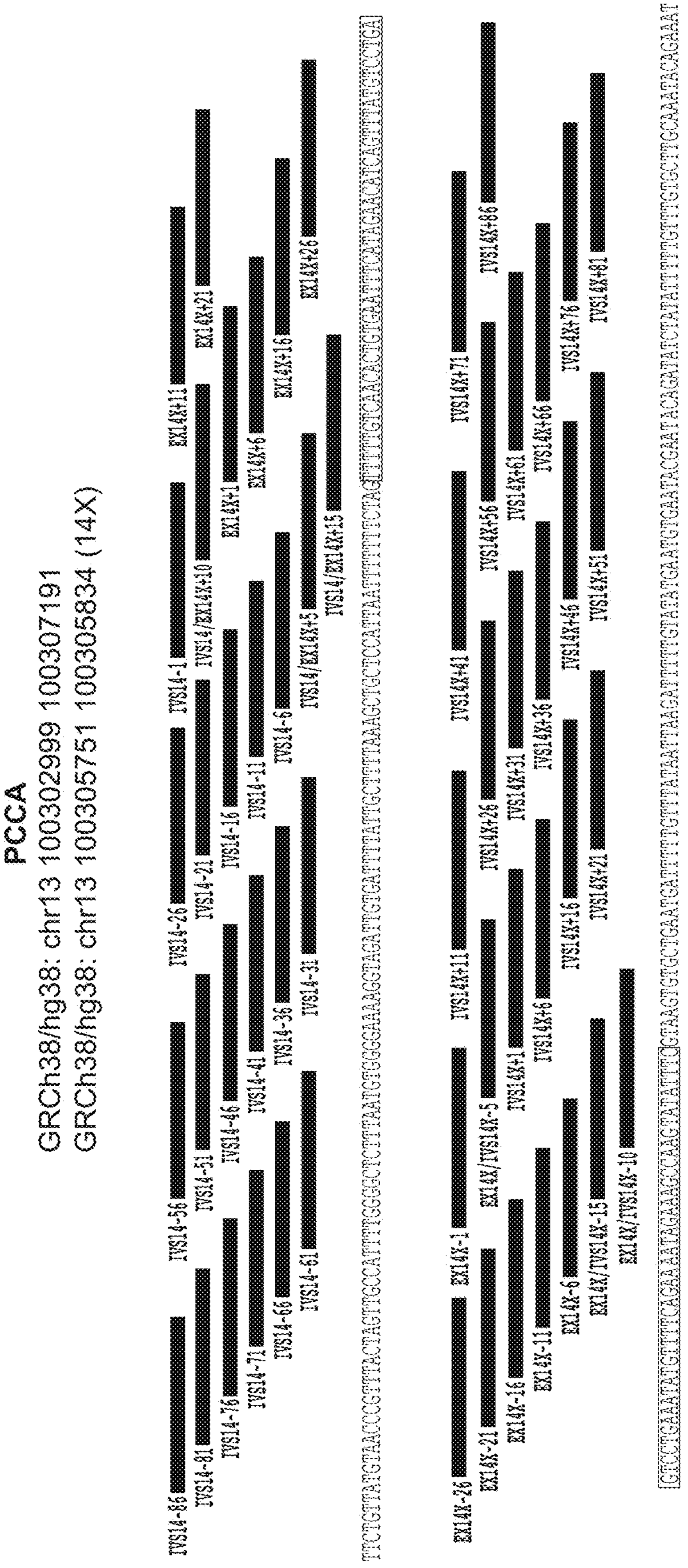
FIG. 63 depicts an exemplary ASO walk around PCCA exon 14×(GRCh38/hg38: chr13 100305751 100305834) region. A graphic representation of an ASO walk performed for around PCCA exon 14×(GRCh38/hg38: chr13 100305751 100305834) region targeting sequences upstream of the 3' splice site, across the 3' splice site, exon 14×, across the 5' splice site, and downstream of the 5' splice site is shown. ASOs were designed to cover these regions by shifting 5 nucleotides at a time.
Figure 64:
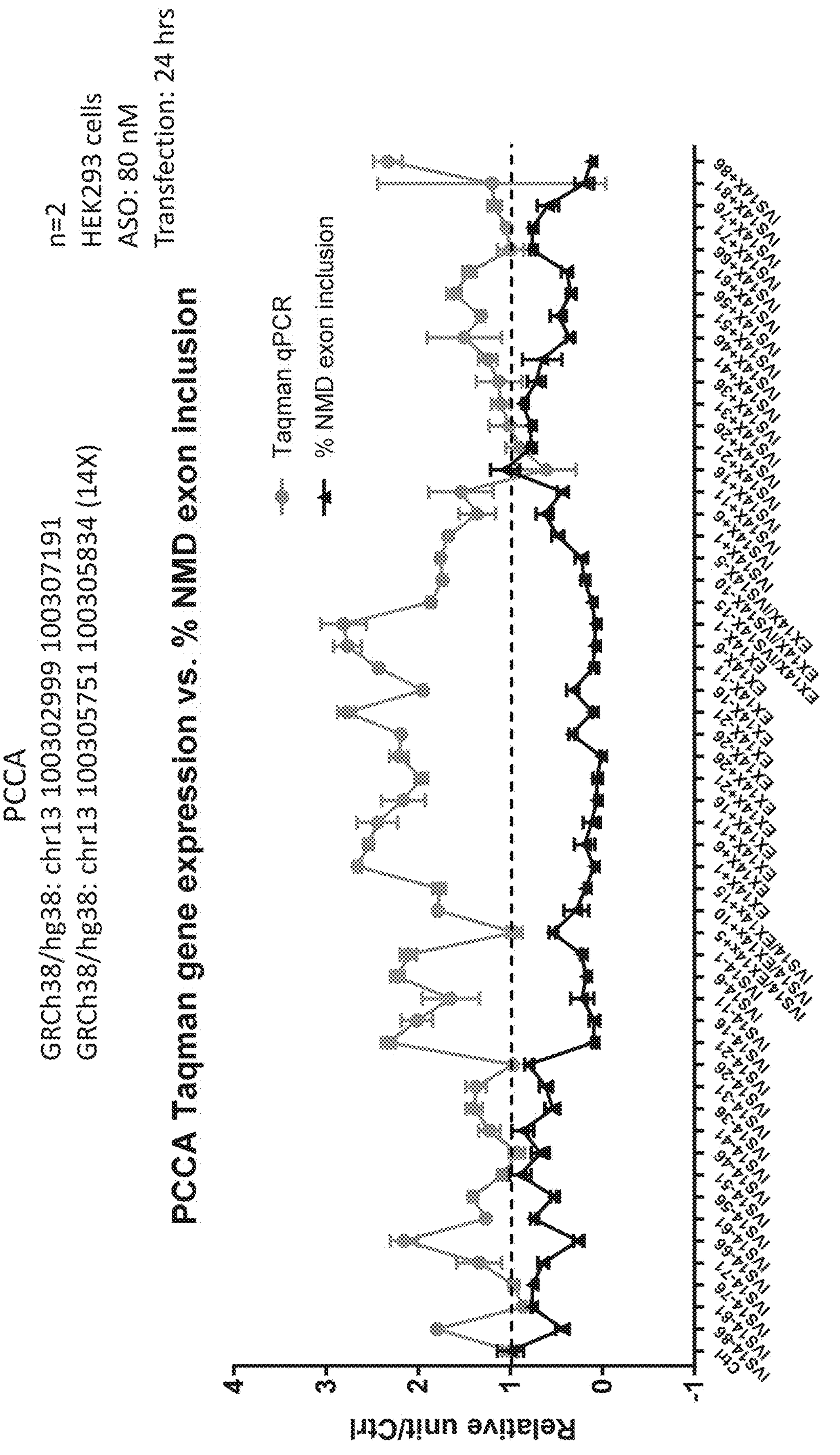
FIG. 64 depicts PCCA exon 14×(GRCh38/hg38: chr13 100305751 100305834) region ASO walk evaluated by reverse transcription Taqman-qPCR and RT-PCR. A graph of fold-change of the PCCA productive mRNA product relative to Sham (grey) and percentage change in NMD exon inclusion (black) is plotted.
Figure 65:
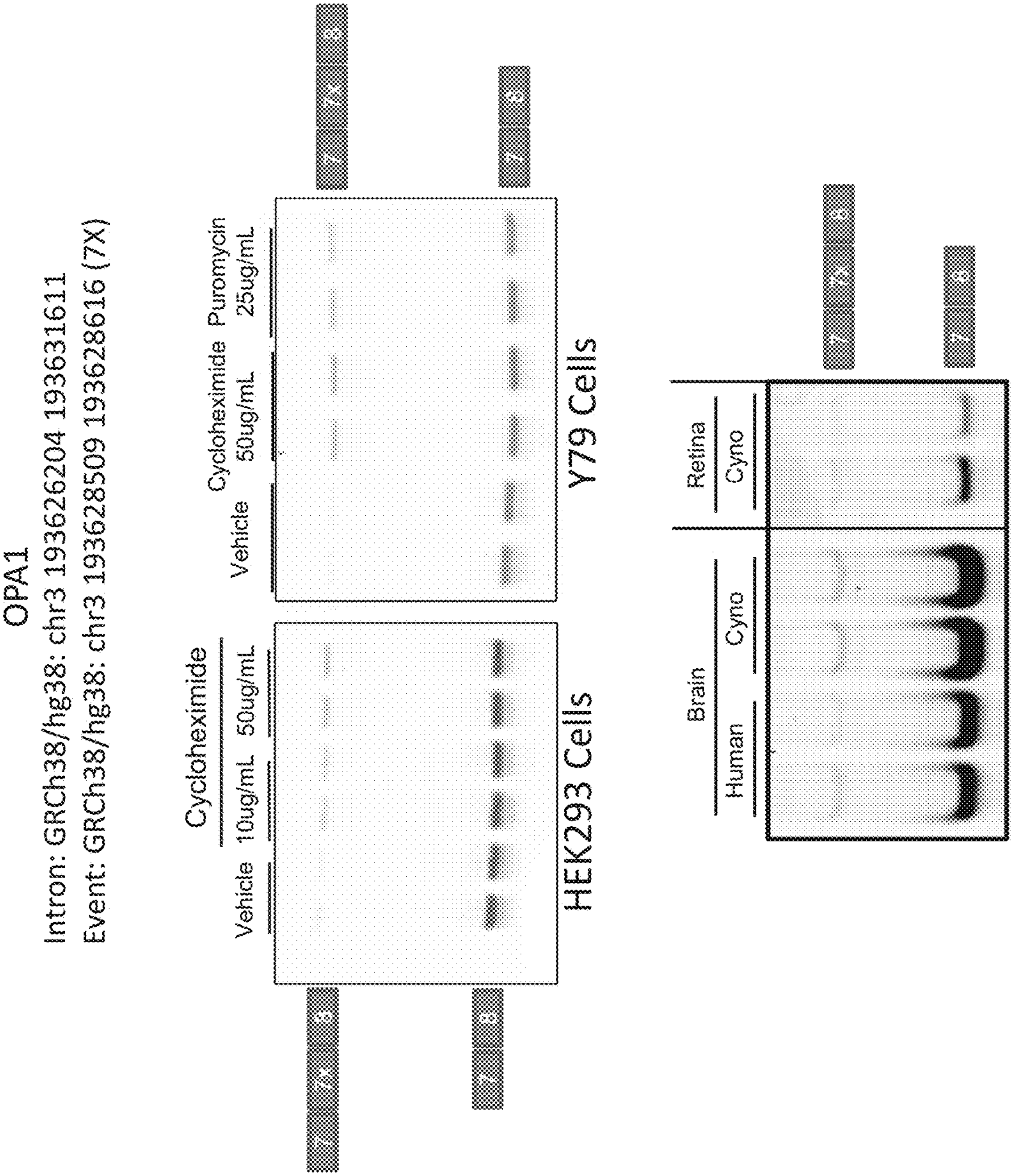
FIG. 65 depicts confirmation of NMD-inducing exon via puromycin or cycloheximide treatment in various cell lines, as well as the confirmation of NMD-inducing exon in brain and retina samples. RT-PCR analysis using total RNA from water-treated, DMSO-treated, puromycin-treated, or cycloheximide-treated cells confirmed the presence of a band corresponding to the NMD-inducing exon 7×(GRCh38/hg38: chr3 193628509 193628616) of OPA1 gene.
Figure 66:
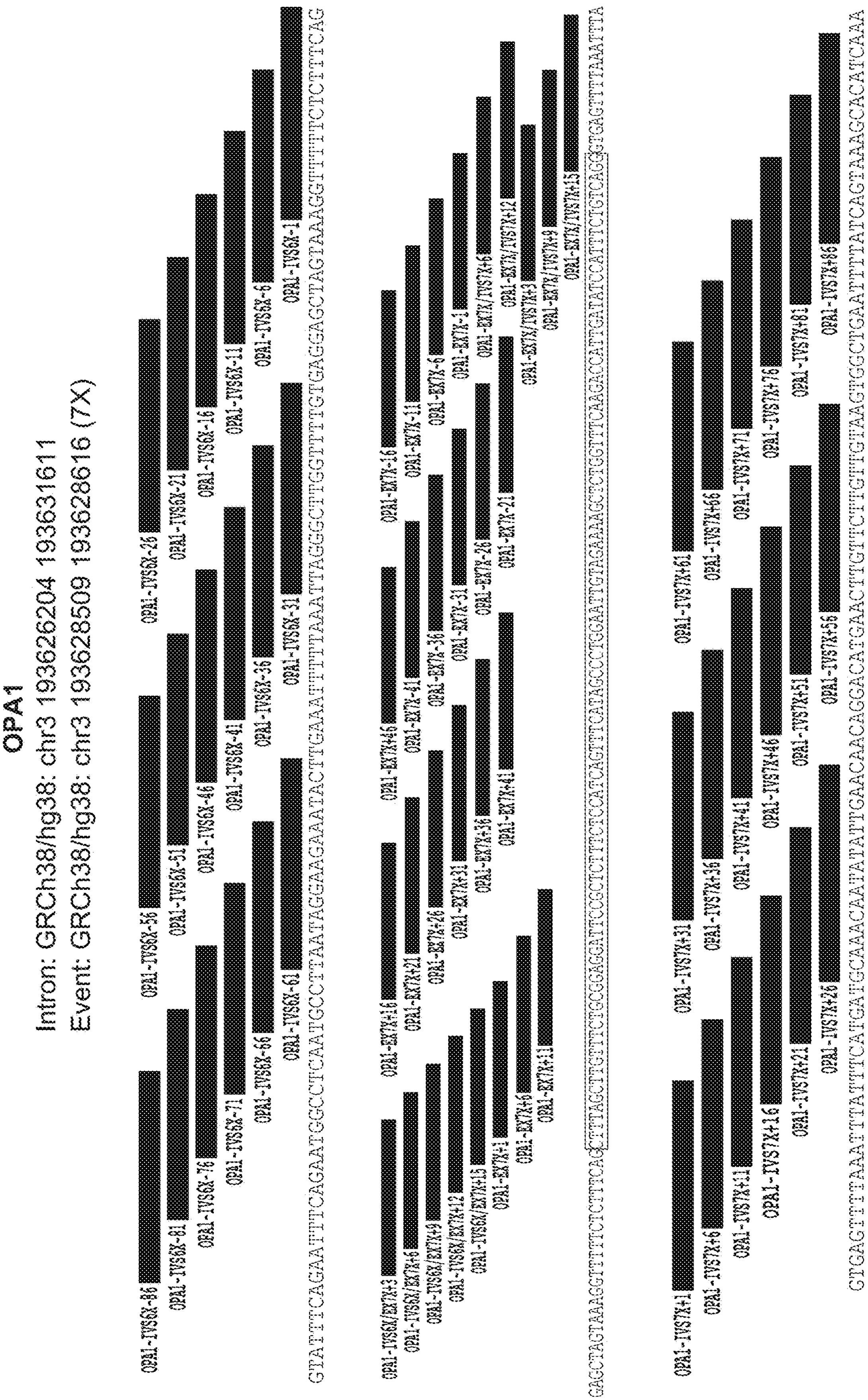
FIG. 66 depicts an exemplary ASO walk around OPA1 exon 7×(GRCh38/hg38: chr3 193628509 193628616) region. A graphic representation of an ASO walk performed for around OPA1 exon 7×(GRCh38/hg38: chr3 193628509 193628616) region targeting sequences upstream of the 3' splice site, across the 3' splice site, exon 7×, across the 5' splice site, and downstream of the 5' splice site is shown. ASOs were designed to cover these regions by shifting 5 nucleotides at a time or 3 nucleotides across the splice site regions.
Figure 67:
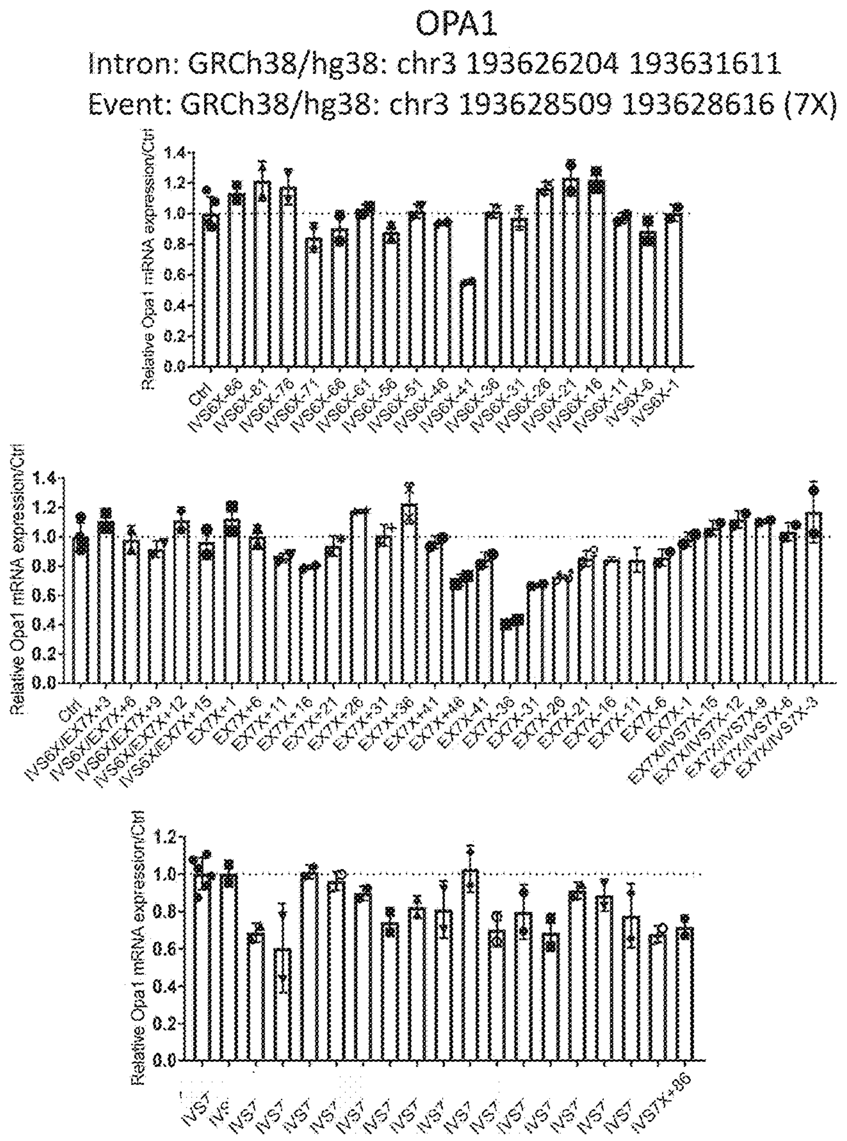
FIGS. 67 and 68 depict OPA1 exon 7×(GRCh38/hg38: chr3 193628509 193628616) region ASO walk evaluated by Taqman RT-qPCR. Graphs of fold-change of the OPA1 productive mRNA product relative to Sham are plotted.
Figure 68:
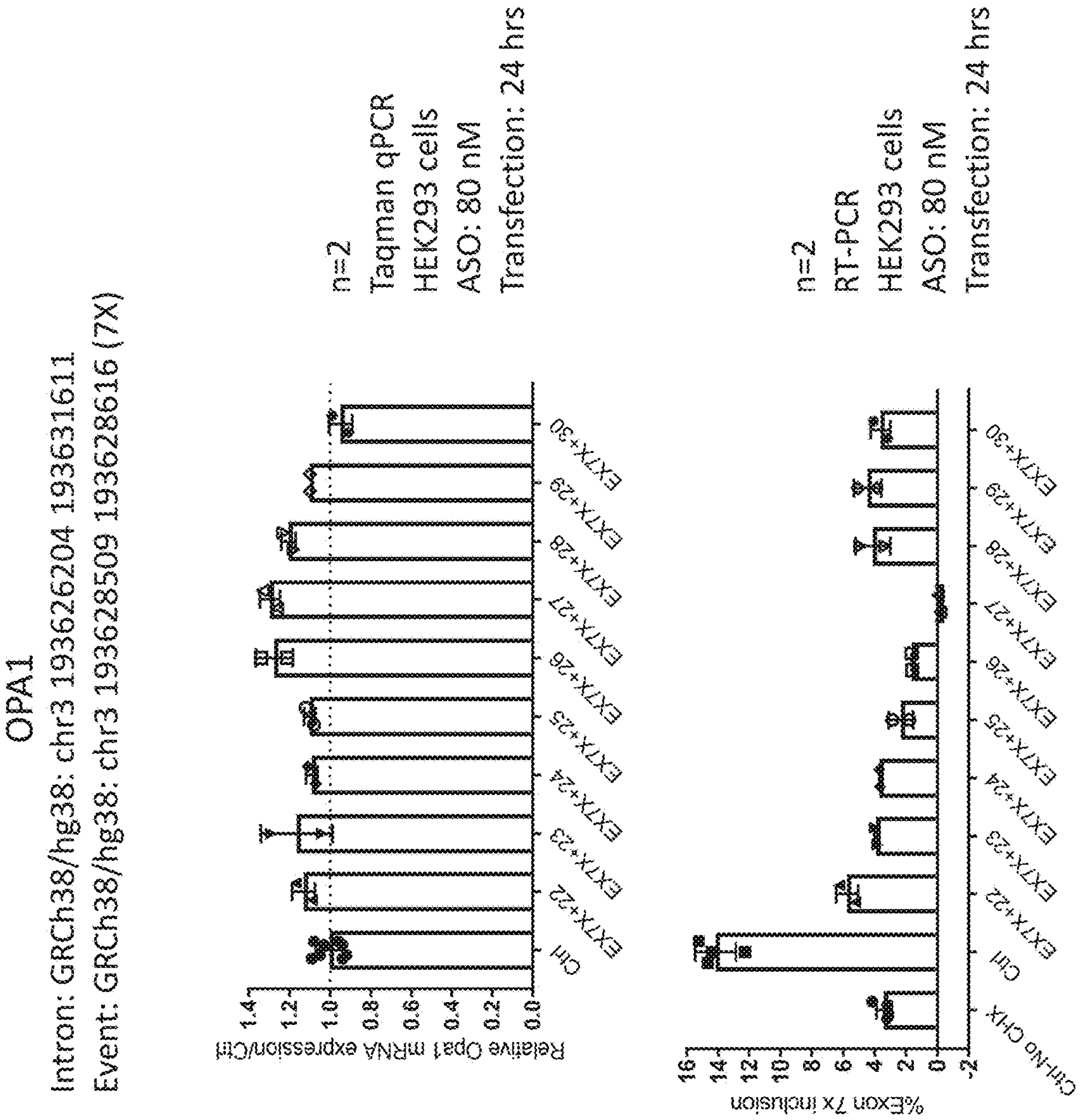
Figure 69:
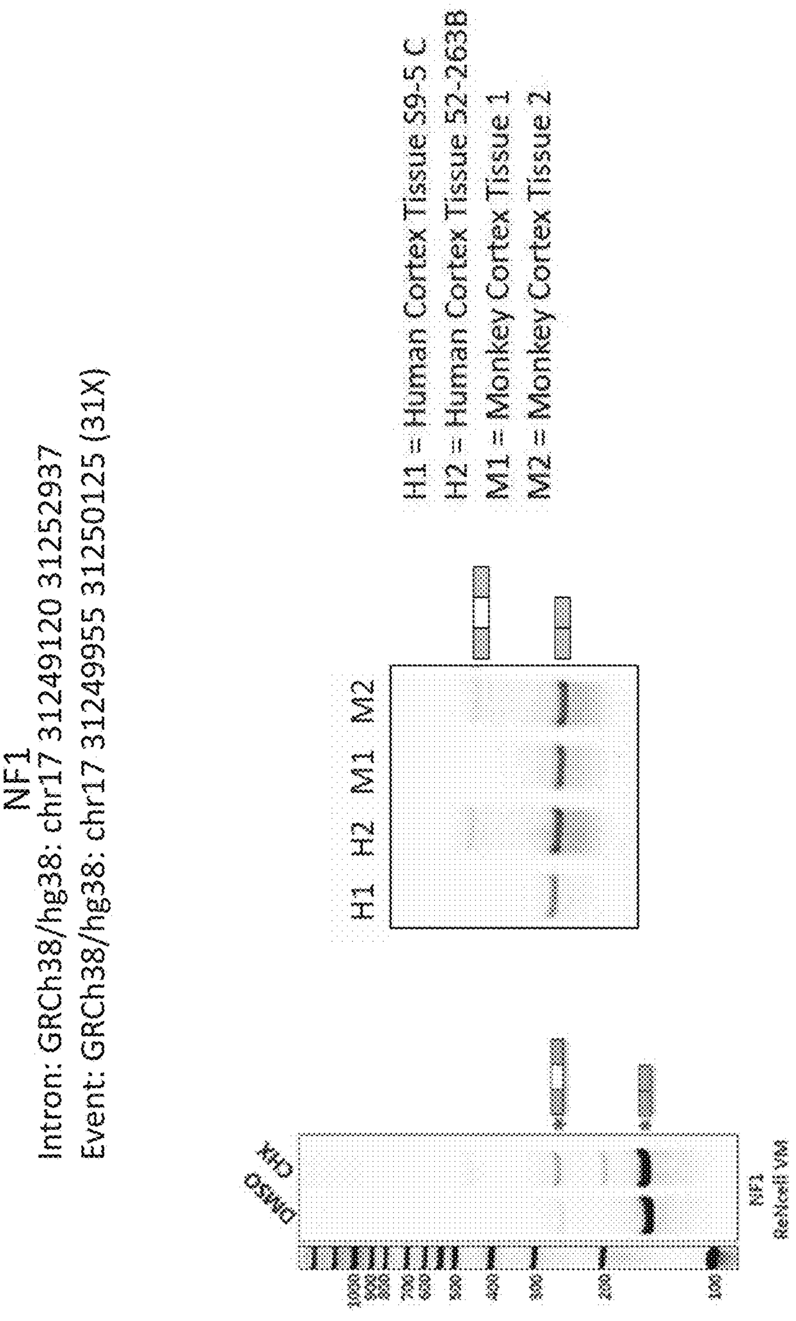
FIG. 69 depicts confirmation of NMD-inducing exon via cycloheximide treatment in ReNCell VM and existence of NMD-inducing exon mRNA (NF1) in both human and monkey cortices. RT-PCR analysis using total RNA from DMSO-treated or cycloheximide-treated cells confirmed the presence of a band corresponding to the NMD-inducing exon 31×(GRCh38/hg38: chr17 31249955 31250125) of NF1 gene.
Figure 70:
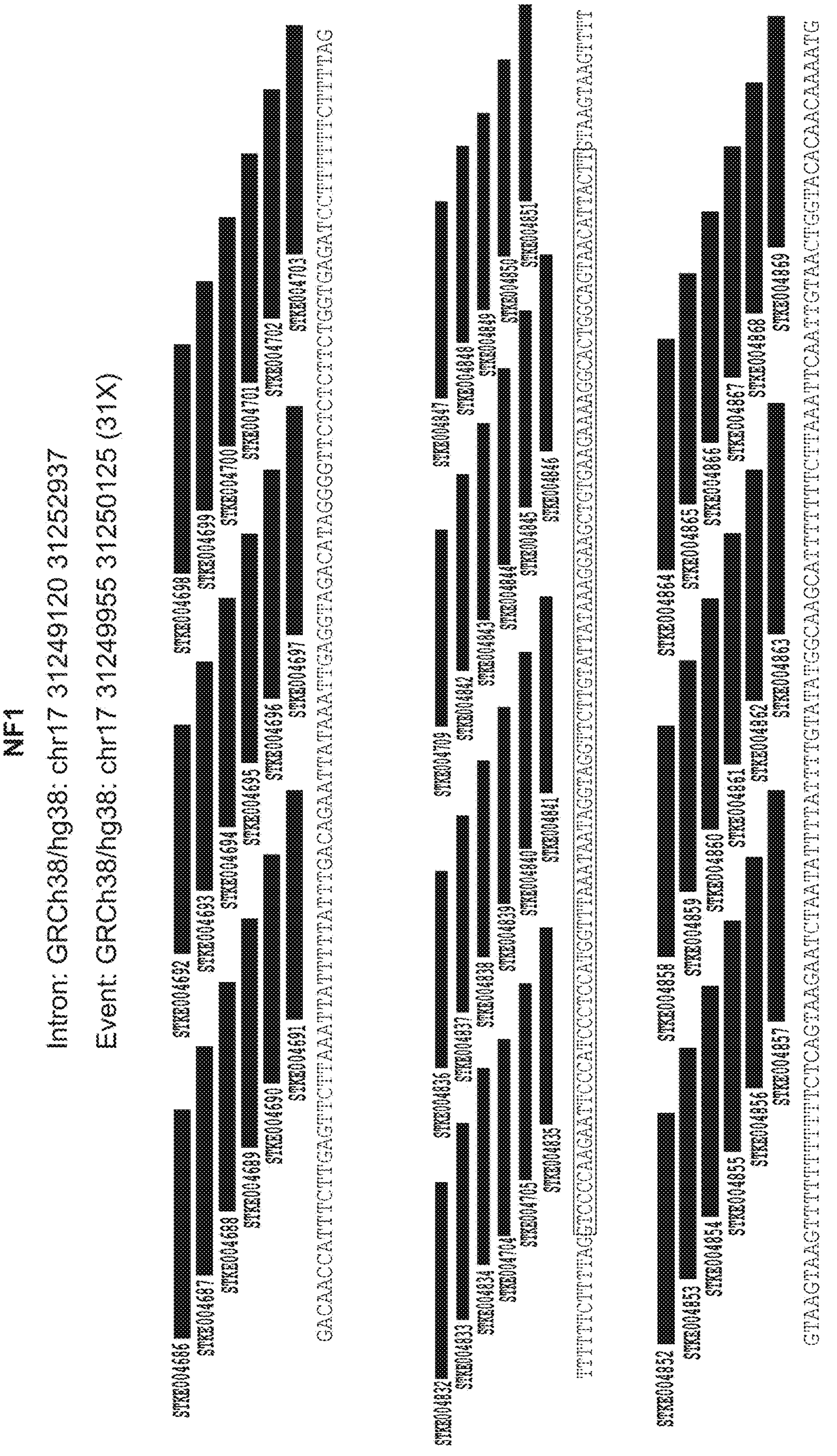
FIG. 70 depicts an exemplary ASO walk around NF1 exon 31×(GRCh38/hg38: chr17 31249955 31250125) region. A graphic representation of an ASO walk performed for around NF1 exon 31×(GRCh38/hg38: chr17 31249955 31250125) region targeting sequences upstream of the 3' splice site, across the 3' splice site, exon 31×, across the 5' splice site, and downstream of the 5' splice site is shown. ASOs were designed to cover these regions by shifting 5 nucleotides at a time.

Example 1: Identification of NMD-Inducing Exon Inclusion Events in Transcripts by RNAseq Using Next Generation Sequencing Whole transcriptome shotgun sequencing is carried out using next generation sequencing to reveal a snapshot of transcripts produced by the genes described herein to identify NIE inclusion events. For this purpose, polyA+RNA from nuclear and cytoplasmic fractions of human cells is isolated and cDNA libraries are constructed using Illumina's TruSeq Stranded mRNA library Prep Kit. The libraries are pair-end sequenced resulting in 100-nucleotide reads that are mapped to the human genome (February 2009, GRCh37/hg19 assembly). FIGS. 2-58 depict identification of different exemplary nonsense-mediated mRNA decay (NMD)-inducing exons in various genes.

Exemplary genes and intron sequences are summarized in Table 1 and Table 2 (SEQ ID NOs indicate the corresponding nucleotide sequences represented by the Gene ID Nos). The sequence for each intron is summarized in Table 3 and Table 4.

Lengthy table referenced here

US12797487-20261117-T00001

Please refer to the end of the specification for access instructions.

Lengthy table referenced here

US12797487-20261117-T00002

Please refer to the end of the specification for access instructions.

Lengthy table referenced here

US12797487-20261117-T00003

Please refer to the end of the specification for access instructions.

Lengthy table referenced here

US12797487-20261117-T00004

Please refer to the end of the specification for access instructions.

Example 2: Confirmation of NIE Via Cycloheximide Treatment

RT-PCR analysis using cytoplasmic RNA from DMSO-treated or puromycin or cycloheximide-treated human cells and primers in exons can confirm the presence of a band corresponding to an NMD-inducing exon. The identity of the product is confirmed by sequencing. Densitometry analysis of the bands is performed to calculate percent NMD exon inclusion of total transcript. Treatment of cells with cycloheximide or puromycin to inhibit NMD can lead to an increase of the product corresponding to the NMD-inducing exon in the cytoplasmic fraction. FIGS. 59, 62, 65, 69, 72, and 75 depict confirmation of exemplary NIE exons in various gene transcripts using cycloheximide or puromycin treatment, respectively.

Example 3: NMD Exon Region ASO Walk

An ASO walk is performed for NMD exon region targeting sequences immediately upstream of the 3' splice site, across the 3'splice site, the NMD exon, across the 5' splice site, and downstream of the 5' splice site using 2'-MOE ASOs, PS backbone. ASOs are designed to cover these regions by shifting 5 nucleotides at a time. FIGS. 60, 63, 66, 70, 73, and 76 depict ASO walk for various exemplary NIE exon regions, respectively.

Example 4: NMD Exon Region ASO Walk Evaluated by RT-PCR

Figure 71:
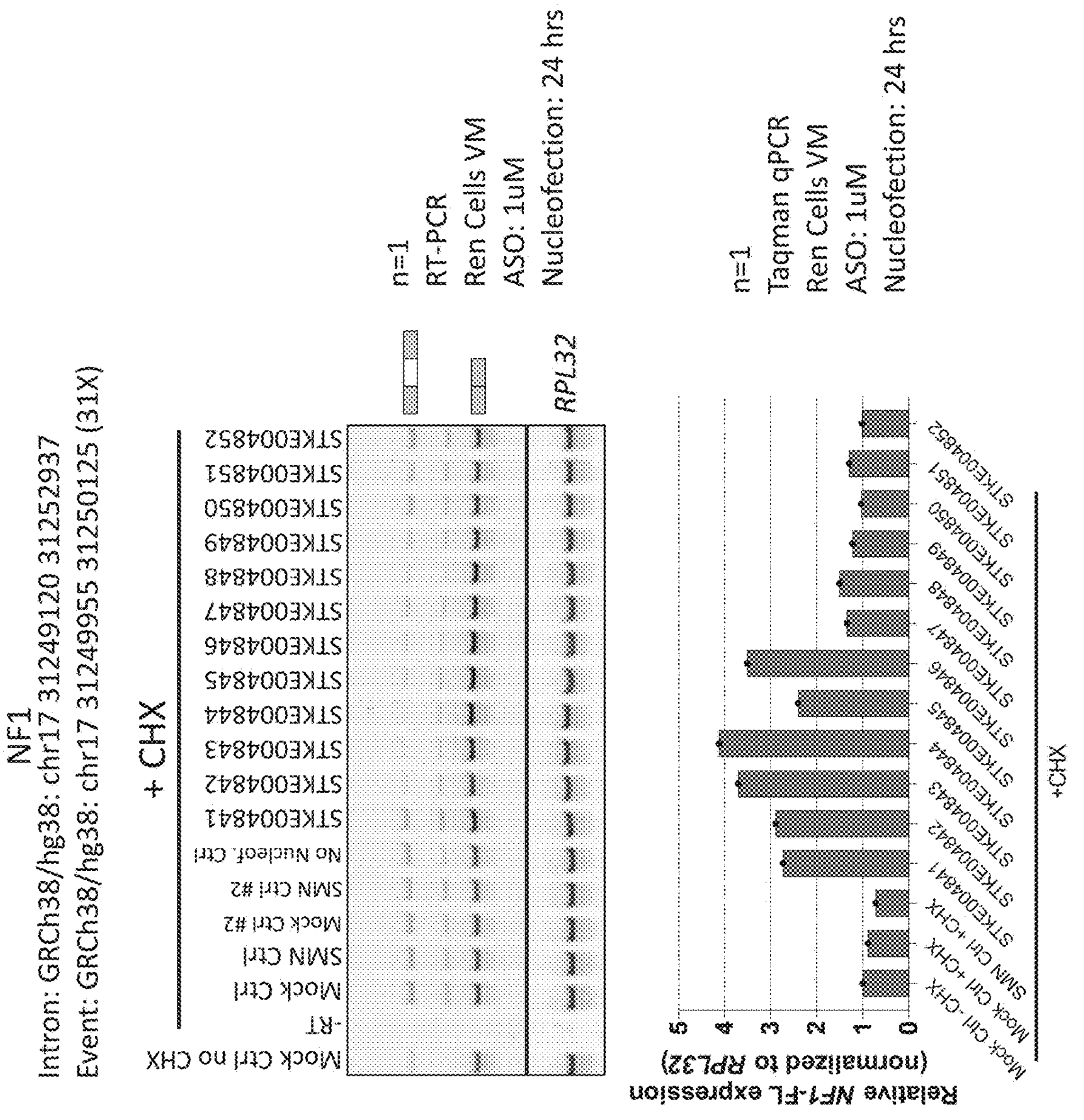
FIG. 71 depicts NF1 exon 31×(GRCh38/hg38: chr17 31249955 31250125) region ASO walk evaluated by RT-PCR (top) and RT-Taqman-qPCR (bottom). RT-PCR results indicating a decrease in exon 31× and a graph of fold-change of the NF1 productive mRNA product relative to Sham are shown.
Figure 72:
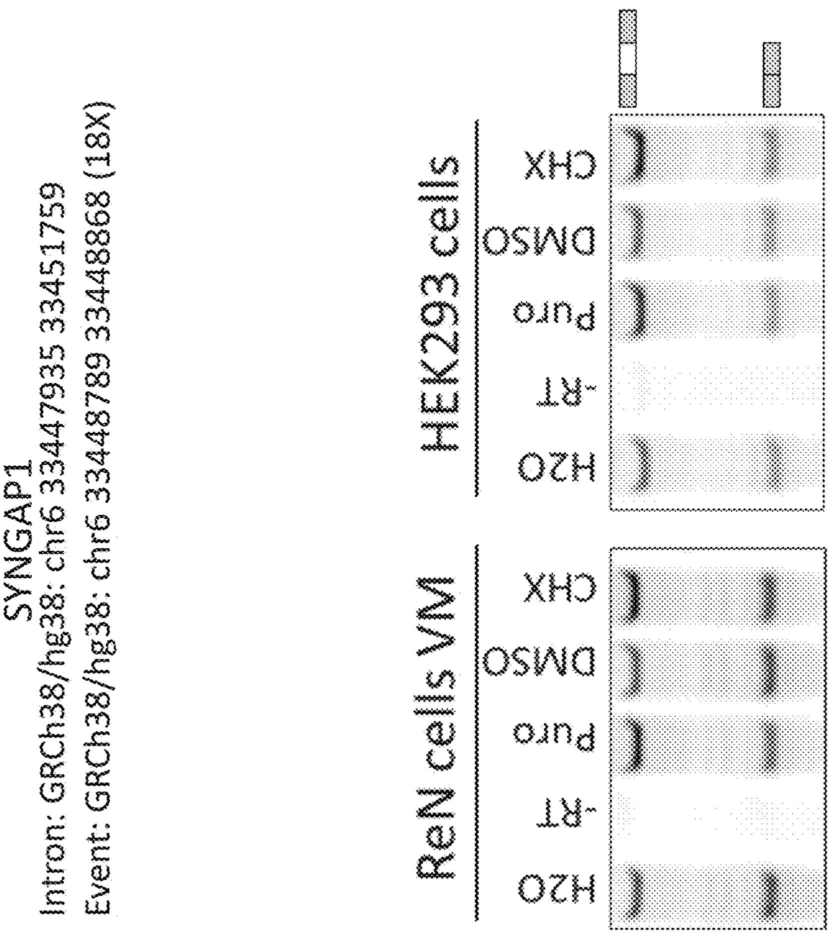
FIG. 72 depicts confirmation of NMD-inducing exon via puromycin or cycloheximide treatment in various cell lines. RT-PCR analysis using total RNA from water-treated, DMSO-treated, puromycin-treated, or cycloheximide-treated cells confirmed the presence of a band corresponding to the NMD-inducing exon 18×(GRCh38/hg38: chr6 33448789 33448868) of SYNGAP1 gene.
Figure 73:
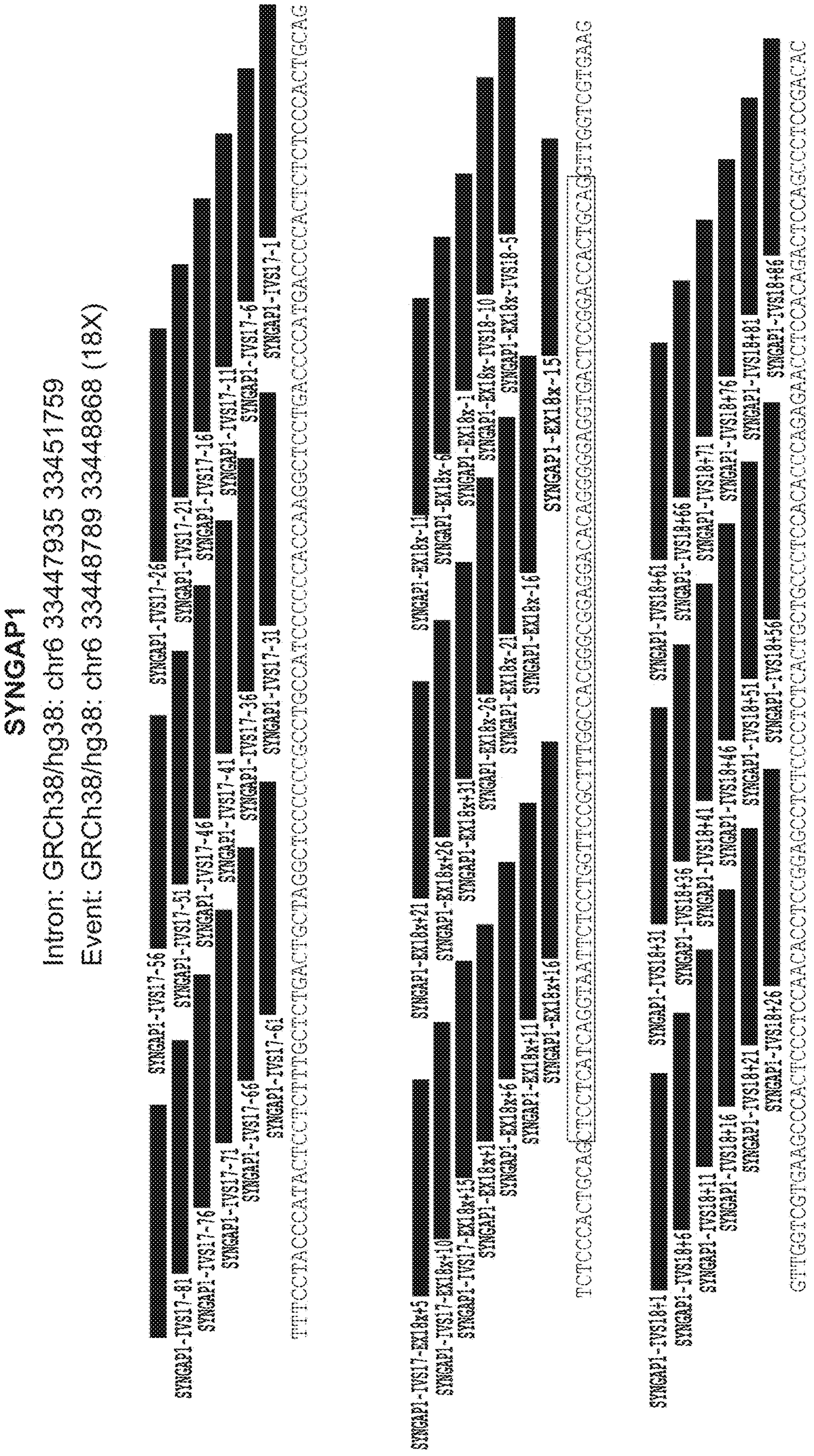
FIG. 73 depicts an exemplary ASO walk around SYNGAP1 exon 18×(GRCh38/hg38: chr6 33448789 33448868) region. A graphic representation of an ASO walk performed for around SYNGAP1 exon 18×(GRCh38/hg38: chr6 33448789 33448868) region targeting sequences upstream of the 3' splice site, across the 3' splice site, exon 18×, across the 5' splice site, and downstream of the 5' splice site is shown. ASOs were designed to cover these regions by shifting 5 nucleotides at a time.
Figure 74:
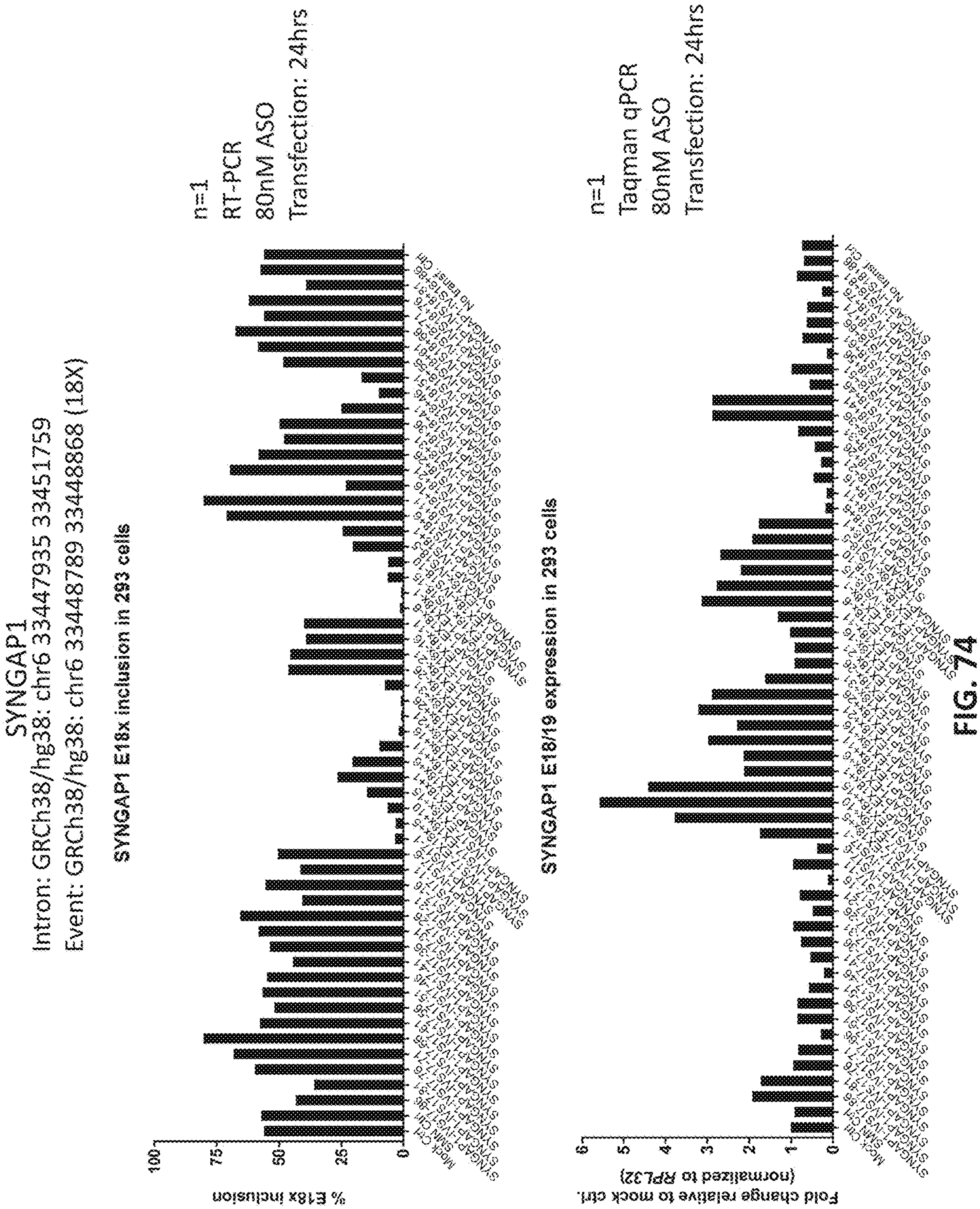
FIG. 74 depicts SYNGAP1 exon 18×(GRCh38/hg38: chr6 33448789 33448868) region ASO walk evaluated by RT-PCR (top) and Taqman-qPCR (bottom). Graphs of % exon 18× inclusion and fold-change of the SYNGAP1 productive mRNA product relative to Sham are plotted (top and bottom, respectively).
Figure 75:
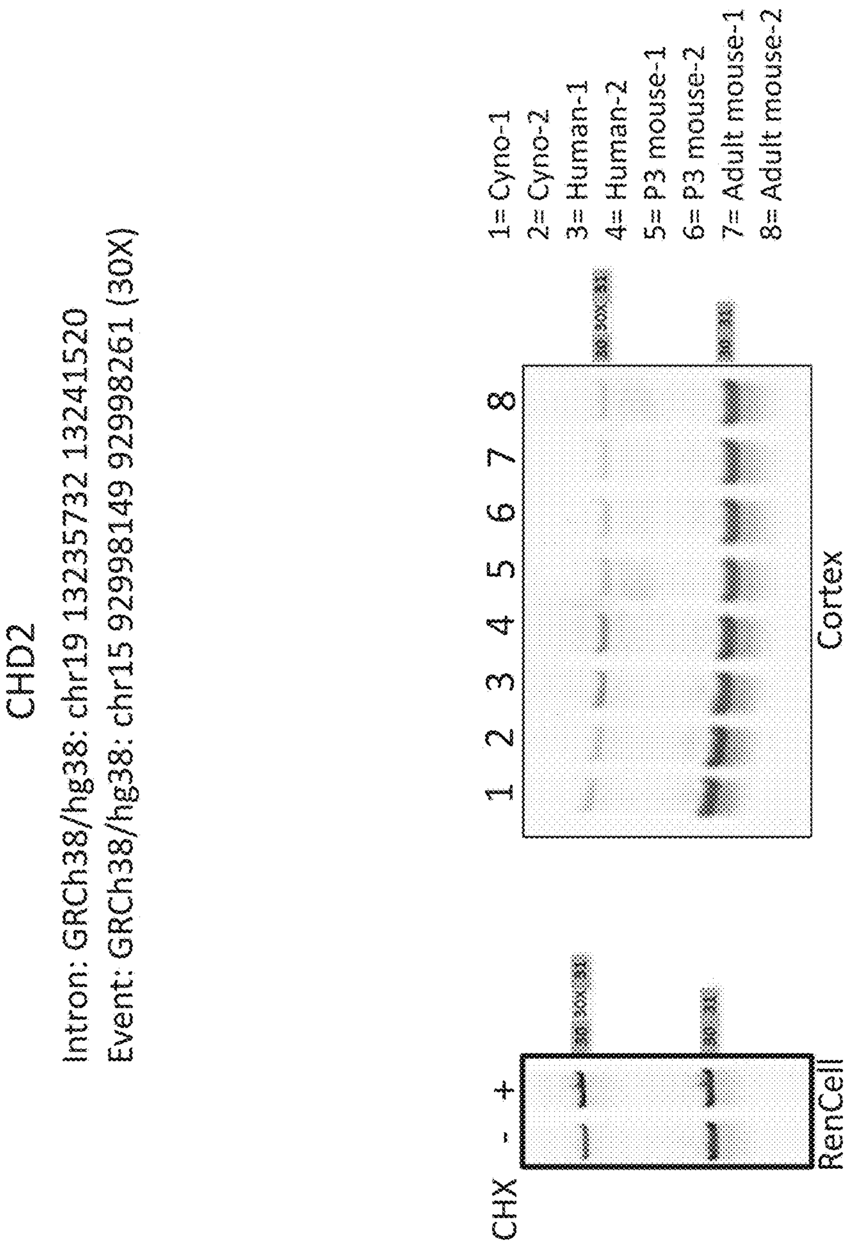
FIG. 75 depicts confirmation of NMD-inducing exon via cycloheximide treatment. RT-PCR analysis using total RNA from DMSO-treated or cycloheximide-treated cells confirmed the presence of a band corresponding to the NMD-inducing exon 30×(GRCh38/hg38: chr15 92998149 92998261) of CHD2 gene. Also shown is the RT-PCR analysis demonstrating the presence of mRNA containing NMD-inducing exon 30× in cortex samples from mouse, non-human primate and human.
Figure 76:
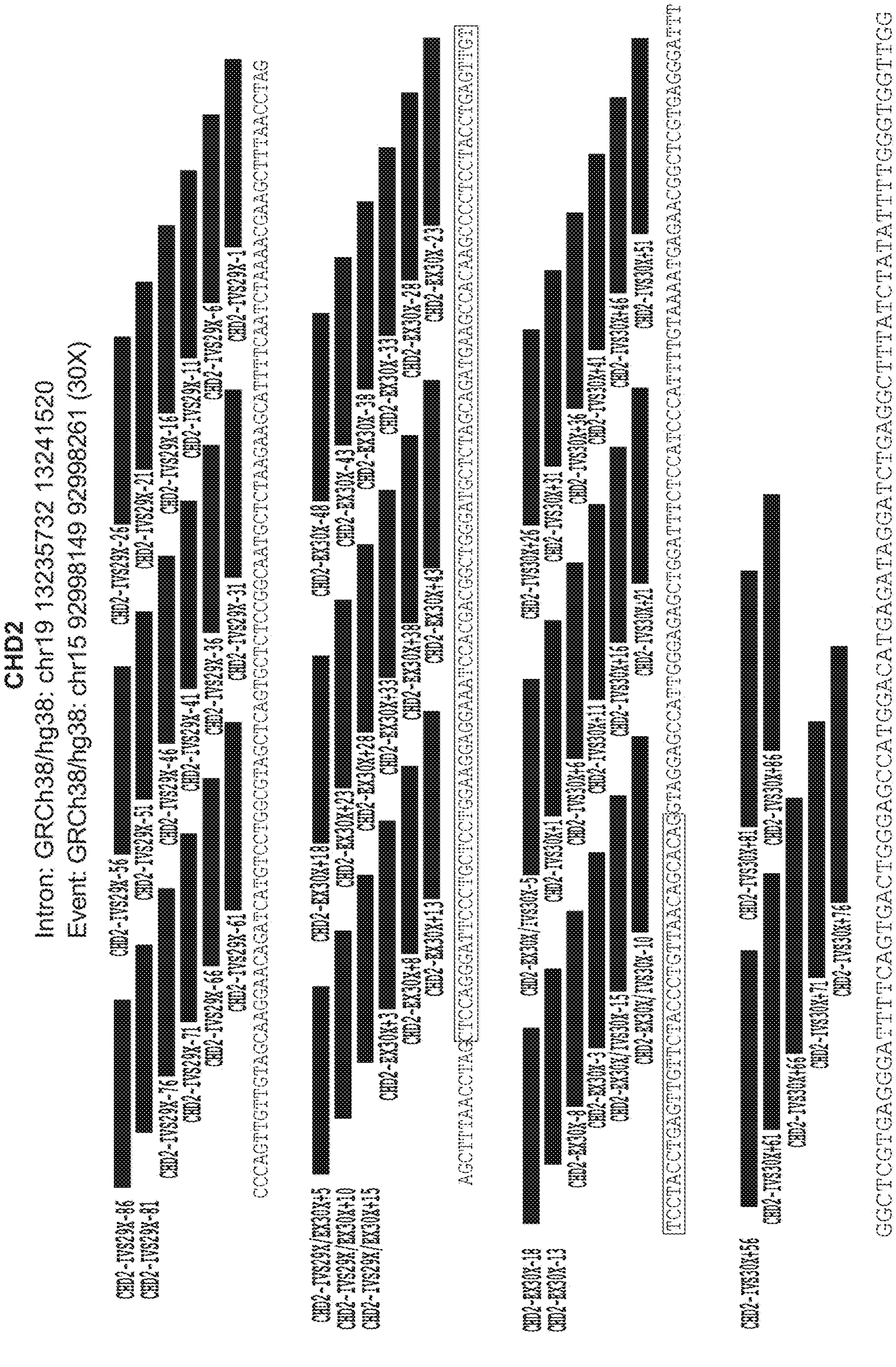
FIG. 76 depicts an exemplary ASO walk around CHD2 exon 30×(GRCh38/hg38: chr15 92998149 92998261) region. A graphic representation of an ASO walk performed for around CHD2 exon 30×(GRCh38/hg38: chr15 92998149 92998261) region targeting sequences upstream of the 3' splice site, across the 3' splice site, exon 30×, across the 5' splice site, and downstream of the 5' splice site is shown. ASOs were designed to cover these regions by shifting 5 nucleotides at a time.
Figure 77:
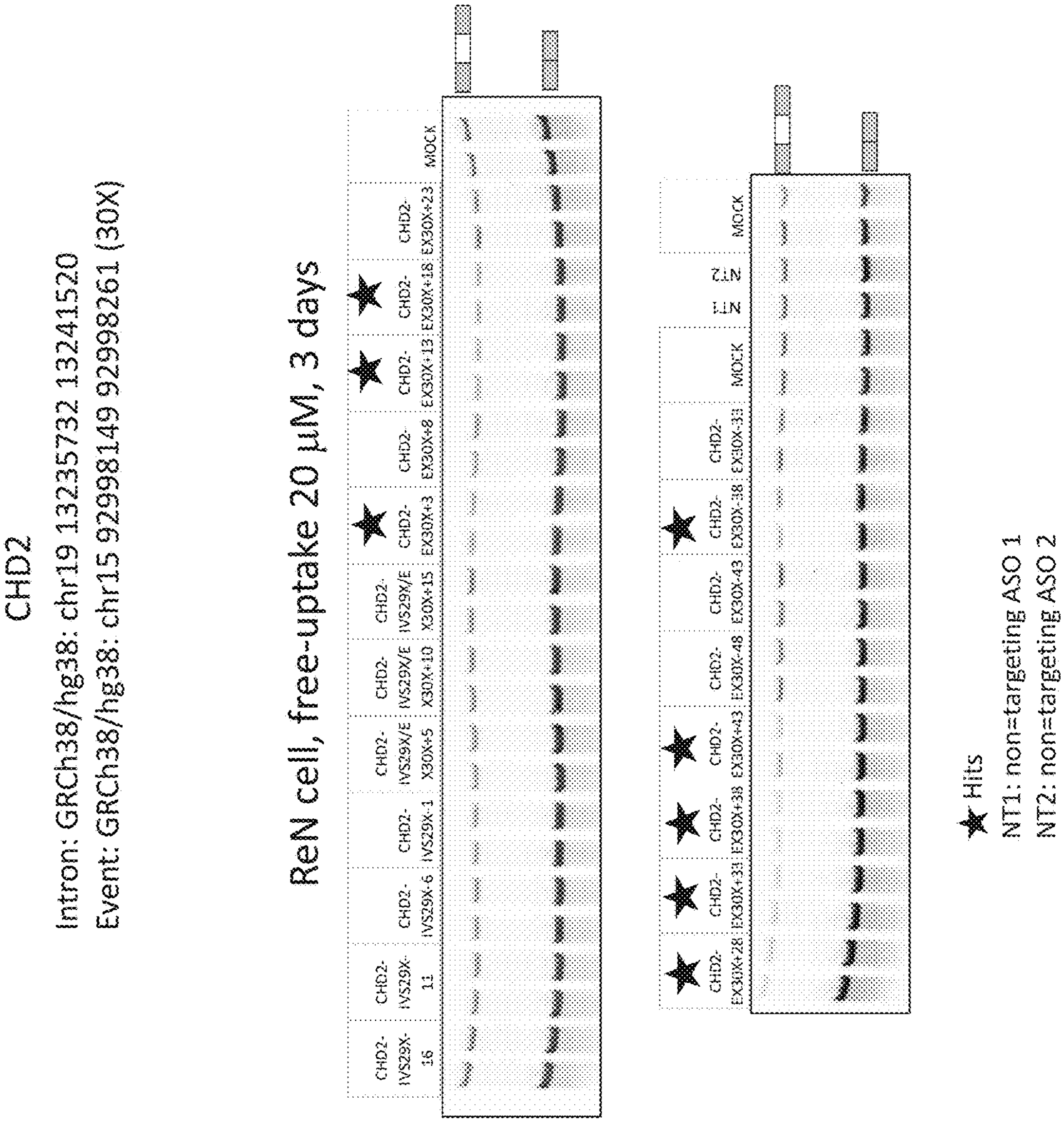
FIG. 77 depicts CHD2 exon 30×(GRCh38/hg38: chr15 92998149 92998261) region ASO walk evaluated by RT-PCR. RT-PCR results are shown demonstrating the changes in amount of mRNA containing NMD-inducing exon 30×.
Figure 78:
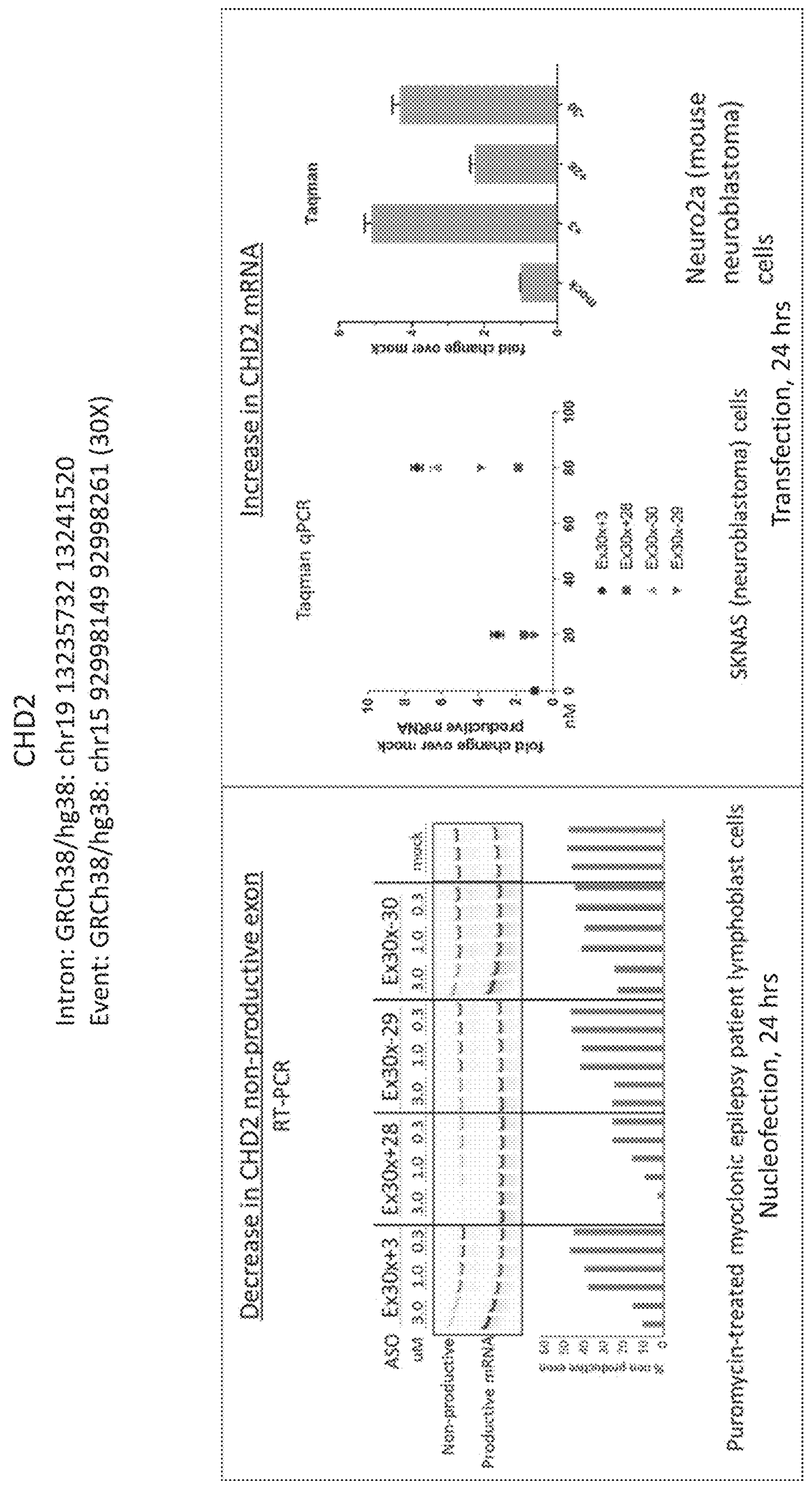
FIG. 78 depicts changes induced by different ASOs in levels of CHD2 non-productive exon (exon 30×(GRCh38/hg38: chr15 92998149 92998261)) and CHD2 productive mRNA.

ASO walk sequences can be evaluated by for example RT-PCR. PAGE can be used to show SYBR-safe-stained RT-PCR products of mock-treated (Sham), SMN-control ASO treated (SMN), or treated with a 2'-MOE ASO targeting the NMD exon regions as described herein at 20 μM concentration in human cells by gymnotic uptake. Products corresponding to NMD exon inclusion and full-length are quantified and percent NMD exon inclusion is plotted Full-length products can be normalized to RPL32 internal control and fold-change relative to Sham can be plotted. FIGS. 71 and 78 depict evaluation via RT-PCR of various exemplary ASO walk along exemplary NIE exon regions, respectively.

Example 5: NMD Exon Region ASO Walk Evaluated by RT-qPCR

SYBR-green RT-qPCR amplification results normalized to RPL32, can be obtained using the same ASO uptake experiment that can be evaluated by SYBR-safe RT-PCR, and can be plotted as fold change relative to Sham to confirm SYBR-safe RT-PCR results. FIGS. 61, 64, 67, 68, 71, 74, 77, and 78 depict evaluation via RT-qPCR of various exemplary ASO walk along exemplary NIE exon regions, respectively.

Example 6: Dose-Dependent Effect of Selected ASO in CXH-Treated Cells

PAGE can be used to show SYBR-safe-stained RT-PCR products of mock-treated (Sham, RNAiMAX alone), or treated with 2'-MOE ASOs targeting NMD exons at 30 nM, 80 nM, and 200 nM concentrations in mouse or human cells by RNAiMAX transfection. Products corresponding to NMD exon inclusion and full-length are quantified and percent NMD exon inclusion can be plotted. The full-length products can also be normalized to HPRT internal control and fold-change relative to Sham can be plotted.

Example 7: Intravitreal (IVT) Injection of Selected ASOs

PAGEs of SYBR-safe-stained RT-PCR products of mice from PBS-injected (1 μL) (–) or ASOs or Cep290 (negative control ASO; Gerard et al, *Mol. Ther. Nuc. Ac.,* 2015) 2'-MOE ASO-injected (1 μL) (+) at 10 mM concentration. Products corresponding to NMD exon inclusion and full-length (are quantified and percent NMD exon inclusion can be plotted Full-length products can be normalized to GAPDH internal control and fold-change of ASO-injected relative to PBS-injected can plotted.

Example 8: Intracerebroventricular (ICV) Injection of Selected ASOs

PAGEs of SYBR-safe-stained RT-PCR products of mice from uninjected (–, no ASO control), or 300 μg of Cep290 (negative control ASO; Gerard et al, Mol. Ther. Nuc. Ac., 2015), 2'-MOE ASO-injected brains. Products corresponding to NMD exon inclusion and full-length can be quantified and percent NMD exon inclusion can be plotted. Taqman PCR can be performed using two different probes spanning NMD exon junctions and the products can be normalized to GAPDH internal control and fold-change of ASO-injected relative to Cep290-injected brains can be plotted.

While preferred embodiments of the present disclosure have been shown and described herein, it will be obvious to those skilled in the art that such embodiments are provided by way of example only. Numerous variations, changes, and substitutions will now occur to those skilled in the art without departing from the disclosure. It should be understood that various alternatives to the embodiments of the disclosure described herein may be employed in practicing the disclosure. It is intended that the following claims define the scope of the disclosure and that methods and structures within the scope of these claims and their equivalents be covered thereby.

LENGTHY TABLES

The patent contains a lengthy table section. A copy of the table is available in electronic form from the USPTO web site (https://seqdata.uspto.gov/docdetail?docId=US12797487B2). An electronic copy of the table will also be available from the USPTO upon request and payment of the fee set forth in 37 CFR 1.19(b)(3).

SEQUENCE LISTING (286 sequences)

SEQ ID NO: 1 - DNA, 189655 bp, Homo sapiens
  source 1..189655: mol_type = genomic DNA
tccggtcggcattttgttctgagagggagagacggaacgagagagagacacacacagggctccttccccccgccctcccccccctccctccgtcggtaccgactcacccgacaccaccaagccgcagggagggacgcccccgccgacaggagaattggttcccgggcccgcggcgatgcccccccggtagctcgggcccgtggtcgggtgtttgtgagtgtttctatgtgggagaaggaggaggaggaggaagaagaagcaacgatttgtcttctcggctggtctccccccggctctacatgttccccgcactgaggagacggaagaggagccgtagccaccccccctcccggcccggattatagtctctcgccacagcggcctcggcctccccttggattcagacgccgattcgcccaggtaaattcctgctctttatttcggcggcggcggcggcggcgccggcgccaggtcctcagcgtctctcctcctcgctcccctccccgccgtttccttagcggccccaggtctcttccacaggcgagtctagagttcgctcctctctggtggcagccgccttgggtagcggtggttttgtaccctctcccggccggctccggtggcggggactgggctcctgctgggcggccggggaggcgtaggcccggcggagagtgcaggccgcgggccagcggaatctacttgagctcggggattaggagagctccgggctgagcggagcgactgctggtcggtgacaggcctcgcccgggagtggagccgtagctagtggggaggcggaaacaatacaactaacagcaaatgtgccctgatcgtccccatatttacaactttcccggtccgggagtggggaacgtcccagtgaaacaaacaacctcccttcttccccctgtgaccccatgaagggaggaagtagtttcagttagtgagacaaacgtaaatactcagacgcggatccagtggtaattctttctctttctaaaacttgtttggacgttggaaagttcataaagactcattttcttttttaaagaattaaatcgtccacatgaatatttaatacagaaaaacatactgtggtagacactgcacatctccccctccccaagagcttttatcttgttgttttgacagtgtgttgttgcacatggactttttattcaaagacaagtataaagtacttgacaggtttactctgccactttctatttgtatgcgttatgtaagggcagttttaagcgactatacgtaaaacactcaggtacttcctgaccaaaacgtgtaggagcatacaaagaattttaagtgttctgagaattgtgctgagatacgggtaaaaccacttttcttttctttttccaaaaaagaaattaagttatacttaaaatccttgggaggttaaaaaattgtagaaggtgccatccttttatgtcagggcagttcttcttgaggtcccaggattgtcattggctgtttgtgccatgatgtttgactgtgtaatgagagaggtgtcattttaataggttaaatgtatctgtaaatgctggagaaaaatatcagttctaacttgacaagttctagttcatgagtaagttaagtgtttcgagcttgtttatggaggcgttcataatgtaggttggtataagggggaaacaccaatttaaaattcctcagtcaggcaaattgctagaaaagtgtacctgggttacacgttttgatattttgtttcatattcgctgaaggaaaactttcattggttaaaatgaagcagcactgctcagcgaaatcccttgttttactagtgtttgttacattggttcatattttttgtgtcattaaattattgtcactgtagaataagttattttgtggaggttatttttgagtttagcgtcctgattacaataaattgtttcacatttcctgcaaacgtacggataaatgtttaaaagaatgaagttaatatagctgtcacgtactaggcatgtttttaatgctataaatccgtgtagtagtcagtagcgtgtccgtgatttgtattggtcagggagcagtttgaattttaaaaagcctgaagctcctgctgagccccaatcccggcctccctccctcccactaatctcccattcctgtctttgtgctgcctgctcctgttagacactgtttgctacggggcctcaggcctactgcgggtgggggggtgtgcgagtggggggcatgccagggagggaatgcagacgggaggaatacttcacatcttaagaaagcagagggtttgtttttttggggatggaggtggtaagggcttcattataaatgtttaaaaggccttcatatattcctgtgattgtctctacaacttttatttcaagggataaacatatttttactaaagataatagaggagttgtgcttgcttaattttcacgaactgaagcaacttatttttagaggttgtcttatgcagatgtttgaataagtgtgttagagatgggtttatgtgattgattcttttttttcctgagactttggaattgttatagtgaattagttcttcccaacttattttcccaattctacatatttagtaatttgtgagtaatataggttgtgtgatagctttcattatgatagcataaacatttctttaaatttaaaaatatgttttgtttggtccaaaccaattaaatacgtcatttttaaaggagaaaacattgtgtaaaattcaaattgtaaaatttaaacttgaactttaaatctctgataacctagttggagagaatagtttgtttccctaaagagtgtagagtgttctgcttcccctctgttggttggaatattcactagtggctaatcatctatttccattaaaaattaaaattcagtgaaaggagaaatcagaagtgttccagtaaccttataatcctagttatattatttggagaaatattttctcatacacctaaaggaaatttcaacaatgtcgcttattgtttctcttaactctgaagagttgtcaataacttttgttacttgaaaagagatttcaagtaaataatgaaagtaaatcagagttgaacattaaatagataattttcaatgtttgagaagtgtatataggatgcttcctttttaaagttattcaacaatttgtttactaaagttatctgagaacatttttgaacctgttctagagatcattataatattttctgcttttaaggaaaagttatacattacttgaaaaaagaaaaacagtctacttgagattctttttagggatgtaaagtgaaagtttttactatggcagtaaacttggttcttcatagtaatcattattaaatttcaaaaatatgagcaagctataccaatacaaaattttctttacttgcagccgaaaaatgtattttctaaggcttcttcaactaatttcatatttaattttttggtaccaatccatcatcaaactgtcatagaaatatttgaacatatctgtgttacatgtttgaaataccccattgtggtatttttactttctcaaaataagatgtagtaattaataatataagagtaaataaaaaccaggagtttgagttttatttaatttcatttaatcctcctttctggtgcttattaggaaaagcataatttggaagaaattctaaaattttaaattaagatttcagttttatgtgaagtgattagggagtgtgaggtaaacagtaattccttttagagaaatgtaactttaattctgtttatcacatttacttgccataaaaatgaatgggaaataattgactaggaacctttatagaaggctgacaactaactgttcagttgaacatgcttattttaatatcctgagcgtactaggttaggtttggtggtaatttatggtcttatatagcctttaaaaattgttttaagatggactttttaagcaaagtttttcgttttttcagcagttgtcatttataataattcttcgtattttaaaactagtcctttttcaaggtgacctgagttcatttaaaaatattctgatatccctgtgagagaagtgaccagctttccgtttaatgatgaaatacttgacacttaagagaccatatgatttgtgtagattcatgtagtaagtcagccggaggataagggattccctgacactagtattttcttagattatgttgctttaagaaatgtgtgagctctggtcttgaagctaggtattgctcagtgctgacactgacaccatttgttactttttcaattatctaagttcaaagtgcatttttcttgtctttgagagagaggatacctgtttcttggttgtattttcctggtatgaaaatagagtgggattttagtgtttctggttgatttaaaaggaattttaaactccatgtctcttaaggccatcattgtaattttaaagggtattttatgtgcttagaatattttgcccaaataaattaagtaataaaagtaattttaggtatttgtcttgtgtgtaattttttttttttggtgtaaatctggagtcagttttgttgaattgagttttgtcaagttgcattatgttttaaggcatatttttttctattcccaaagttatatcattaggagagatcattgcttgatgtagcattgccagctaagattttgaggacttatttgccaggagttaagtctgtccccataatatctcatttaatcttttaacatgcccaaaagtagaaacaataattatctacaatgtacagatgaggaacctgaggctggaaaggtttagaaaactgcccatggtcctacaattagtaaatgatcagtctgatttacatttgttcttatggattcaggattctatgtatctagtttcaatgaaattttaatattatcttttgggtgttagttgatgtgatacttgcccagtcacttagtcaagaaaattgtgtacttcaggcaaagaagctgaaatagaattcaggctatatattctgtatttataatacttttaaaaatcaataactctttaccatcttgtgtttaaaacaatttttgttaagcagtctgtgaagcttttagttctttgaagtattttatattgagttgaagatgtttgtcaaagcatctgttgttagaaagacaaagttcagctttagagagtcatttcattcatagaaatgtatatgaccaattgtaggatagtagctagatctataaattagtatgactgatcattttgtaaagtttcagtatttttatagccagagaatgttgatcattatagtcatcaacttgggaggttgtgcgcttattccagaactgttgccagtacatacaaccttataggaattccttttgtgaatacctttaacacatttgaaatagtctttttctcatctttatgacaaatctttattttctggggtgaatttgagttttagatactgtacaacgtcacttgaaacttagtttagggattttttttgtgtctggcactatgttgagtgctttatgtttgtaatatgtagtattattgaatgtttccatgtgacagaaactgtgcgagggaaaaggtttttcagttcctcaaggtattgaaaagttgaatatgaaattgaagttagttgtatgagaaaactgagatatagaatgattacgtgactagcccaaggtcacacaactaataagttcaagacagtggagaaaggatttcagagttgatactttacccataagccttaaccacgatactgtgtatcatgatttgaaccacccaactactcagtgaagttagtgatactgttctctttttacagaggaaattgaggttcatcatgcttaagaaacttattcagggtagcaaacctagcaagtgttagaagtaggattccagctaaaatgtatctaattctaaaacctctattctttacattctaccaccctggctcttcaaaatttataatacaatttttggtgaaagggtagccttgattatgaagttagtgacactgtttttcttgtggagcttacaagagtaattctaaaatgttttgatcagttatagctgattcattatttgattatagtctttttttttaaaaaaaaaacccaccttgttactttacttcgtgtatagtacacaaaatgtttgtatattcaaatatgcatataaataggatattgatttttaaatgcaggtactgtggaatatattaaatgtaggtatctgtggaataagtagctttagaaaatttggcaaaagctattctcaggctataacaatactgaaattttaaaaaaatgatcagtcatgctaattcatagattaactgtatttttatgattttattgtgactcttgttacttttaataatgttaagcattaaaaaaattcccaagaatgcattgaattttcaaaataattcatgtaggtaaattgctttgccatcttacatgtgtgacatatctcttaacatgcatataccaatttcctttgagttctcttttgtacatatttctcctttgacagaaaagaaaaactttttcagaaattagcaatattaatttattaaaataattatatatatacttttgcctctcctgagaaatgcagaagctgtgacataattttaaaatgctggatttccttttgttagaattaacatatttgggtcacttatgcaggtgaaatgcacagttatttttatatgagcactattgaaaaaatactattctagatacattaaaactaacaaatgtctaaaacactaattattaaattctgactatacttttaaaatattagtctttatgattgatatttatgatatttaatttggtatttgtaaagcaaaaatgtcctttaatcctggtgaggaaatacattacagagttttctcaacactgctacttgtcaaccctttcagtattttaaaacctgcctttagttgtctttatttgaatcagattgtgggttgccagttttgagccaaagacatcgatcgtctgagtgtatgctctatgtaattcagtttttttttttggtaatgaccaagttgaagttttacatggttttaagttgggcataactccatttattatttatttattttttattaatactattctttaaaattgatgcacatgaaaaaatttcttcctagggttctgcgtatacctcagaaagctctaagattgaaagctgaaatgtcatgacctgaaaactactgattctttcccctttaagaaaagaatttggaaactagtgtttattccataacgttaccttcaagttatcctgaaagacacacatgacatacgcttttatttaactctactaatctttttactattttctctttccctttttttatgtatctcttcctttcactatcaatgtccatttcatctcccccaaagcaaatttttacatactgtggctaatataggtatttgttgttaatgtggttgatcttgtaatgtgttactttccctgatgaaacccagagcagtttcagaggcctcaaattctgagatcttcctaagttcaaaatagattgctggtagaaaagcattgacattaaccatgaaaatatatatttgtgtattgttcccacttctatagacatatattacttttcaaaatgtcagctcaaggaccagaaattttttctgaggagaaagagaaagcattgcctttacaaaagtttccctgatcattccatttcatagcatttgtacagttttttacttgtatctcttgataaaataatttgttcctatattcgtcagccatactcaaccatcagctctgtgaaagcaaagagattttgtattatcttcatctgtatgtctataacatcatcacagtgctgctcctgttttaggtattcaatatatatttgttgtttagttagaattgagccatgtggtatttcttaaaggtatgtttttaaatctaagattagtgaatggcaagtacatttctcttaatttcaaaatataattttcttaggtagagctgtgtccttgagggcttcttgctttgggggtaggaatattttatttacatatatccctaacaatacatacataactttataaagataaagaaaaatttaaagttcctttttaagctgttaatgaggatcgtgaagtacaggaagggttttttgttctgattccttaggcagtataattggagtaagatactggagtattgcaagaagtgaaatatctaaatactttcttgttttaatctttggatttattgcagttttaattttttttttgccaatttaagtattatatataatcagataagttaaataatgagaaatacgttacagcacataaaaaatgctattcagggtcagcaaagcctgagtcctgtcctctcgctctcctccctggacagcatgagcttcaccacttgctccaccttctccaccaactactggttcctgggctctgtccagccacccagctatggtgcctgactggtcagcagtgcagccagcgtctatgcaggcgccaggggctctggttcgcggatctccgtgtcctgttccaccagcttccgcggcggcttggggtccaggggcctggccaagtggatggcccagggtctggcaggaatgggaggcatccagaacaaggagaccctccaaagcctgaacaaccacctggcctcctacctggacagagtgaggagcctagagaccaagaaccagagactggagagcaacacccgggagcacctggagaagaagggaccccaggtcagagactggggccattacttcaagaccatcgaggatctgagggctcagatctttgcaaatactgtggacaatgcctgcattgttctgcagattgacaatgcctaccttgctgctgatggctttagagtcaagtgtgagacagagctggccatgtgccagtctgtagagaacgacatccgtgggctctgcaaggtcattgatgacaccagtgtcacttggctgtagctagagacagacatcgaggctctcagggaggagctgctcttaatgaaggagaaccacgaagaggaagtaaaaggcctacaagcccagctcaccagctctgggttgaccgtgaaggtagatgctcccaaatctcaggacctcgccaagatcatggcagacatacaggcccaatacgacgagctagctcagaagaaccaagaggagctagacaagtactggtctcagcagattgaggagagcaccacagtggtcaccactcagtccgcgcaggtcggagctgctgagatgacactcacggagctgagacatacggtccagtccttggagatccatctggacttgataagaaatctgaaggccagcttctggagaacagcctgagggaggtggagacctgctatgccctgcaggtagagcagctcaacagaatcctgctgcacctggagtcagagctggcacagacccaggcagaggggcagcaccaggcccaggagtacgagaccatgctgaacatcaaggtcaagctggaggctgagagcgccacctgccaccgcctgcttgaagatggcaagaacttcagtcttgatgatgccctggacagcagcaactccatgcaaactatccaaaagaccaccacccgctggatagtggatggcagagtggtgtctgagaccagtgacaccaaagttctgagacattaagtcagcagaagcagggtaccctttggggagcaggaggcccataaaatgttcagaggtcattgggggaaaataggctattcagttaaaatagttatctgatgactgaaatttttttaatatgtcaggtgtattgaggtataatttatacagtaaaactcagtcttttgggtgtgcagtttgatgagttttgacaaacatacacagtcttaaaaccaccaccacaatcagaatatttccattacccccaaaagttcccatgtatccctttgtaatcagtttcctgctcctactgcagcccgaggcaactagatctggtttctgtctctatagtttttccttttctagaacataaaaatggaatcatatatagccttttatgtcttttttttaaatttagcagaaagcttctgagattcattcatgttctatgtatcagtagtttgtcaatgactgaagtttaaaattgttaactttggtgaagctcttacgaaagagtattatcaaaaaatagtactttgaacagtggtagatatttctctcagattttggcagctgccttattattgaacattttacttgctcatttttacccctcgacccccaaattttacttacctgtttaaccctcaacccccaaatctagtctaatagacattattatatggcatttatttatattagtaaatgctgtttaattctctaccaagcatgtgaaatagacctactctctttttcataattaaaataggtagcatcttgcattttgaacatacagcacatagaaactagaataaaaaatgaaggatggtgcagtaacaccaaaaacttgagtttacatttgctttaggtttagtgtttgtaagttggtgctaaaaaaagagcatagattatagtgaataacagtcacagcctctcttccaatgattaaagttagaaaagcagtgccctttactgaaaattgggggcagataatgagaaaagagtaattttctggacattttattcgaccacctctcccccgaccctttcctttttgaaacagcttcatctctgggatattctcttgttgtttgcttatgtctttgacctcccattttttaagtcttttgctaggtcttgctcctctacctacccctttaaatatttgtattctccaggaggtgcttcaaacttatttctgttcttcctgttgatctcatttattcacatgacttgttacatgctacctgtgtgctgatgactcacaaatctatctccagaatatatttctcttctgagccagatccagctgtctatcaggtacctcctgatgtcccatgaataacagaaattccatagtatgtaagtctgaactcatcccttaattcttccttactctgacctgtcacccaaagaaagaaaactattaaaaaatacatgaagtaggttaatgttttcactatcaactcatttacctaaactagaaatttgggataatccttgacacttctttaccatacttccagttcagttattcacccagttctgacatttgtaacacttccctgaattatcacttgaatctaccccttccccaatgttttgattctgtgagaggtcctgaacatacagttttctcagatttaataacttctagtattttaagaaagatttagcagtaattgtgaaagtaatatgtatttagtattggatactttttgcttctatgcttgggctctggtatttaaaattaaggtgtaatctttagtaacagtgatactatatagcctaaatgtgactgtgttctgttatatctaaaatttaggacttttgacttacagcccagtttatcagctggaagacttgaactcattttttaactcattttttatcttttcattcttgcttttagaatactgcatttcatggagttgtatattcatttcaatactttgtgtttatgtgttttggagcagggtagaggagaaaatgggaatgtataaggaaagttaaaggaaggacttttgaattgactttcctatactgtggaaacaagtttacttaaataacattttcacttttattgcaaacaacagaaaactaaagaaatgctgtgggatatgataccattcaggtgctaagcatgcacatatttttaatgacaggagttagatgtgttgtaacagtattgcttgtttgtgagtttggaaattaatgttcatggttttgtataactttatgatatttcttccttaaaataagaaattacccctccagcccacagtttgagccaaagggtctgcttgaaattattagtttaaataatcctgagcgcatcttttgtaaagggcattttaaaatgtaatgctgccttgaaaaacaaagcaagcattttcttcgttatatctagagtttataactaaagaagtaatatgtgctatattttgctctagtgccaagtaccatattttggaatgaatagaatcaatctaaaggcagtttacaaaggctgaagggagacccagtttggtagtcattggatccctttggtggcttgcacatagtaagcactcaacaaacaattgttgaataaatgaatttgaatatattttcagtttggggacataggactaattagagtgacagaagatgggtggggcttgctaaatactgagcaagttttatagaggaaagaaaacatgaaacccagaaatggtggacaacattgacagcaaagaattggtgtaatttagttaactatttttatctggacaataaggtttgtttagttggataagagaaagatctatatacagaagtgttttgagttctttctactcttatttccactctggctctacttctgaacccccatgttcactgctaaagaactaattgtaggcttggggctaaaatgatctgcataatccagatactcatattaagaactgggaggaggtgttgggaaagaggtatttcttacagttcttcaatctttccaattactcatgtttcttagtatatgtcagggtgccactgcactgtcctccgtattcatatgaggatgtctaaaaactagaatttaaaatcacatataatttacaataagcttgtaactgtcctagtatgaagttcagtatctgaatctctaataattagttacctagctgttgagccacattgccatctactctgattatcatatgtttcttatgattctgatattttaaactggaagataaacaccacagttttagtgtgttttataaaaattttataattcagtaacaatccattcctttattttcttggaagccaaaactacatatagtttcctgatatgttaagcttaaactgtggaatttagaacttaaaaattttcaagagcttcaaagttgaagacttttcttaattttttttcaattgtagaaccaatgtgaaaaaaaaaactacatgctgtttgggaaatgggaaaaatatcaaattttatgtttttcctactaagtttcctattaaatttttacataaaaatatttatgatgaatgtaattatggttaaatacatatattaatgctataaatttattcctcttttaacgttggatcataaagattttcctagttttctatataatgttcataattctttaaaatgttgcccagtattttgtcagtggatgaaccataatttattcattctattcttgcatactttttgcttttactttttttctatataaataatgaggcagtgaacatctttatatgtagttttttccccctttaggggctttattcgcttagagtagaatctcttaagtggaagtaatcctgtaagtggaagttgggtcaaaaggtttgaacatttttatggcctttaatatatatttccaaaactaattttattctgctataatctttattttcattcacatcttaattcattcagtagattcattgtgtttttcatatagaatacacacttcctatgaatattattaggtcatttaaatgctcccgtttcccactattgtgcctgtggtctctttttactatatatttttaacctcttgatgataaacagttgtggcttttcaaacggtgtatatcatttcgaggtattatatagtaaaattagcatgggatctaaactgctattagccaagtggcatttaggccaattcttaacccaagcccatgtcttcaactgtaaactgaagaggttctcagcttttgagatttcatggactagtcagaacaaagcaagaaagtgcttttctgcagaaataaagtggtaaggatattgtagattggaatgtaaaaagaaaagtaatgtctaggtaagacccattacttagtcttaatatttgaaatgtgaaatacccagtgtgatgtgaacatggtcatgatctcatattcattctcttgtacatcaaacactgagtgattcctatgtcttttctcaggagctattaaggcattgcagatggtgaaataaaagacttcaggccgggcacggtggctcacgcttgtaatcccagcactttgggaggccgaggcgggcggatcacgaagtcaggagatggagaccatcctagctaacacagtgaaacctcgtctctactaaaaatacaaaaaattagccaggcacagtggcgggcgcctgtagttccagctgcttgggaggctgaggcaggagaacggcatgaacccgggaggcagagcttgcagtgagccaagatagcaccactgcactctggcctgggcaaagagcgagactccatctcaaaaaacaaaaaaagaaaaagaaataaaagacttcagcccacccatattatagtctaatacagtttatagacaggtaaacagagattatgttacaatatctaagtgctatgatcaagataaacaaggtgcagttggagcactggtggtaggggtggtcacctaatttagactagtgtggtgaggcgcagtaagtcaggagccctcctaggtgtgatggttagtagatatgcaaactaagttttgaaggctgttagtcatactgtggagtctgggccaacaatttgatttttggaaactgatgatggcttagattattagaacataggctggaaaaggggcatgccaaaaaggtctgaagctacagagaggggcaggctacagattatgaaggagtggatatgccttactaagaattctgtgttttattttaaagacgagaagccaggaagttatttagtaatggagtatgttttatgcatatgtaaaaaaatttttggatagtaggcaggaaaagggaggctcaggaggccagtaggtgttgaggtcctcaattaagatgggggattgtagcgaaggaaacccataacaaatattaaagagttaatctagttatagtttagtgattctatgtaggtagattgggtaagagagaatgaaaacagtcaaggatatatccttgattcccaagtttcatgtgggcatatgagagtagaatataagttaaatcagttttggctgcctgtgagtaaaaatatagtgtaccaaaacctgtatcacctttcacattttaaaaggaatggatattgaaaaatttagtggcttggtcaaattgtactaatgattatttggaaatgacttttacagctgacctagaagatctctccagtgttaaatcagggttaaaagtagtacagtggatgaaaaaatgctcatcactggccatcagagaaatgcaaatcaaaactgcaataagataccatctcacaccagttagaatggcgatcattaaaaagtcaggaaacaacaggtgctggagaggatgtggagaaataggaacacttttacattgttgttgggactgtaaactagttcaaccattgtggaagtcagtgtggcgattcctcagggatctagaactagaaataccatttgacccagccatcccattactggctatatacccaaaggattataaatcatgctgctataaagacacatgcacacgtatgtttattgcggcactattcacaatagcaaagacttggaaccaacccaaatatccaacaacgatagactggattaagaaaatgtggcacatatacaccatggaatactatgcagccataaaaaaggatgagttcatgtcctttgtagggacgtggatgaagctggaaaccatcattctcagggaactattgcaaggacaaaaaaccaaacaccacatgttctcactcataggtgggaattgaacagtgagaacccttggacacaggagggggaacatcacacaccagggactgttgtggggtggggggagtggggagggatagcattaggagatatacctaatgctaaatgacaagttaatgggtgcagcacaccaacatggcacatgtatacatatgtaacaaacctgcacgttgtgcacgtgtaccctagaactttaaagtataataataataaaaaagtagcatggtggattataatcttacttgattaaattactagaagataatactatttctttttaatgctttgttttctagtatattgactatattcttgtgagcttagaataacataatgaatgttctttaataactattttctattgtgcaaagttctcttagggcctttctggtgtatttgtttatccagcctcatctgaagactgcctcttcagttagttttatactaaatccatacatacactataatgaaatcttgtagtgagaactatgttactttgttcatgaagggattatctttacaaatataattaaagggatgcttttaaaataaattttaaaatggcagtagctttttagaattgttacatgtaggaacagttataaagcagtcaaactgatgtatccaaaataactgaccaggtgacatactgccaaaatgaaaattagtactttccaaggttctaagtatacttaaacaaatgtacttcattttgttttttggcttgagaggtagcatatcagaatcacctagggatttttttttttcaaactttaatccttttttggagatgtaagtttttaagtttctcttttagctgtgttcccttagacttctcaatcattcagtaagaattgaataactgcagtgtgttcagcaatgaatactagatatttgatatggactttttttgagtcttcctcctgaattttacatggctacctaaaagatctctctcttttttgtattctataaaaacatcatctgtgaggcataaaggagcaaggaatcatgtgagcagagttagcgaattagatttttaaaaaaatgagaatggtgagatgtgtttagttctgaagaatggaggaggagttgctggatactagcgaggacgtagaattgaggaaagaagttagggtaggagatagtgtaaatgaatttggtagaaaaaattcagtacagcctaccagcagtacttcaagtaaaattagaaattgtgaactgacctatctgttcctaaaggtgtcttatattttaaaagtttgctcaaaagtcaaattgaatcttgttagaaacacactacttaaaaatataaaccatgcctatgtgttcacactaagtcctcagcaaatacttcttctttattagttcatagttgcctttctactgatttgatggaaaatatatccttctcaaatatatttccaaatgaaaatctgctaatttgtgacatttctaatggattattaggaaggaaggtatttgataagaagcaaagaaaaagtaatcaaattagctcaagttcatctgatattgaaatatgataagtactccttagtaacacagcttagctagaaaccgcagataaagtgaagtatccaaaaaaaaactctatttatatgagaagtttgatttaacctttgtctaatatctaaagttaattatgtgtccaaaggtattgtactatactatactgtcatgtatgtactttcaaaaatacatgtatataaaaatacatatatacatataatatattcgtatatacaaatatatcctatgcactttgatagctctattttgataacttgttttgtattttcctacctcacaccttttgatcaaaacatttacctccttttttatccatctatccaaatcatactttctttctatcatgatcttatgtttttttccccccactgcggggaggtggcatgtcagaatcctctgtggattattttcaagcttaaaatcctttccaccttttctcctgccccagttcacttgatcttttctagcagtacctatgtgtaggagttatagaaattatatgttagcttgtcacattttcttactgtatatcaagctaaagtttattttgttttatttttaccttatttgtcttctcagtcagattataaactcttagaggacacagtctgcctgtggtgcttggtgtcttacctgcaacaggcttgtagcaagtgtttgctgataactggtgtagctcatctggactggtttgaagaggtttggaaaatatctcacactcttataaactgtaaaattcacccttttaaagtgtaaaactcagtgatttttagtatattcacaaagttatgcattcatcattactttctagttccagagcattttcatcaccccccaaaaaaccacgtttccattagtggtcacaccctgttgtctccagtcagtccttggcaaccattaatttaccttctgttgctgtggatttctgtattcatataagtggaatcaaataatgtgcccttttgtgtctggcttcttttaattgctcatctatattgcagcatggatcagtacttcatttctttttaggactgaatatactccattgtatggatataccacattttacttttgctttgtcgcttgatggacgcatggattgttttcaacttttgactattatgaataatgctgttataagcattcatttgtaagtttctgtgtggatatgtttttacttctcctgagtaggtacaaaggggcaaaatttttaggtcatgtggtaactatgtttaactctgaggaactgtcagactgttttccaaagaggtgcatgattttacatttgtagtagcaatgtatgaaggttagactgtctttacatcctcaccaacacttgttattgtctgtctgattgtattggtcctagagggtgtgaagtggtatctctgtgtggctttgatttgcattttcctaatgactgatgatattaaacacctttttatgtgcttattggtcatttgtgtatcttctttggagcaacattcatccaaatcttttgcccatttttaaattgggttatctgcctttttattgttgaattataagttgttagacatattctagatacaagttccttatcagatacgtgatttgcaatatttgctcccattctgtggattgtcttttcactttcttgatagtgtcctttgaagcacatacatttttaattttaaagatctctattgttttcctttggttgcttatgctttgggtgtcataagaaactattgcctaatccaaggacaggaaaagttacacccgtgtttagttttagcacttacatttaatactctgatccattttgagttaatctttttcataaggtatgaggtagggatccaacttcattattatgtacgtgtttatccaattttccattaccatttgttgaaaagactattctttcccattgaatggtcttggcatccctgtcaaaaatcagttgaatgtaaatttaagagtttatttttggctctcaattttattccatcagtccatatgtctgtccttacgccagtactacactgtcttgattactgtggctttgtagtaaggtttgaaagtgaaatgtgtgagtcctccaactttgttctttttcaagattgttttgactcttctggatctctcattttcatatgaagtttaggatgtttgtcattttctgcaaaataggcagctgcaattttgataggggtcgtattaaatctgtagatgagtttggggagtattgcctttacaataatattaaatcttaacaatccaagggcatgggaagacgttccatttttttaaagccctaatttcctttagtgttttgtttgtttgttttgagacaaactctcgctatatggcccaggctggagagcagtggcatgatcttggctcactgtaaagtccgcctccctggttcaagtgattattgttccttagcctccgagtagctgggattacagtcctttgccaccatgcctggctaatttttgtatttttaagagaaggtgcggtttcgccatgttggccaggcttgtctcgaactcctggcctcaagtgatctgcctgccttagcctcccaaagtgctgggattacaggcttgacccaccacacctggccagtgttttgtagatttaaatgtacaaatattgcatttcttttgttaaatttgttcctgtgcattgtgttctttttaatgctattgtaaatggaatagacttttatatatttttttttttttgagaaggagtcttgcactgtcacccgggctgcagtgcaatggcacgatcttggctcactgcaacctccacttcccaggttcaggcgattctcctgcctcagcctcccgagtagctgggattacaggtgcacaccagcacacctggctaattttttgtttttttagtagagatggggtttcactatgttggccagactagtcttgaactcctgacctcgtgatccacctgctttagcctcccaaagtgctgggattacaagcatgagccaccgcatccggcctggaattgctttcttaattttacttccagattgttcactgctagggtatggaagtgcagttgatttttatatattgatcttgtatcctgcaaccttgctgaacttgtttattaattgtaactcatgctcttctttctagggacagtttatgttctttagtttggttcattgtgccctcctccagttttccaaataatacatgtcaacagtgttataagaaagaaatttcttattttctcaatcctgctttgtgacttaaacaaacttacgcacatatgaaaagtaagatcagacaactcagaagaaaaacgatatccactaaaaactatgtcaacattttcatttagtgctctggctgtaacataggattaaaaatttgaggattgtggttcagtagttaaagcagtaagctttgccaatagtgaggcatcttgagtatttgttgcggaaataaataaatgcctgctaacaatgtgtatatagggatgcaaaataaattctattggtcagtaatttctgaagtctttactccactagtcagtaagtgattttcagtagtgcatctggaaagcttgagtcatacagggaaaaaaaaaaaaaaaaagcaaggagggaagaaacaaaaggaagtaagattaataatttgaattttgttaatacagataatattgtgatttaaataaatctattgattaggaacaaaagaggaaaaaataacagattacagtattattcctcaagttcaaacttctgtgtttcttaatgccagaatcaaacctaaaatgtcaaacacacatataaaaagatgcccaaacttactagcagttagagaaataaagagtaaaaatctagctagcttattatgtattttgttgatcagtaaggataaagtgttgaaagtatgcttcatatactataaagtatgcttgtttaataagttgtatcctctattatcattaatattgttgttcttatcagtgacctttaggtcttaaaatagatgtagagaagggtagtgtaatcctgcctttaaaaaaaaattcatcaaatgctttatgtcttattcatggtcatatttaatactgttgaagaaacccatgagatagatatttttgagacaattgaggcgtaggaagttaaataatttgcccaagcttacacagcttgaaacaagaggaagaagaaatcaaacctatgtttttctgattcctttttttttttttttttgagacggagtttcgctgtcattgcccaggctggagtgcagtggcacgatctcagctcaccacaacctccgcctcccaggttcaagtgattctcctgtctcagcctcccgaatagctgggattacaggcatgcgccatcacgcccacccaattttgtatttttagcagagatggggtttctccatgttggtcaggctggtctcgaactcccgacctcaggcgatccacccacctcaccctcccaaagtgctgggtataggtgtgaaccaccacacctggcatgtttttctgattctaaaacttagttttaaactttttttaaaatttagtctttaacttttaattggcatactatattgcttctccactacctttgaacttattcctaggtggattatataataaataatattccttggagttttaaattgtattaaataagatttaaagtagaattttaaaattggattttgattttacttcagaaaactctcaagtgtttgctttgggaaatcgaagaaaacatttgcccattgttgtaatgctgctgtatttcccaattgtgatttccaaaatttctttgattctcactttgggaaatggggtcttgaaattcatgaaatccagttttgggtccagaagcaaatagactcagtgaaagagacagtcatgggagaaccccttaaatagttttaggacaaaaagttacagtttaaagagaaggatgggtaaatgttgaagaaaacttaatacctcttgttttctctatgttgaagacttttggttttgcattaagtcttgcctgcattaaaaaaaaagtgtaatgtgattgtcttatgtacttacaaattaatatgtattgtatctttaattgcatctctgtggaatttttatatcatttgctttctttgttttatacctttctttgggaatctcatattcagtgcagactgttgtaatgagtttggtttgttgacctggtgagcagtaggattttgtaaaaggaaattcagcttaaagcattcagaactttggctgttgtgccctttcaaaagtgaatttttaaataggtttaaaataaatgactgcctccaaaggattgctttctaaattttgtgttagagacatgcttgcctcctgattttgtattttagccccaaagtgaattaagctttcctgcttgagttggtgaatattacttaagtacatgtatatacacagagttaaaaacctgctagtactcaaaaatcagtcctgtattgtatagagatttgcctgctgatggatcaggtgttgttttcagtatactgttcttggactttatgacagactaggggtacttaatgcctgagttgataatcacattattacttcttacactttgtttatagaatctagaaggagttaaacagaaaagtatttttctgttccttccttatgatttagaaaatagaaaaagtcttcgctaaagcctttaatagccttattcttagtgatgatgatgattatattaatagcaatgatggccagtatttgtcatgagctcactgttttgaatatttgactggcattatttaatcttcactacagttcttgaggtataatcagcccttcatatttgagagtcacacatttgcagattcagccaagcacagattggaaatattcaggaaaagaaaccaataaaaaaaatacaaaaacatttaaagtgcagtataaaaactatgtagcatttacattgtatttggtattataagtattctattaatgatgtaaagtatacaggaaggtgtgcattttatatgcaaatactacaccattttaaattagagactttagcgtccatgaatttcatatctacagggatcctggaaccagtcccctcagggccaaaggggactgtctagctataatatctccactttccaaattaggaaactgatgcttacaaagaatgtgacttgctcaagagatgagagaaggaagtcccatgagcaattcagtcaacataattacaatgaatgtatgctctccttaagtttagttagactcctgacctccttgaggtcagggacttaatatgtttatttctttaattctagtaccaagcacagcacccagcatatggcatatgctcgggttttttttgttttgttttgttttgtttttttaataaagaaatgaagttgcgagaggctgattcattagctttagctgtaagtcttctggagggaatccataccaatttcatttacattgcatgattttttttcctttgccttggaataccgcttggcaggggacctagtaagttcctgttcattcttcaagttccagcgtaattccatcttttctttgatgccttccttgtctcttttaggcagaattaattgttcccttttctatccactccctttttttccccagcctttattttagattccagggggtacatgtgcaggtttgttacatgggtaaattgcgagtcgcagggggtttgttgtatagattattttgtgacccaggtaatgagcatagtacctgacaggtagtttttgatctccacccttctcccaccctcaagtaggctttggtgtctcttgtttccttctttgtgtccatctgtggtctatgtttagctcccacttacaagagataacatgcagtatttgatttttttgtttctgtattaatttgcttaagataatggcctccagctgcctccatgttgctgcaaaggacatgatttcatccttttttatggctacatagtattccatggtgtatatgtaccatattttctttatccagtccactgttggtgggcatctaggttgattccatgtctttgctattgtgaatagtgctgtagtgaacatacacatccatgtgtctttatggtagaatgatgtatattgctttgagtatatactcagcagtaggattgctgggttgcatggtccttctaagtccttttttttttttttttttttttttttgagtcggagatttgctcttgttgcccaagctggagtgcaatggcacgatcttggctcactgcaacctctacctcccaggttcaagtgattgtcctgcctcaatctcccaagtagcggggattacaggcgtgcaccaccacacccaactaattttgtatttttagtagagagggggtttccccatgttggtcaggctggtctcgaactcctgacctcaagtgatccacccccctctgcctcccaaagtgctaggattacaggggtgagccactgcacccagccctaagttctttgagaaattgctgaactgttttccacagtggctgaactagtttacattcccaccagcagtgtataagcattcccttttctccattgcctcactagcatctgttattttttgactttttagaatagccattctgactggtgtgcaatggtgtctcattgtggttttgatttgcatttctctaatgattagtgatgttgaacatttttttgatatgcttattggcggtatgtatgttttcttttgagaagtgtctgttcatgtcctttgcccgttttttttttaatagagttgttttctgcttgttactttgtttagattccttacagattctggatactagacctttgttggatgtatcgtttgcaaacatgttcttccattctgtaggttgtctgttcactctgttgatagtttctttggctgtacagaacctctttagtttaattagatccagcttgccaatttttgtttttgttgcagttgcttttgaagtcttcatcatgaaatctttgccagggctgatgtccagaagagtttttcctaggttttcttctagggtttttatagtttaaattttacatttcagtctttaatccatcttgggttgatttttgcatgtggtgaaaggaagaggtccagtttcagtcttgtgcatatggttagccagttattattgaatagagagtcctttccccattgcttgttattttcagctttgtcagagattagatgttttaggtgtgtggctttatttctgggctctcacctgttccatttgtctgtgtatctgtttttgtaccagtactgtgctgttttggttactgtagccttttagtatagtttgaagttggatggtgtgatgcctctggctttgttctttttgcttaggatttctttggctattcgggctcttttttggttccatgtgaattttagaagttttttgtttgtttgttttttggttttttttcctaattctgtgaaaactgtcactggtagtttgataggaacagcaatgaatctgtaaattactttgggcagtatgaccattttaacaatattgattctttctatccatgatcatggaatgtttttccacctgtttttgtaaactctgatttttttttagcagtgttttctaattctcattgtagagatctttcacatccctggttagctgtattcctaggtatcttattcctttgtggctattgtaaatgggattacattcttgatttgactctcagcttggacgtcattggtttatagaaatgctactgatttttgcacttcgttttgtatcctgaaactgtgctgacgtggtttatcagatctaggagttcttgaatagagactgtggggttttctaggaataggatcattatcatctatgaggaaagatagtttgactttctctcttcctattcagatgccttttatttctttctcttgcctgattgctctggctagggcttctagtactatgttgagtaggaatagtgagagagggcatccttgtcttgttccagttcttaaggggaatgctcccagcttttgctcattcaatatgatgttggctgtgggtttgctatagatggctcttactattttgcccctctttttaaactttaatatattagtaatacctattattttcatattgtaattatctacttcctctagcctgggaattctttataggtcggggaggggacagtggtaggctttatctaactcatcttagttattgtcagtctcaagtatgatttctggcacttggtgggtgctcactaaatgtttgggctgaatgaattcatataaacaagctaaaaatagacttgtagataaatgatggagaactttatttaaactttgtcttctctgaattactgtcatttgctttgtgattttaggctacttcttagtttatgagcaccatttctcaaggctgcattctttaagaaatattaatatttgaggagatactacaccatccaaagattgccgctagtattttctaagatgttttttagggaaaaaatttaagaatggagggaagaacctaatcagtgaaagatgtgatcataaataagcagacagatttataggaataaacaggttaagaatttgaatatagaaatatagaaaggaatatattagattaaattatagagtcctaaagtagagtgtaagccagaattatatgtgctcttacacataccacatactgtataggattgtttatgaggttcagttgagataatataaatagaagtgctcgtaagtaggatgtttgtttctgcaaaatgaattttattaaatatttagtgtactgtagataaagtgattcttaagaatttttaaaaactgggccgggtgcggtggctcgcgcctctaatcccagcactttgggaggccgagttgggctgatcacaaggtcaggagtttgagcccagcctggccaacgtggtgaaaccctatctctgctaaaaattcaaaaaattagccgggcatggtggcgtgtgcctgtaatcccactacttgggaggctgaggcaggagaatcacttgaacccgggaggcggaggttgcagtgagtcaagattgtgccattgcactccagcctgtgtgacaagagcaagatttcctctcaaaaacaaacaagcagttatgtattgccatgtaacaaattacaccaaaatttagcagtttagagcaataaatatttattatcttagtattcctatgggccaggaatatggctacagcttagttgaatgcccttttactcatggtatctcaggaggctatagtcttcctatagttagggtcagttgaagctgcagtcatcacaaggtttgactggcagagaatctgttccaagcttaatcacttggctcttggtgagccataggttgcctatagctgttggctggatacctcagtttcttgccacctgtgtctcaccttaaagcagctcacaacatggcagctgacttcccttaaagtgactaagagagggtaccacaacagaagccagtctttttgtaacctaatctcagaagtgacatgccatcccttttgccatattctatatttgttagaagtaaacacacaataggagggaattacacaaggtggatggcgtaattgaaggctgtcttaaaggctgcctatcacagtgcaattagtatggcattagtatgagaattccagtgatgcaaaagtgaaaaattcgacaaaaacaagtacaggaagcaagttgaggttggttggttggttggttggttggttttacaacttttaatgcatagagggtaaattggccaaaaaaaattagtcaagaacagaaatatgtagcttgtcagcagttagttggaaaggggtaataagcaatgaatttgaataatttactaagagataatattactgtaatgtgtgtgttcatgggatcagttcatctcttcctatgtatttctcatttctgtgttggttctgacgcaggagttttttcctgtttgagtgagatccactaatggaggattgttatttgatgcttaggacttgggattgagcagaaaacactactgttggcttgtaagatcataatcggtgttttgaatatggaatatactaccttcttaaatttagttttacatgtgtgagtgaggcggtttcccctgtgcagtttttccttgcacttctccttcctgaaccaatcttaatgaggaatgtgtgtgacatgtaccaaaaacttcaaaactttaagatagagaaaatattttgaagatgcctattcataaattatttattggtttaatttattttcaataaaaatttcagtgagatgttaggtaggcgcaatatttctgaaatttatctaaaaaataagaaagtcaaagaaaattctgaaaactatgtttttgtttttgtgttttttttttgagatgaagtctcactctgtcacccaggctggagtgcagtggtgcgatcttggctcactgcaagctccgcctcccgggttcacgccattctcctgcctcagcctcccaagtagctggactacaggcacccgccaccacacccagctaattttttttgtatttttagtagagatggggtttcaccgtgttagccaggatggtctcgatctcctgacctcgtgatccgcccaccttggcctcccaaagtgctgggattacaggcgtgagccactgcacctgaccctgaaaagtatattaatggggaaggaaaaacagacatgccttactacatattaaaatgtcatttcaagcagtagtagctaaaacatcaatacatcatgataaatcagtggatgagaacaacccgaaaataaaaccctaccatttctgcgaatgaagtatataatcattatctaatatagctaatatgtaatatgtagtatataacatgtaatgaatatacataagatgtgtaaaggaattctgcatttttagacctcccacaacaattttaaatagtgacagtgatacgaataatattatgattattttgggactcttttaacattaattttaacaagaatgtattttgtgttaagtataatcttggttgctggggttacataatttatcatcctgttaaaatcattttgttgtctctattagtcttttcattaagagtgatatgtccttttttctatcaaactactaatgtcttttagaaattatttctgctaccaggacagattttgttttacttattgcttaagattgttaacttgcaaaacgaagtgaagtgaaaatttaatcaactgtgtagactgtcctaactaccttaatcaagtaaaagaatttacttgactttgttgcaatctgagcttttattttgtcaaagtctagttatcttattaagtcttcagtagaagatataattaatacttggtgatttctaaatctgaatattggagaaaagggcaccaaattgaagaatgctagattttaaatattttctagaactttaatctatatgttcctcaaggggaattattgttaagcactgtcttgatgtgggaaaatagatccacaagaaacaggagtttcttcttcccagcccctaaagatacactacattgtaactttagacttgactgaatttttcaatgtagtgctgtctttgcataggtgtatgtctttgcacagatggtgactagtagaatgtggattccgcttctcatcccatcatacttgtttagtttttccgggtgaatatatagccaagttttaaaagcaatgctctgagattcttactccacatcttgttaaatggcgattgtgaaccagtagatctggagtagggtttgagagtctgcatttctaacaaacccaaaggtgatgttatgctctcagcaaggttctagactgctaaatttcctatatagacttagttgttgcgatgtctttattcaaaaagaactgctttgttcttggtcttataattgtaagatattttgttaggtgagtcccatatattttttctcacttaatcttcacaacacccctgcaagactgtaatacatgttcattatggaaaattcagataagcaaaaagaagaaaaataaaagttacgtagataccagaaattaaaataatatttatttataagtttaagactccaagtgaagattaaagttctaaaaggaactaaagttatagcttcgggagtattatatgcattttcccaccttaagtaaagaaaacaaaacattgtgggagtaatatgactgaaactaaaatgtatttacttagaaaagaccagaagaaaatgtcagagcatacagtagttgcattagggtgacaggattataacaggcactttttccttttatctgcagtccacaatatttataatgtgcatatgttacctttacaataaaaatttaaaaaccttagtcttctcagaaatgccactgaggaaaaggtctgaaagttaataataactaaactaaataaatactttacaatttaaatgaaaatcatcaagatggacaaagaataattcacacaagtgaaaaatggtaaatgaacaactgaaaagaataaatcaaatacagctttggtaaaatagtaaacagctttacacaatagtaaaaaaacatgcagctaagcaggtatctatcttttccaaaaggaagtattttagagctaacaaccaatgctgacaaggcacagcaaaaccaatatatttgttcatttctggtagtagtatgcatccttttgaaaggtaatgtgattaacacaaagattcataaatatttaatggcaatagaatacaaaaatactatacacactccatctgtcactatgtaacatgtttacatgctgaaagacaatcttttggggaaaaaactcttttttgaggataaagagatgagattaccgagtgctttagtgtttgcttaaacattctttaagtcttcttaacttaaaaaaagcaaataaccaaagttaactttacatatgatagccctctatcaagtaagtaaaccacattttgcatattatggatgtttatgcttttttgtttgtttttagccctctttagacaaattcctatagaattttcctaaattagaaacaagtcttgagatttgtttttaactttcctagtactaaagtcaaccacttattccaaatttattgaattcacctgtatgtggtacaattattatctagttatcatacagggaacgtagaattggtaccacaaggaaataatgattttaagaaatagaaagatttaaaggtattatttcagaaatgactggagaactttaggcattaaaaaaaaatctgtaagttctggtttcagtttcttctcttcagtgtccaaaattgcatccaaaatagcacagccactgccaaacatgtgcattaaatcttggaaagcaaaaagagaaatggtctgtaccagtaagccacagtattaaaaagtttaagcagagactttcagaagtaatcggtcaggtgcaggttctgtagaaacttgaagtcttacctaaggaacaaggtaaaggaatgtataacatataccatgttacatgaacataacatttaatattgcaaatactttacagagctattattttatgtatatccttgtctgaaatgatttgtctccacttgaaccttgttgactgtttttctagacttcttaaaactgaaaccaaatagcataccctaattatctagttgagtatttcccagccatatgttgggtgagagctgttggcattttggacaagacacttcttgtgctggactgccctgtgattttgtgtcccactcattactaccagttgcaaccctcaggaattgagtactagaaacaccctcacagttttcatggggttggtgagcaagtaccttctgttgagaattggtctagtcctttgaagaatgctaggtagctctttctaaaataggttaatttcatgtcatagtgtttaggtaaaagcttcacattggacatgaataaaaaggattagagttcagtgtattcaggaaactaatataagatctttgaatcttcttattttgttccaagattgatgaaattcaggagaggacttgctacagtgtttttggagggtaattttgcactactgtttgaatcaaaattttaaattacgcatttgtcattaactccacttctaggaatctagcctgtaggaatcttggagggcataaaaaattatttgccaggatgttcatttgcagtattattggtaatcacaaaaatagtaaaaactaaaaaaaagaacgaaataaccaacaacaatataaccccacctacctgaatgagtattataaatagagaaaaggttaaatgggcatatagtacatgctatacgtttattatttaaaaggaaccaggactctatatcctgaataaatttttaacaatgtattattaaaggaaaaaaagaacagtatgggccatgcacagtggctcacaccagtgatcccagcactttgggaggccaaggtgggcagatcacaaggtcaagagatcgagactatcctggccaacgtggtgaaaccccgcctttactcaaaatacaaaaattagttgggcatggtggtgcacacctgtagtcccagctactcgggaggctgaggcaggagaatcacttgaacctgggaggcagagggtgcagtgagcggagatcacgccactgcattccagcctggtgacagagtgagactcagtctaaaaaaaaaaaaaagaatgttatgattagtatgatcttcagttttgaaataaaaatgtgtgtgtatggataagtaaggcctggaaggtgacttcttatattgttgaaacaaataaataaaaaagtagaaccaaggctttcaaaggttgagaaagggaataatacttcctttgtttttctagaacatgattggtcctcccatcattttccttcatttcttcctttagactgcacagttgcacttgcagtaaacccttcctcttgaatccctacccaaagatattttgaaaaggatctagtaactaatggggcaataagcagcactatcatcatgggcaccttaggctcagaatttgtcatgttttaactgtttctctgtctttgctcccatgtcatcttcagttgttgggtccaacttgcacatcttttccatatacctttattgttcttcctgtctttatcctagttcacttcatacctagattattatagtagcctgtgaagctggtctcttttcggcttaagtatttccagccgtggagagtatacctcaatgaaaatattgctgtagcaatttgtacctctttactctataatttattttttatcttacctttttttagtggtggagtaagaaggtaaaggtaaagggagatataggagctgatactattgtgtttcagtactggtgatctattgctaaataattatataagcttgcatactgacccaactcttctagaagggagagtgttaacaaaactaggagagagattgtagccaaggtttaaaatggatatatttatgggagaagcctgcttagtgaattgtgttttagggtaggaattctgaatgagtaagcatgtctgctctttttctaatatctgttaagtttggggctattttattccatgtcttttatcttcccttttagaaatccctcagttgaattaagaggaaaaaagatcatttaaaaaaatatctagactagcattgtatgaatgaagactgcagaaatctgtagaaacccgctagaaattggtcagttagtaaggtgtatccccttgatagcaatttctcatatggaggatgtagtagggaggtcatagcatctggagagctttttcctaagtgacagtcatcacattctgagatggcatcccacttatcacctttctccctttgagaatcagttttaatgagtcattattactaagggaatgtgttttatttctcatgtgcaggggcagaaaattaatttggaacagttaccttaaagaaagtgagttggcagtaacagtgattatttccttcactcccatgcccaaatctttcatactctttaaggctgaaaactgccacttcctgtaggaaatattccctgctttccttctggcctttcctatttaatttgtccctcttctgatcttacttgaatcttttttatgacccttgttattttctacattgtactataaattatgtgtgtgcttattaaaaaatctatattctatactagaaactcttcctagagcagagtacatgtctaacgcctcttgtattctcacagtacttaatagaacatcttgcacataatatagaggctcagcaaatatttcctgatcatattattaattgtgaagtttgctaggcaaaagttaatgaacttcaaatgtcattgctcttctacccctttaaaatgtcttttaccacagagaaaaattagcaaaaattataaagctgatatccaataactgaaattaggaaagcaatgtattgaagaaggagctagtgtaaatctagaagtgagtagagatgtagataagcagtgaattttataaaaccttgtgggtaatgcaaagagtttgacctttttccgtacttgaagagagccatttgaagacttttaagaggggagtcatttgatcaaattcgtgttttaaataaattagtgtgatacaatgaggaagctaactgtacagatagtaacaccagaagatgggaacccaattaggttattgcaagaatctaggaaagaataaatcctaaaatcttagagcagaggcagtatagtaggataaaagagaatagatttaagaaatacagataaaattgataggcttggtgccttatttgatgtgaagtaaggcagatggaagcatcttgatgaggctttagagattgaagtgctgacacctaagttagagaaggaatatagggaggagggagaatagcagtaactttagtggctgagatgagttttgaatgtggcgatattggattgtctgtaagagagccagttgaagatgtccagcagtcagttggttatataagactcaggtttatggagcggtcagtctgagaatcatcagcatatagattcagagtaagagtggctagagtttgtcctagagaacatgtattactgattttttttttttttttttggggatggaatctcactgtcgcccaggctggagtgcagtggcagcaatcttggctcactgcaagctccgcctcccggattcaagcgattctcctgcctcagcctcctgagtagctgggattacaggcatgtgccaccactcctggctagttttgtatttttagtagagatggggtttctccattttgtcgggctggtctcaaactcctgacctcaggtgatccacccgcctcggcctcccagagtgctgggattacagatgtgagccaccgcgcccggtgtgttgttgatttttagaacctttttttcactgttttctctggtgtttccattagcaagtatttgttacggtttactttctattattgtttttattatagaaacagtgtctttcaacctgaatttaatcatgaggggaaaaaaatcaaagcaatcctagttgaggaacactgtgaaaaacaattggcgttaagttttcaacaatgtgtgtcttgaaatattaaaaatataggttgtggaattgttcaacgttaaaggagactaaaagagacgtgataaccaaatgcaacctgatttgattgattgattccagataatctttttagaggacattattggaataattggagaaatttgaatatggattgtattttagataatagtaacaatgttaaaatgtgataatttattgttgtataggagaatgtccttttacgtagggtaaagtgccataatgcaacaactgcagtggttcagcacacacaaaaaagtatgtgtaaagtgataaagcaaatgtagtttgcattgtaagtgcttcttatgtaaaaatgtatttttataaaagtgcctagttttcttatttccttcttttttttttttttttttaaaaagacagactgtcttgctccgtctcccaggctggagtgcagtggcatgattacagctactgcatcttctacttcctgggctcaagccatccacctgtctcagcctcctaaatacttgggactacagatgtgtgccaccacagctggctaatttttctgtagagaaactcccaatttttctggtcttgaactcctgggctcaagcagtccttctgcctcagcctcccaaagtgctggaatttcaggtgtgagccactgtgcccagcttagttttcttaatatatttttgcatgtggtagcatattagaggttgaatacaattgtatttattacatgtttgtgcttttctctattgattatgggaaattgttaagacaaaaatcgcattcactgtatagcagctggtttatcctgtggttcttctctttgcaggcaaacttactaagtaaatggaccagaataaattattttcataatctattattattaaaccctgtattagtcagaatgggatataatctcagttatttaatacaactagggtttattcttgctcacattacttatccaacagtttgtcaggaaatagatctactccatacagtagctccagaaaccacactgatggaatttctgacagtgtatatctgtacacctggaacattagtcctccacggtgaccaccacatggaaataaagagctagaaggtcttctgttggccgttaaatatttcagccatgaaatgacacccaggtcattcaggcactcacaacctagtaaccagaactagttaccttaccctactggtaagtgtctgggacatgtgggaagcacaggttgtttggtgaactgtaaatgtgtctgtcacatattgtacttcatctcaagaaatatgcgtagcctttaaacctatggataatggccattgttgccataattctgcctattaaattgtactaaaaaagtgttacaggccgagtatctctaatccaaaaatctgaaatccaaaatgatccaaaatccaaaactttttgagtgcctacgtggtgccacaagtagaaaattccacacctgacctcatgacaggttgcagtcaaaactttaatgcgcaaaagtattagagatattgtataaaattacctctgggctatgtgtatggggtgtatatgaaacataaatgaattttgtgtttagacttgggtcccatctacaagatatctcattacgtatatgcacatgtgccaaaatttgaaaatccgaaatttgaaacacttctggttccaagaattgacactcaacctgaatcactttcagtgacaaacagtggctttcctcttatatattgactatttctcacataatccatttttatttattactttcaaaactatataataaatgtaaactgattttgagagtttagtgatttgcccagagttacagagtctgtcacttggagagcttgtagagttttgagattttgctttgccatttaaatttaatgatagctacatttaaatactattttaacctgaaactttttaaaatatttttaaaaaggagttttttcctcagatttttatttttcttcttaaaatttatattatttacatttaaaaaatagcattagatagtgttttcagaatgaagtctatcagccctgtatataatcatccttttttcttgggcacttaattagttagacatttctcaaaggtataaattctaatgtagttcttaaaaaatatccaaaatgtcctatattatagtttatcttaaacacatttgaaatgtctacatataatagattgatgaaatctatataaactttagtaacatgtctctaagatatggcactacaattaatttctaatattaaaaattttaatagaaccacaaacaatagaaaacattttaaattgtatttaattttaggatgtttattttaaatctagttataaacaaagtcagttaaccagattcttcaatggacttgatccctgtaccaccctttcctgcacacttctttttattgaattaggtaaattgtaaaccaaaagctcttactagatgaagttctcaggtcagtacagattcaacagtctgttatacccctgtaattcctgattggagttttgttctcaaaatcatactcttatgaacaaacgccaaagctatatcataactatggaatgaaggggagagagttacattttaatatttaaaatgtttaaagctttacatgtttgaagcaggtttattagcttagtagttttaacttttgttcaattataatcaaaaaatagctttcatgtttaatctctgacctttggtttgacatgtaaaaatgataaattttatcatagtgatacattgtaacacatgcccaagtatctccaaaactgacttcatcttttgtgaaagtgatgccaactgaacataccaggaagtcttaggcatttgtatcaaactgcctaagaacccagctgttagcttataagtcagtgaaattatattttatcatttattatcattgatagaacacagactaaaaggaaatacatctgaagtccatttctttaattcatcattatcttcagtggaaaaagatatgaggaacaacatcactcattggaaatgaactgtctttgtcatttcatttgtggtagttgtcctttcttcaaaaagctatttcttgaagaaaaggaaagttagtgaaatttgttttctcattatactttatccaaatttgaagtttcctaataaaagtagataattgccttttggcaagtttcctctttattacaagttcatgtaggtgtttgagtttgtttttcttatttataagaggcagaagatgatacctattttcacagttacttactaacttactgctttagtttgaaagaaactgacaatgtttcttctgaaactttttaacaatacaattaattagcatctgactaaaagtatctctttgggtttttaaattggacatgtcaggttgtttagtatcagttgttttactaaaaccacggaagtgccctcaatttttacagcattttgttttttgagtgaattttaccaaccatttacattttttttaaattatactttaagttctagggtacatgtgcacaacgtgcagttttgttacatatgtatacatgtgccatgttggtgtgctgcacccattaactcgtcatttacattaggtatatctcctaatgctatccctccccactccccccaccccacaacaggccccagtgtgtgatgttccccttcccgtgtccaagggttcccattgttcaattcccacttatgagtgagaacatgcagtgtttggttttttgtcgttgcagtagtttgctgagaatgatggtttccagcttcatccatgtccctacaaaggacatgaactcatccttttttatggctgcatagtattccatggtgtatatgtgccacattttcttaatccagtctatcattgttggacacttgggttggttccaagtctttgctattgtgaatagtgccgcaataaacatacgtgtgcatgtgtctttatagcagcatgatttatagtcctttgggtatatacccagtaatgggatggctggatccactggtatttctaattctagatccttgaagaattgccacactgtcttccacaatgactgaactagtttacagtcccaccaacagtgtgaaagtgttcctatttctccacatcctctctagcacctgttgtctcctgactttttagtggatcgccattctaattggtatctcattgtggttttgatttgcatttctctgatgaccagtgatgatgagcattttttcatgtgtctgttggctgcataaatgtcttcttttgagaagtgtctgttcatatccttcgccccctttttgatggggttgtttttttcttgtaagtttgtttgagttctttgtagattctggatattagccctttgtcagatgagtggattgcaaaaattttctcccattctgtaggttgcctcttcactctgatggtagtttcttttgctgtgcagaagctctttaattagatcccatttgtcaattttggcttttgttgccattgctaaatggcattactcatcatttacattcggtaaatgacatgtcatttagtaatgacatgaagtccttgcccatgcctatgtcctgaatggtattgcctaggttttcttctagggtttttatggttttaggtctaacatttaagtctttaatccttcttgaattaatttttgtataaggtgtaaggaagggattcagtttcaactttctacatatggctagccagttttcccagcaccatttattaaatagggaatcctttccccatttcttgtttttgtcaggtttgtcaaaaatcagatggttgtagatgtgtggtattatttctgagggctctgttctgttccattggtctatatctctgttttggtaccagtaccatgctgtttgggttactgtagccttgtagtatagtttgaagtcaggtagcatgatgcctccagctttgttcttttggcttaggattgtcttggcaatgtgggctcttttttggttccatgtgaactttaaagtagttttttccaattctgtgaagaaagtcattggtagcttgatggagatggcattgaatctataaattaccttgggcagtatggccattttcacgatattgattcttcctacccatgagcatggaatgttcttccatttgtttgtatcctcttttatttcgttgagcagtggtatgtagttctccttgaagaggtccttcacatcccttttaagttggattcctaggtattttattctctttgaagcaactgtgagtgggagttcactcatgatttggctctctgtttgtctgttattggtgtttaagaatgcttgtgatttttgcacattgattttgtatcctgagactttgctgaagttgtttatcagcctaaggagattttggtctgagatgatggggttttctaaatatacagtcatgtcatctgcaaacagggacaatttgacttcctcttttcctaattgaataccctttatttttttctcctgcctgattgccctggccagaacttccaacactatgttgaataggagtggtgagagagggcgtccctgtcttgtgccagttttcaaaaggaatgcttccagtttttgcccattcagtatgatattggctgtgggtttgtcatagatagctcttgttactttgagatacgttccatcaatacctaatttattgagagtttttagcatgaagggctgttgaattttgtcaaaggccttttctgcatctactgagataatcatgtggtttttgtctttggttctgtttatatgatggattacgtttattgatttttgtatgttgaaccagtcttgcatcccaaggatgaaacccacttgatcacggtggataagctttttgatgtgctgctggattcgctttgccaatattttattgaggatttttgcatcaatgtccatcaggggtattggtgtaaaattctctttttttgttgtgtctctgccaggctttggtatcaggatgatgctggcctcctaaaataaattagggaggagtccctctttttctcttgattggaatagtttcagaaggaatggtaccagctcctccttgtacctctggtagaattcgaatccatttacattttaatataggattaccaggtttttatgctgctaaggacatttttgtaaaaattattcccccaaaaaattagtttaataaaagagagggcattttactaccaaaaggtaaagtaggaaaggtgtatcttcagaataaaagactgcccttccatatatttcagttgacatttttatgctgatatagtatgtctcccattatctttatttctctcctacctctctttttttttttaagagatagggtctcatgaaactgcccaggctggccttgaacacctgggcttgagtgatccttccacctcatcctccctagtggctgggactaccggcatgtaccactgcaccgagtattactttttttctctttaccatgtgcttctgtgaactttattttaatccttacttgaaaagcatgattttgaacacaccctgtgatgaaggttacaatgcttattgcaatattgcaatagaaaaggagctttcaattttgtaggcaaagtttttgtgtgccagatccctgactgagaaagaagatattttcatttaaaagtaagcaaataatcctctactttttttctaacacagcaaattgatccatatgcataatgaaaaacctctgatattgaacatagagattcttattaattgcagtgttcacaggattagaatttaaatacacaaataggtgtctgcagctatcaataccagatgactcagtaagctaaatacagactttaatagaactatcttggatgccttttaaaatatcttttaaacttgttgtcaggtattctgttttatcttttgatttctaaaatgggttgtaacatttgagattcactgaagtttcttttgtattttttatggcaatagtattttgccattttcaggatagaaatactcatttttgaagctattacagtaggcagcttttttgtaaggtgatatgaatatcagagaaatataactacatgttatacttctgatttcatgggattaaaaaaagaaaaggcttctcaagtgacacaaatgcatatgttttcagagactaagaaagcataaattgatgatgacagaacttgtaacgcatttagatttgtgtcacttgaaaaacacttgttacaagcatgttgtcaatttgtgtatttcaacaaatagccattttaaagaaaaacataaagtaaataatagtacactgatgatattcagatatggtgaaatcatacaggtagaccttgaatgaataatgagcacattgctttaggacagatgtgactctcaacttttgatatttgactgtgtgagtttaaagttgatgctttaattttttaataggtcaaacttgggaatctaatgactgatagtatttttgataagaaagcactaatatagaacaagaaacagtgttctgaaatgaaaattatcagacttccactttctgttcatatctatttcaaaaaatgtacgtggcatattatgttctttgctacttagtggctattaaaatggaatcattttataaatgtctttcagcaaagaaaaatgttgtctgctgctgtgatcacccgccactaagtactgtgctcctcctctcagtagcttgaccaccttatatactttatgtggcatctttaacctgtatctgtcaccttacatatcttcttctttgttccttaattttttttttttttcaaagactgcctggacctactctctcattctctcctctgtattgctgctatagttgtcactttcttctacattcccattctctgctttggctgctgtaattatcttttgcttttactattttgatcttgtcattcaggactgtactataaattacattttaccatgggttaggtttacctatcttcaaaaaacttcagattaccttattctctcctcaataccaaataatatactctagttttcttagctaatttttaagcgtctccccattcctccagatccaccaagaaaaattcatcctacaccacatttttacccctggacctaaagtgtattatatgttcttgaacaggaaaatttcatctcctgaaaaaaaaaaaattactgatatttccatgagtacatattgattctggtttgactactattttgaaatagagtggatgtaaaaatctatgatgaaatcttaaaactagtaaaattatcattagaactagtattatacatggaactattagtctggtagcatagtctgttatactactcacactaaagcaaaataaaaagtactgtcttcacttggaactgttgtcttacaattctgtgcctgtcttcaccatttcatgaaaatattaattgttcttcttggcttactttttctttaatttatgttcttgccaggtcaaaatcaaaagtgatgatttaggacttgggcatttgtcgagataagttcatattgtcaccactttcccaattttgaagcttacaaaaaaaataggcaggattttagtttgccttcagttagggaaaggagaattcatttgccacaggagtaaaatcctacgttttataaagctattttaatgaaaataccagctttccaaaatgaatgggacaaacacagaattgattgttgcttaaaaactttaactgtattgagttttggtaaatcataattcaaaaataaaatgcagggggacaagaaattattaactttttattgttgaaatacattttcctcaaagtgtttttttggttttgggttttttttgttttttttttttgaaacgaagtcttgctctgtcacccaggctggagttcagtggcgtgatctcagctcactgcaacctctgcctcccgggttcaagtggttctcctgccccagcctcccgagtagctgggattacaggctcccaccaccacgcctggttagtttttgttatttttagtagaggcggggtttcaccatgttggccaggctggtcttgaactcctgacctcaggcgatctgcccgcctcagcctcccaaagtgttgagattacaggcatgagcgacagcacctggccccttcaatgtttttcttaaaaatatgttaccagtttctatcactgcccattttccacctccttattttttgtataatgaccttgaattttgacccatttcttaaaaattggatttttatcataatttttatactcttaccctaaacctattagtttgatttttcaataagaaaaatcatgctattcatagtataggtgaaatctcatctgaggttacccacttgagtagtatattcatagaaaaagtattttgagtccttaagagccatgaagaaaacaaaactgaggggtcagttttcttttggccattgtcgagtattatacttttaacttagtatgaaatgtaggaaatgtccagcatactggatacttatttctctggaatcactctggctgtctaatggtggtatttggtattactgcagaaagcacaggttttgttttagaaagtcctggatttgactatcttactcattttatgaagttgtgcagtgatgaactctgaggttcatgtacttatattacttataaaacatttaaattgttagggttgttatgcctaaacttgatgattttatgtaccatcgcaattttgttgagaagataaatgccaaaaagcaaacccttggaaaattagtttacctttctttaccttacctttgataaagggaatgttaaagggtaactgatttgaactacagatttcttttctaccacctttaaggtcctttccagtattatctctgtaaacaaagttaaagaaaaatacatttgaaagaaaagatttgttgtaactaaaccaattaaagctggcttctaggccagggctggtggctcacacctgtaatcccagaactttgggaggccgaggcgggcggatcacgaggtcaagagatcaaaaccatcctggccaacatacaaaattacaaaatttttgtaattttgtactaaaaatacaaaatacaaaaattagctgggtgtggtggcgtgcacctgtagtcccagctacttgggaggctgaggcaggagaatcgcttgaacccaggaggtggaggttgcagtgagccgagatcacaccactgcactccagcgtagatgacagagcgagactccatctcaaaacaaaaaacaaaaacaaacaacaacaaaaaaatgctgacttctcagggccaatgatgttattctctgagatatatatatattttttcctttcatggataagttgaggacattatcttgatatctcttgatctgataactagagtaatctttgaatattgttgttagttattattaaaaacacttattaaggtcctttatggaaagtgaccagtttcctgcttttatatacattcttctttctgtggcctgaaacattatgtggtctttggttatttactttacaatttagttattctgataaatactcttactttaaaaattttatatccagaagaatctttttctgcagtcacagaagtagtcttggttgacctgttttggctttctgtgtaatgtctgtattagataccaactgattgatataaatgagactctaaggggataataataagtgttaaggcccaatcaacaccctgaggctgtgaaaatgttcactactatttgtagaaagttcatatataatatgatataaaaattgcaaattgagtcctggcaatatctagtcttataaatggatagagcaagatgcacttttgagtgaatgaattcctgttttaaagtggttaaggattatatttgcaagttccaagttatctgtattctactaattgtcctatagatgacattgttataatttgttcactcacattgttgctttccactaagatctgttattattatctttaggattttcttatttgttaacatgattgcttaagtgattaatcaaactaaatcagataacatagaactcaatgaatatagctcttaactttggataacagctattttcctcttgaactaatatccaaatttttgatctttaaatgttacaactgcagtaagcatggaatattattgaaataaatttaaatataactgtttaataaattattaattatggatgattaataaaatgtttagtgtgttactgaatgtttcttgagaaaattttatatcagtttaaatagttttgtagcttgtcagcattacagaattttttatttttttattgtgtcattaagtgtagtggttaagaacataggcctggagtaagatttgaattcatattctgattgtggtctttattagctgtgtgaacttaggcaaattactgtaacctctttgaaaaggcttccatttctataatagtttgccagctggtttggtcaggaacactgtattgtcttgtgtataggtgtatccacaatgtctggtaccttgtaggtactcactaaatttttaatgaaatgaatgataactgctttggatgattgccatgaaaattaaatgatgatatgaatgtaaagcagctagtaatgtacatagctgacactaactgctgttattatcaacagtgacagaaaatctccagtctagctaatacaagaaatagatttttcctcagactctcatctcacattcccttttaagatttccttgtcctatccccaccccagacgtttccattttgcttttattttctataataattcctgggggcctctattaaaggcctttttctttgactacttacatccattataccagtatctttgtcagtaaaattttatatatcttttattctgtcatcaggttaagaaacaataattgtatttttaaaggaaaatattttacgatgctactaagcagttactttgtccacttatgcaggtatttcataagtatgaagtagggaggtcaatatctgtctgacaggaatctgctgaagattaatgttatctagcagaatgcttggcatatagaaggtactcaaataagtgatgctatctattaatagcattgatagtaatactttaaaacactcttttctagtatatcatatctccaaatttaatatttattgtcttttacacttattttacatacattaattcattactttttttttttttgagatggattttcactcttgttgcccaggctggtgtgcaatggcgtgatctcggcgcactgcaacctccgcctcctgggttcaagtgattctcctgcttttgcctcctgagtagctgggattacaggcatgtaccaccacaccggctaattttgtattttagtagagacggggtttcaccatgtttgccaggttggtctcgaactcccgacctcaggtgatccatccacctcggcctcccaaagttctggtattaaaggcatgagccaccgcgcccagccagttcattaatttttaaaataactctgaggtaggcactattatcctcactttatatttgaggaaaccctcaaagagactaagtaaataacttaaagtctttcaactagtacgtggcagaattataattaaaaacctgtttttgccactattgcatattgttagaaggctgtttcttcttgaggctgagctaagagaacatatatccatcctacgtaacttacagttcccattgtctgttcatttgcctatattctactcacatttcctgctttccattcttacttatttctgtccaactagaccaagaacataatattctataccctgtctcccaaacttctaagtcatggatttgttttaacctcctgctatgctcatttagctaggtatcatttatgaatattttcttctcattttcgtacccattctcaagtctaattcattgatgactcagtcacgtcagtagtttctccattaccatggcaataccttcctgaatatgagaataaacatatatcctgacttaattcctttggctcactctgtgaattctttaccacttttgaacactgtaaatgtacctttgagaacttctttgttgccagtttgatttaaaaacaaaacaaaaaaatgttactgactgttccagttatctgttgctgtgtaacaaactactccccatacttagtgtggttttaaaataacagccattttcctatgtctcacgattttgtgggtcaggaatttaggcagggcttggctttgttcatgtggtggtgatggaggttacttggaggtattcagctggtagatgggctggccagaatagttccagatggctttacccatataagtgccgccttggtagagacagccaaaaggctcgattcagcggagacatcatgtgtagcatctgcatacagcatcatcagcatggctttttcatggtcatgtgatatttaacatagtggatcagggtttccaaaaagtattgtcaacatgcttatttgaaagctgtaagatttcttatcacctagcccctttctgctgcattttattcaccatgcatgtcacaaaggtcagcccagattcaaaggagaggaattagccattacctcaatatgaggactagcaaataatttgtggtttttattttttatttttgtgggtacatagtaagtatatatatttatggggtatgtgagatattttggtataggcatgccatgagtactaatcatgtggtttttaatctgccacattgaattaaaccaattattttagattgtgtaaattcaagttgaaaaaaattggtaatagggcaaatggtttcatgtatttttttaccgggaacaaatttaaacagttattagaatcagagcacctataatgggagtcaatttttcctgaagctgaaccaaaatgtttattggtttgatttgaaaggagaagttggttttgttgacgttagaactataaacactttttcctataaatatgtatattctccctctaatatttgctttatgattaacagtgtactatcatctgcttttgtatcacgacttgagttcaagagttgtaggtgtatgagatctgagaaaagaaagaatcctccactccatttcatttaatgttatattctcaccaatttatataacacttacatattataagtattgttttctcaaggaggatacaggcatattttactgagaggagaaaagaatatcaaggcggatttttggtttaaaatgttattcatattctaaacttgtagatcattataaggattttgcctttgctctgaaaaagtcattgaaggatttcaaaaagagtgacatgatccaacctgtattttaatagaatctctgattgctatgtttaactgccaaggagtgcaagagtgaaaaagaccaattaagagtctgggaagggagcatggtggcttggaaatggtcgaattttggatatattttgaaggtagagactcacgatccaaaagttgtgtaaaaaagataggagtcaaggataataagatttttggccaaaggaactggacaaatgagttgtctttaatcaaaattaggagtattgtagaagaagcacgaagaacagtataaggaatttattttggaagtaagtttgagatggttgttagacatccaaatggagatatcaaataggcagttggatataccagtctggagttcaggagagaggtccaggctggagtctttaatatatatagtgtttaaaatccttgagacatggaaatcaccaagggagaataaagtggtaaaggagacgggtttcgccatgttggccaggctagtctcaaaatcctggcctcaggtgatccacctgcctcagcctcccgaagtagattacagccatgagccaccatgcccggctgcagtgattttttttttttaaattttctaccactttctttcaataaaaccatactcgatgcacaaaaagagcaggaaagtcaggagactgggaagctttgcaactaactttgaatgtgtggtcttgaacacgtaatttcatctttttcttatctgtaaaacgaagagattggactagattatttgtaagatgccttcctactttaatatatcagtgaatcttttcaaaacagggtaattatattgaatgtaactgtcatcctagggtaagtgaagtagtctttaactacatgcaggtgacagtttgtaagcttgcttaaaaacatgattgctttgcctattcttctcaagaaattttagtcaagtgcaagttagagctaattaatacaaccaaatcacagtgtttgtttttgcattcccagaaattgttagtactgtatatgatcagtatgtacaataaatgtttttactaactaaaaaaatttcttaaggaaaaatatattgacctaaggagaaatgtttagagctagataaaggagattaatatctctagatgcaattttactttacaacgttattgaggtatgatccgcttaatataaagttcacctgtttaagtatacaatttaatggtttctagttttagaaccttttcatcagtccccaaattttcctcaagcctatttgcagtgagttcccaactcccacagccctctccagtcctggcaactactgatctgctctttgtttctataaatttttctggacatttcatctaaaaagaattatatgtagtattttgcatctggcttctttcactttgcatgttttgaggttcatttatgacataacgtatcagtattttgttcttttttattgctgaatggtagttcattgtattatgatattttgtttgtctatacactagttggtagatacttatataatttccagttttttacttttatgagtaatacttttttgagcattcatggagaaatctttgtgtagacatacgtttttatttatcttggatacattcctaagaatggaattgctgggtcatatgataattaactttttaagaaacagccaaactgtattccagtgtggctgtatcattttacatttctaccagcagtgtgtaagggttcaagtttctctacatcttcaccaacagttaatagtgtctttttttataacattatgacagtttaatggatgtgtcatggtatcattgtggtttcagtgagaatatacctaatgactaatgatactgagcacttttttttatatgtttataagccattcacatgtgttctttggtgaagtgatattgagcacttttttttgtatatttataagccattcatatgtgttctttggtgaagtgtcttaagtaagttctttgcccattttcaaagttgtgttatcttcttgttcactagtgagagttcatttaaattctgaatacaagagcttcatcagatttgtgatttggcaatattttctcccagtctatggcttgtcttttcattttcttattgatatcatttgaactatgaaaattgttaactttaatgaaatccagtttatcagttttatcttttatggctcatgtttttgttatctaagaactctgccttgtttttgtcatctaagaactctgcctgacctaaggtcacagatgttttctcctatattttcctttagatggtttatagtttaagctcatacatttaggtatttgatccatttgaattaatttttgtgtatggtataagttaatggtctgtttttaaatttatttttgcatgtaaatgtccagttatctaaaaatcatttgttgacaagactgtcttttattccattgaattttgtgggcatctttgtgaaaaatctaacataaatacaaagatttatttctggactctagattctcttcattgatcaatccgtatacctgtccttatattaatagcacacaatcttgattactgtagcttcatagtaagttttgaaattgggtagtataagttctccaacttttttcttcactaaattattttggctattctagatcctttgtattttcctataaagttaggatcagcttatttctatggaaaaaaaacagctgggattttgaaaaagattatgttgaatctatagatcaatttgaagagaattaccatattaacaattttgagtcttctaatttatgagcatggaatgttttagatctttttggctcagcagtgtcttataacagtgtgcaaatacaaatcttatactgatttttaaaaatttattcccaaatattcttcatggtcctagtttgaatggaattgttttcttaatttcatttttgcatttttgctagaatatagaaatacaactgatttttgtatgttgattttctatcttgtgatctagctgagcttttttttgattctagttgttcgttggtggtttcttaggattttctacatactggacagtgtcatctgataatgcagtttcatttcttcctgtctaatctgaatgcatttaatatctttttaagtttttttcttaaaatgtgttactttttggtgttttgctgtactaactaaaacctacaggacaatattcagtggaaggaataagaacaggcatttttgtttttctcctgatagggaagttagctgtagaattttcatagatgctctttattaggttgaagaagagcctttttatttctaatttttgagagttttaaaaaatagtggttgttggattttgtcaagtgtttttctgtgtctttcaaaatggtcatgtagctttagttgctatttctattaataagatgttttacattaatttatttttagatggttaaccacccttgcattcacaggataaatcccatttggtcataatgtgtagtcatttttatatgttgatgaatttggtttgccagtttttaaaaaataatttttgtatgtgtgttcatgagggatattggtctgtagttttcttgcattgtctctgtctggctttggtgataccagactcagctgggaaatattctctagtttataaaacagtttataaaagtttgctattctttcttatatatttcataaaaatcattggtgagatcgtctgtgcctaggctttcttagtgtgaagatttttaataagtagttcagttttcttatttgttagggatctattcagagtttctatttcttgttgagtctgttctggtaatttgtcttttgaagaatttcctttttttttaatataagttgtgtaatttgttggcttaaagttaatattcccttttaattctttctttttttatttttttgaaaaggagtctcactctgtcacccaggctggagtgcagtggtgtgatctcggctcactgcagcctctgcctcctaggctcaagtgatcttcccacctaaccctcctgagaaactaagaccacaggtgcatgccaccatgcctggctaatttttgtattttctatagagacgaggtttttccttgttgcccaggttgctctcgaactcctggactcaaatgatctgcccaccttggcctggaaagtgctgggattataggcatgagccatcacaccgggccttcccttttaatttctaaagtattggtagtgatttcctctccttcatttctgattttggtaatttgtgtctgttctctcttactttcctgatcattctatttaagacattgtcaattttgttgattattttttaagaactaatttttgaattcattcgtatgtctctggttttttttttttttgtttatttttacttttatctttatttttttcttcttcctgtttttgattttgtttacactttttctagtttcttaaggtatggaagcataaatactgattcgaggctgttctttctaatatgggcatttaaagctataaatattcctataaaactgctttagctgtatcccatgaagtttaatatgttgtgatttcattttcatgcagttttaagtatttaatttctctcatgatttcttctttgacccattgattttctcagatttctttcggttatgggttttaattttattcttttgttgtcagggaacaccctttatatgatttgttgtaaatttaatgagatttatttcatggtccagcatgtgatcaattttggagaatgttcttgtatgcttaaaaggcattgagtattctgtggtctttgggtggagtgttctgtaaacttaagttaggtcattttggctgatagtgttgctgaagttttttacatcattgttaattttctctctagttatatttatcattcagttctgtcggtttgtgcttcatatatgtggcaacttcgttgttaggtatgaatacatgtataaacgttatatcttccttatgtactgactctatcattatgaaatatccctctttttctttattactatttatcttcaagtctgtttcatctgctgttaatagccattccagcttttttattgtttctgtttgtatggagtatattttctattattttactttcaacctatttgtatctttgaatcaaagagtgtcttttgtagaagtatataattgggtcttgttatttgaaccaatatgatagtttttggcttttgattgtcatatttagcctattcccatttaatgtgatttttgatatgggtgaatttacttatgccattcttcctttactgccttcttttgtgttaaatattcttttagtgtactatttaaattcctctgctgtttttttttttttttttttttttttaaagaacaggatctcattctgttgcccaggctgaagtgtattggctattcacaactgccatcatagcatactacagactcacactctctgctcaagtgatcctttcacttcagccttgtgagtagctgggagtacaggcatataggagtacattggagtacaggtgtacgctactgcatgcagctctcttgattttttttaaaacaactttttagagttatttccttggaggttactgtagggattacaatatgcttcttaatttatcacaatctacttgtatagttaaatttttattccagtatagtagtagaaaaactcttcctttaataaagtttaaagtagataagtttttaaaaacatactgttttttaaaaatgtactgtttttaaaatcctaatttttatacttagttatttttagcagtgtcatattgaattctgttacgagtttcatggttacttataataaccagtttcctcattacatagtagaatggtatttttccaatttgaactcttaattttaaattttcttctacctttaaaattctgtgattctgtttggtcaaaagggtctgtggaaataatacttgatatgtttatatagtggttattcaaaacttactcatatattatttgctgacatctgatgagatatagttctagagacattttttatttctggactttagtcttggatggatgaaaatttgatccgatttcaggaaagaaaaggattataaattagaatccataacatggtaaaagaagtttgtttttaatgtcaatctaatggtaatttttgatcatttaattttttaatttaattaaatctaaggctgagcagatttttctgtatggtttcagacaccagtagtgaaaattacccaattccatttaattcggtagcagtaagataccagttggcttttattgattaatcttccttgctccttcatcaactataccatatttatattttataagtaaaaagttactcatattgctagctttttgtggatctgttttggattttattctcaattttcccaaggatttttacattttcagtccatgtaaaacttcaactcttatttttcttaataagagtatgggggggtgggcagtttctataattaactgataggtctctgttaaaatgaggttctctttctaataaaaaacaaatgtgacgtggctaatgtaagtttaacatgtaaagatcatggtattaagatcacttgatttatgtttgtatatgaccacctggtgtcatcattttaactacatgaacttgctcagcatccagatttcacactctttaacttagtgtttgattgtgtaagacgttgtgttttttatctaatacattctctagcagtgttatattttatttcaacctggtaaccatatgaccagcattgtgctaggtattatggaaagatttcaaaaattaatttttaaaaattaatgagacaagattctgtacctaaggtgccagtgaaatgatttgatagaatgtaattatgcatgactggatgctgactttgtgtgcatctaatacagaaattcattaaaggaaaagattgtaaagtaaaatggtaggtagaggatggtttccaggaagagttggaacttgaaggatggtaagtgaaatgatagaggaatagaggatagatagatttttgtctaggtgtcatgataaaatagtaacatagacagtccttgatttacagtgggtcaactttacagtttagattactaatgaatgggagcaatggtagaaattataagattacagatagtggcttttcattttagaaatatttgagcactaacattttaaggggaaatgattgtcacattgacacattcatacattggtactgtaagaatttgtagtgccaaaaaagaatcatgaatgaattcccacataatgaagctatgaagaactttcagaggccatggaaataaatgaatttttgaagagctataggtagacctaagtagctagagttaagaaattatcaaagataatgaaccactggagaaagtggagtcagtagagtcaatctaaggtacaagaaagaagattgagtcacagaaaccaaagaatgagttaccagatagaaggactcacactcaccatgcgcgttgaatgttgcaatactgtttctcttctcttcagtgtccctcttttcctccttgtagcttaaattcaaaggtcatttaatcatttccttgcatacaaataccttcagttccttcgctcctctctgttttggcaaaaccacagctttggttaaatctcacccttgcagctaagtgggactggaaaataattcaaaaaacataatgactggtctcactttaaaggcagtgggctcttaatgttacccagcaattgtaccacacttctttgatccattcactctcctagatgattgtttcattctttttcctctcctgaaaacctccaacatctcttcttcatcaaggcaatcagaaaagttttcacaagtacctgacatcacatttgtcctcctattctttgttaaacctactctaaacaggtttctgctcttctgtcccaccgttttcaaaatgggtcttctctaagtcaccagtaacttgcatcaagtctagtgatcagttctcagacttcaagattcagtgaccagttgatgactcctttggtattgagggctctcttcgttgtgcttctaaggtaccatattgtattagaattgctgtatcaataccagtgccaacacagaacacacaatatccaaggtttcttttcagttctttttgttcttagaatatattccagtatattagtttcctaggactgctataacaacttataataccataaagctggtgacttaaaacaacagagatttattctctcacagttcaaggggccagaagtccaaaccaaaatgtcagcatgcctattcaccttccaaaggctctaggaaagagtctttccttgcctcttccagctatggtagtggctccagggattccttaacttgtggctacctaaaaccccagtctctgactctatccctacatggctccctttgtgtgtctgtctctttcttctatcttatataaggatgtgtgtcattagatttagggaccatccaaaatgatctcatcttgagatcctttattacattggcaaagacgctttttccaaataaggtgacatttatgggctcccagtggacttatttgcagggggttgagggtttcacatttcaataaactattcagtaattgcatagttatagtcctgtcatcaaagttacttgaattaaatttttctgtgtgattatggtattatttgatatatagttgggtttgtttgttgctgtttgtgttcagttttaggatttgctttttcatccaataatcataatactgatttttgagtatatataacatacacagtcatgcaccatatgatgacatttggtcaacaacagaccataatgacctacaggtcctacaggattttaataccatatttttactgtaccttttctatgtttagatacacaaatactgttgtgttacagttggctacgtatacagtacaataacatgctgtataggtttgtagcctaggagcaataggctataccagtagcaataggtgcgtagtaggctataacatctaggtttgtgtaggtacattctgttatatttgcacagtgatgaaattgcctaatggtacatttctcagaacgtttgtccctgtcattatgtgacccataactgtgtgtagctcagaggtcaaagttatattaggaggatatgcccagaattctcactaccatcccattttaccttccttgtggataaccatttcatgactactttcaagtttatcttgacctaacaagtaagtctgattgattaacctcatcttaatcatgggacaaaaacaagcagactcctcaaagttccatatttaaaatggtgataacgagacttaactcattggattatattgaagattaaatggaaaaaaaaaaaagtaaaacaactagcacagtgcctggcacatagtagatataatttccttttttcccttctgtacctcataatataggctatgtattgcctacaattagggaggctaatcagtttgttcacatatagccttttctttctataaaggagaatttgtgatatattaaacaggcattataaaatattacccagaagttttatcaattttttggctttcagctcctgaaactatagatagcatttatctatagttagtagcactagttttaaaatttggaatcttggtcctctcattcatttatgtattacagcagagtcagacttattttaaaaacaattctaacctgcctgaggcttctgtctagaagtggaatgtattttgggtaagcttcttaaacttcataaaatcaccttctcatttattccttgccttaattaataaaacatgtacttctgctcttaatgaccttcagccatatactcttgacattctaaatttttctaacacccaattttgagaaaatgtattaatagaggactgactaaaggttggcattctctgcattcctctgaatatttcaaattttacttttaggttaaaccataccgttggagatctgtgtgcatggattgcatgattttgacctcttgttaactttgcatttgctggattgtactttcaggatgtgatttttttttttcccaagaaaagagaagaaaaggagaagttgcctaaaacagatctttagtttttttaggaatgctattaaggaccttctccattatgtcatccaacgtctttctgaggacttactagtgaaattactctcagatttctgcatcttggaaatgctgtacttctgaacaactactaattcacttttattttatacacatattttcttctttgccttactaacaaggagacttaagccttattttaggaccaactcttggagtttggagaacaatgtgtgtttctgtgtgccatttttattttcgatatcaaaatgtattgtttgccctgaatctttcccctgtttatttttagtcatatgtatgcatcagaattatctgaagcacttattaaataccagctcccatccctgaaaaccttgggttcagcgggtataatagattgcattaatagcaccggttgtttgccatgtgaccacaccatttaccccctgctcctaaaggggcagattatatttccttgccccctgactttggatttgctcataggacttactttggttttagtgggcgtgacatgaccaaaggcttgaatagcactggcaggattaggcttgtacttttgtgcctctattgtctccaaaagaccatgtccagcctggcccactggttccgggagaagggttgagagactgtagttttaggccagtacgtattgaagtatttaggggaatgaactttgatgttgtcacctcttaaatggttcagggaggcacacaccacacacacacacacacccccgaccaccaccaccacaccacgagtgagaaagggaaagacgaggaaagagtgtgattatttaagcagatggagcaaaatgtaagcaactggtgaatctggttaaagattatggtagtttcttgactaattatgtaattttttgagtttgaaattatatcaaaagtaaatgttatctcttccacctaaaaatgtaaaaacatttaaaaccttaagaaaattgttctgcaaagtttctaaatcagctagtttgaacattaaactttgttcagtgataaaaatctatactaatgaactaggtactgtccagaatacacagactattactgttttttaaaatttttaattttgaaataatgtaaatccataggaagttgggaaaaagtatacaaggaggtcgtcacccagcttctcacaataatacaattttacataactgtattacagcttcaaaaccaggaaactgacgttgatacaatccgggagcttgttcatatttaaccagctggatatgtactgttgtgtgcgtgtacagcaggtgtgtgtgtgtacagttgtgtgtacatatagttatgtgtaacagtaccacactcaacttactattctatcactgtaaacactacttcaggtggtatctcttcataaccacacctgcgctcttgttgtttgtttttttcacagggtcttgctctgtcacccaggctggaatacagtagtgtagtcatagcttattgcaccctcaacctccctggctcaagtgatccttacacctcagcctcccaaatagctgggactacaggtgcataccaccacacttgactaatttttgtattttttgtagagatgggcttttgccatattgcccagactattcttgaactcttgggctcaaactatccatctgcctcggcctcctgaagttggtattacaggcttgagccactgcgtctggcccacttgggagttttcagcccctggcaaccactaatcttttcaccatctctacaatgttattatttcaagaatgttacaaaaatggaatcatgtagtttgtaggcttttgaaattggtattttttctacttagtgtaatttcctttatatcatccaagttgatgtttttaccaatagtttttcccttttattgttctggcagtctgtagtatggctctaccatcgttggtttaaccattctgcattgaaggacatttgtttccagcttttcgctattatgaaattgtcttagtccattttgtgctgctataacagaatatctgagactgggtaatttataaaaaacagagatttatttcttatagttctggagtctggaaagttcaagattgaggggcccacatctgacgaggaccttcttgctgtgtcatcccatcatggaaagtggaggagcaagagagcacaagacattagtggggagaaatagaaggggacagaactcttctttttatcaggaacccactcctgagacaacaacattaatccatttatgagggcagagtccttgtgaactaatcacctcttaaaggtcccatctctcaacactgttgtattggggattaagtttccaacaaatgaactttgggggacacggtcaaaccatagcacgaataaagcagctatgaacattcatttgcaggtttttgcatgaacacagttttcatttcataaatacccaagaatgtacaattgcccttttacttagcatttagatttttcctttaaagtttattctgaggcaattgttttcatactctgtttgtgagaaactattgttctttccaaggccttaaagctatgactaattctgtaaacacagttattgtaatttcaggttaatatttttaaggagtatatacagccttgtgtgaaaagagagaaatggattcaaaactaagcaatttttaagtgtgccatgtttattaactaagatatgtatgtaaataaccagtagattattttttgaagtagcatgagtcaaaataaatcaaattgagagccccttcagcttgtctgtcaggtcaggaatgaactaatttgtacgtaccttttctccctcatcttgtgtcagtccttcactatgtaccagttacataatcttctttccttagctaggctctgtccttcttcagggacttgagcatgttaatcattatggatcctcatttcttcttccgcctttgcctgtttaactcttacttatgagatttccttaatgagacatttcctccctccccaaacgtaagtttagttaccttctttttttctcttgcagcactttgttttgttttgtttttcatataaaaaacagctaggactctggaatgttaagagtggggattctggaatcagacttgggcaagttacttaatctttatgtgcctctgtaattattgtcttaaaatgaacataaaagtagtacctaattcataagataaggattaaatgaattaaaatatataaatcccttagataacaatgctaggcatatgttaagcactatgttagtatcatcaaatgttgttgttactgttatggaatttatcacaaatatgtaattatatgtttcgtagtgattattcatcacccctactggactctaaggtctgtgaggatatgtctatttggtttaccactgtatcctcaacaactgctggttgtccctattgtaggtgttaggtattaagtgcatgatagtgaatacataaaggtttacttttttaaaaaaattcaggaaaccagataatcaaaaagaaagaaattaatcacttaataagtttcatctcccagggataagaaaacataggtaaagagagattaaactactccttcaagttcaggcaattcagtattctaattgaaagtgttgtgtttcctttttaagtctagttttgcttttgtgtttatatgtcataattaattgtgttaaaacataattttagaaaccgatctttctatatccctcttttctataccccccaattttacttcactttcttaaacaacaataaaagtctcctgtaacataagaaagcttttcttcctaattatcttctttaggtactttaaaaaaaatcaatcagctatcacatgttatggacaaggggaatcactattgagttaatatcctaagacgttcaaaacccagaaccaaaaaaaaaaaaaaaaccaccaaaaatgctgtttggagagtttcaggtttaattaaagagtttgttcaggtgtttttgctgtttggaatcattatctgagaaattatgctataacacatggtcatttgattctgtttccattagccttctactctgggatatatggctactacattttctttttaataatctgtgtttcacagtaagtttacttttgtggaactctattattaaataaatcagaaatctcacttaaaatttaaaaaattatttttctaatgaaaaattgatattacagaactaaatttttaaaagtttatgtacagaaaggatatagtatttgatgttatcaaaacttacatgttatgattagttcattgaccatgagtatattaatttagaaaaaaatacatccctaatttacatcatccttaatttgtatacttgtcatgtagtgcaggggtccagtggaaatcatagaaaggttgctgtaggtaatgagtcacaagtcacttttctccattgatagcttctttttctgtaaatcgaactatttaaaataatttaaaaacttagatccttagtaaaaagctgttttttattggtctaagttgactttttaaaaatttattttccctggccaggtgcagtggctcatgcctataatcccagctctttgggaggcggagtggggcggatcacctcaggtcaggagtttgagaccagcctggccaacatggtaaagcccgtctctactaaaaatacaaaaattagccaggtggggtggtgaatgcctgtaatccgagctactcaggagactgaggcacaagaatggcttgaacccaggagtcggaggttgcagtgagctaagatcgtgccactgcatgccagcctgggtgacagagtgagactctgtctttaaaaaaaaaaaaaaaaaaaaaaaaaggccaggtgcggtggctaacgccttgaaatccagcactttgggaggccaaagcaggcagatcacttgaggtcaggagttcgagaccagtctggccaagatggtgaaaccccatctctactaaaaataaaaaaattagctggggggtggtggtgcacacctgtagccccagctacttggggggctgaggcacgagaatcacatgaaccttggaggcagaggctgtaatgagccgagatcgcaccactgcacttcagcctgggtgacagactctgtctcaaaaaaaaaaaaaaaaattatcctccctaaaaagctattccagtatcttttttcacattcattagttatattatttagtggttatatttggttctcttgaactgttttctgagtttttgaaaccaattgcacaaatacagcgcaagggaaacatggtttagcagtagtaggactgaaaaaaagttttaattcttgctaacctcactgtgagactgtagtattttgtacctaacaaaaaattttccgcagtaatctttagttaaaaaaaaacccttctattacagaaaactatatagttgttatattgtaacttcaaatttttgttgtattttttattgtcatattgttttttctcaaatattttcagtccacaatttgttgaatccatggatgtggaacctgtgaatacggaaggccaactgtacaaaaaagatcccagaattaataagtaaggtttagtaagctttcgggatacagaattaatatacaatattctattgtatttctgcatcctaacaattaacaattggaaatcaaaaatttgtcaattataataacatcaaaaatgtgaactacttaggaatgaatctgaaaaagtatgtgaaagcaccgtagaccaaaaactagtaaacattgctgagtgaaattaaagaatatctaaattagtggagacatataaattgtttgtagatcataatgctcaatatggttatcagttctcaaattgttacatagattgaatgctatatctatcatattccaagcagctttgtagaaactgacaagatgattctaaaatccatatgtaactataaaaaaaaaaccctagcatcagaacagtttgggaagagggaataaatttgtactaaagcagagatattgattagataattggatatgagtctagtatatgggagaaaagtcagatttagagatacaaatttgggagccagaagcacagaagcactattttaaaatcatgccactgaatgagttcaacagtagagtacggagaggaagataaaaagaaccagaagaggatcctggagtggccagtttagtcagcagaaaaactaggagaatgtgttgttctggaagacaaagaattattcaaggaggagagaatgatcaactttgttgatttctaggtcaaatcatatgaggtgagaggcttgcccactgaatctagcaattttaatgtaattgctaactgtggcaagatatttggtggaatggagaataaaaacacatatggttgtgggttccaagagaaagtaggagaagaattagggatgaatataaacaactgagggaattttgctgtgaaagggaacagaaaaattaagccattgttggagagagatcataggggtcaagataaatggtggggtttttttgtgttttgtttttattggaagtagggacaattatttgcatatatatgttttatgctgattggaattattcaatatgtggaaaaattgatgatgcaggagagaggagaattgctgaaacggtatttttgaatgagttagagcaggatagagatcagtatgcagatgacacataagtgatccatgattttttgcatctcttccacgtataccttttcttgattgctctttcatgtgctttattaatgatcttacctattgggagagtttcctaaagtatctgaagcatattccatgttttcgtactagattgtcttgaagaactgaagatcaaaaatcaaagtagccagagtttcttgaaaagattcttaaggcagccagattccaaatggctaacagaaccaaaatggcaaagactattacatacttttataatttaatattaatatagaagtcttgttcacaaatttttcttatatttcacatgtacatctcaaaaagtttccatttcagtatttaaacaaaaaaccacacacttcaggatcttttgctttctaatattgttgaataatcaattcagaagaatctggccaatctttgatgtgctagtaaaaaaaaaaccaaagctgaatttttaattttctcacttatttacataagttgaaagtgtgccctcttgtggactattcagtaattttcacataaaagccttttccttgtatattgcagactaaattaattgtatatcatcacatatgttttggtcaaacgttgagatctagatcttaatgttaagttctttaaaacctaaacctcatttggaaataaacagtcattgtttgattttgcatttctaatacaattgtgtatgaaacagtcttttaacagtttcaacctatataagggacttggagacaggctatttcttttgcaatataaaagaagatgagaaataaattttgttttggtgtgttgggagtggactaggaatccaaacaattcatagacgcgcttggaaatttcctccgtagcctctatgtaaaaataaatttttaataatcaaattccaggacacaggactatttttttcctgaggtagtttgtagttttgtgtagtttggtacaattaaactttgcataactaactacaggcctctgcaaatccatttaactgtataacaaactgggactatttaaagttatgtgaagttttattaaagtcagttcatagatgtgtatagttttgcttattgttttatttctcagcaaacatacacatattttataaactgcttttgagaaaccctaaatctcaactttatttacttagtggtaacttttctttctctgcataatagtactcagtagtgtaaatatatccttctaatacacgttataaatatgtgatatagctacactattgggacacgcatatacattattggtatccagcggtggctgcagagagctcagggttccagaagcaaagcaagtgtctgaagagagttttagaactttgctttattttgcattttaaaaatttattggaagtaatttgaaactttagaaaagcagaaatgttttaaagaaagtgagaatttttacagtgcagcttattgggaactttttgtttttgaggtaggatttgaggaagatcctttcagaagtatcttaaatagcatgtgaaaaatctgttcttgaatagcaggcagggaaaaggaatctgaaggtggcttgactgaagtgaaaggattctgctggagaggtgccactctctagggactcactgacctatttaaaatagtaagtagtaccacatagatttatttatttatttacttaacctgtgtagctatttagcatttatatcccacctatttcctaaaaggattttaggtgttttataatgttaaatgtaatataaaccaggacaataaaaatatactagtttaaactttttaaaaaattctttaatgtgagaaggctgagcaaagggcaaggagaaccttttcattctccccccagaaatcttgctcctcttttactaaagctttcaatcatctctccaagtggtggcagggcaattctaaggtctgaccttagttcttagcatagtatgttaacagatttacccttagttttctggcccaccaagactccagcagactttctgttgcccaacaggctgggctgcagccacactataacaaggtctgaatctcagccttgtgagatgagtatgcttttccaaattcttattttcctcagatattttcctcccttaaacatgtggatggtagctgtttcctgtatttgccattcctgtattttgtagaatcctttttataccttctagttaaccatttttttactacttaataattctatatattaaatttttcttgctcaaaaacagtgtgtgtgtgtgtatatatatgcatgtgtctgtgtgtgtgtatatgtatatatatacacacacatatatgtacttagttttaagcctttcccccaccaccaaaaaaattaacattagcaaaggtgttaattagctaaatattccacatatatgaaatttcagtttattcaaaataatgttataatcacacaaggtgacaatatagtttaaagaatactgacctagagatcaaacacttatattctagtcttggctagtgaattactagctcagagaccttgaacagacacttatgttctttgaagaacttttactgtttgctgtaggtttatcttttttccatagcagtgtagatgtttctcagttttatgtcctttaggcaaacataagaatataagatttgattagaaacacctgagttcaaatcctatttctgctgcatgctgcctgtttagctgtagagagagtatttacgccctgaaacttaatttttgcatctgtgaaatagtgataatctttacaatcctttgatattggaatgattaaggaaaggaatatataaatatctgacacataagaagtgccaaaaaaaatttcccctacagcattactttatttcttgcctatctgatctattataatgtaactgttatcaaccctcaataagtggcttccataactatagctatagttcagactacttttgtcagattgtgaatttccaacttcctgctttagacatctccaactagatattacactggcattttaatctgaacaagtccaaaatcacaccatggttacatgtaagtactgcagtattctaacagaactttctgcttccatcctctgtctctttctcccccaccctatcttccttatcactattaaattagtcttaactgaaagcttaaggatgtggaaaaagatatcaacattatgtaagaaactcccttgcaggctccaattgacttttctggccatatgctctgtctaaagtgtttatgaatataccttgcatattatattagtctttagcacctagctcagtatacttcatagaagatgcttaacataggtaattatttaaatattcagagaaatctatgtacatatagcagcaacaggagacttactaatttttttattttatcatagtttatattagtattttcctgaatcataaagtaatattctaatcataataaaagtccaaggagtacagatagaaataccaccaaaataagaattccccagcatctcagcatatacccgacccctaatcattgttaaaggtttaataatgttcttttttttcatgcctagaccatcatttttatgaaaatgtgttttaagcaaaagtatttagcttggttgatgagcttatgatgtgcacactgatattttcagttagcaatatatctttaatatcttttcatgaattttaagaatctttgccattcttctttattttagtgccaatttgctgagagattaaaatatagaatcatcactgtaaagttggttcaggctttaattcaatgattctttctcttttctccctctgaaatatgtacccccctttaccacattcttgtggccaaactcaaattttaaagggcagaggatgttccatcttgttaaccattgtactttgcttgcctagcatacatagtgtctgacacagtaacataagataaatattaattggatgcctcatgaaggactaaatattttagaaatagtatgttgtgttgggtgccacttataactcaggaggtacttacaggtttgaatgaactgttatgtaacctgatacagcattttaaactgttaactattaagcatagtaaaaggaaaatgctttagttatgttgaagacaagatgaagcagatttttctggaaaacaacacaaagtagagtttaaagcaatttattaaattgctaagacagattgaatagttattatgagaaaagttaccagaatcgtatcttacatccatcatgtatttagctcatttttagtgtattcaaagatggagaaaataaggggtttgtgcttggtaagattcatttgctaaaatgtcattgtacaaattttgaaaagaaaggttatgaacttaacataaaaaataccatggtgtttacttactcattgtaatcttgtatccaaaactgtttttcctcaaagtgaattttgctttctgctcaatagttcagatcaagaagaaagtaagagtaattgaagtgccatagaaatgtgaatcacatactaaatgtggttataaagtaaggatcctaactccataaagccagagtcaccatacttcactgtcacatggtgtagtatactgactaacagtcttttaaactggatgtttcaatcaacccgtaaaataatatttaaaaaagaatgagacatctgtataaatgaaagatttctaagataatatacatggcaaaagtaagatgcagaagaatatataacaaataacatttgttgcatttaacgaacacttagtacatgcccagcacagttctaagaactttacacatattatttcatcctcacaacaaaatttaataataattacctacctcatatatcagagatgaggaaactgaggtgcagagattaaataagttgtccaaggttatgtagtaagtgggggagcttggattcaaacacacagcctaattaatatttttcttcttggctatatattttgagtacattgattgtgtatgcatagtaatctctcatggatgtaccatcatttgttatactaataatattgttatacattttagctgttagtttaagtgtccatgtgccagatagcctgatcttgactccagctgtatggccttaggcaaattatttatcttctctgtacatcacattcttcatcaaatagaactgtaatattagcacctcaggttcatatgaggattaaatgaggattaaatttattacatagtaagtgctgagcaaacatgagttaccatttctattttttaatcactaaaagtaaaaatattgtgggaatatctacatgtgtatgttaacatgtatatgattatttctttaggatatatttctaaaagtgaaattgttgagaaaaaatgatgcatttttttaaggctttggttatagggtgcaaagtggcccgccagaaagtttatctaccatcagataataagaatgccttttattccaaatctgtcccaattttagtagtattataatccctactgatactgttttatttgcacttcttttgtttgcttgaggaagttgtaaattttgttgtgaaattaaatgaagaagtggagtctttaaaaatcttggcaaatgcttaaaagttcccttcagactcattagaatggactaaattgataatttactataatatcttcccctaattaagcattcttttaattaaacctcaagccattcttaaatttagtttataaatgatttctcaatgtattttgttcgatttagttcttagtattacaacagttaaatttttttctgctttctgtcgccagtatttatttctcctaccttatgatttaaataattgtaggtgagcaggcccaagactatgacttttaatactgtggtgaaatatatactggaatgccaaataattatttataatagatcttttagaagtaggaattatttgtattgaaaagatgcctttccctctatttgttttgaaaagactcctgttcttcatctgttctcccgaatctgtttagtaatgctgttaactttctggatcacttactatgtgccaggtggtatgtcaaatgatatatgtgcattattttattttattctcatcaccacttagaggtgggctactttcctcactcttccattttttcaaatcagcaactctcagatggctttgcctggtttaaaatttacccacaattttaaagacattttacctgaactcacaaagcactgtgcagtatactcttatagttctattccctccatccctttcagtgttcaacccactaaatttattttataatctactaatcagtcaccaatcacagattgtaaagcactaccttaagtgacagttttaaagccctcattaaaatcttctttacagtttggttgcagtttcattctagacacatgtcagcttcagttttacgaaaaacaatatactttcacagagccaagcagtccaaaacattattcaatccagagccaaaaatgtcatagctagttagttagggttgtgtttgttcatgtttagaatcctaggaacgctatttcttgatggaccctggtcaccttccaacataaagtagcaacatttccacagattacttacatttattaaaagctgtgactttagctaaaattgtaacctcatttctaccaaattcctctgctgttcttcaaaatcttggattccagtggaattagccatagttcagcagtgaagatcaaatatttttgtcagtaatcatcaacgtgtaattaaagcactttaaaccaagtaagtattgttgctctcccgccctttcccctttactcccagtgtttacttgacatcatttcagtgcatttttatgtcactgtgaaaagcacaatcttgtggttaggtttattaatcttctagttcatacatgggtaactaaatacatagtcatttttaggctaaaaatcctagcctggggttggatctgctctatttgttactcacctgggacttaagaaaacagtcaggtagcccacagtagaatcctctagcatattactctctttaggttcctattctctgagttaaataattaaatacagtcatttgttacttaatctgcttgaatatggcagtgtacgtgtacaacagtgagttgtatatgaataacaagatatttttgtgatctgtaattttcattcaatggtttctttccattaattactgagcataagttggaactttcttattagcataaatttaggaaaaattcattgtgttttggtgacctttatcagattttaaattccaaccaactttttaaagtgcttgatgtgactactaactatgcagtgttgcattaaatttctttagtaattgttaaataatcaaattaataatttcaaagagtagaaattagtaatttcacagtgtagcaaatggacaaatatagaatagctagtagtgattatagctttcctatattatttcctgtgccttttcctttcagtgggcttctgctagaaattttgtcagtcattcaccaaaggaaagtaatgttttttcccttagctggcaattagtaaagaatgtacatataaaggtctttaaactgtaaagaaaaaagaggaaatgattaccacaaagacaagatagttaatacccctagaaggaaccagaatgctagccttttggatgatgattctatggatgcttactttataactctgttaaactgtgtgtgtgtgtgtgtgtgtgtgtgtgtgtgtgtgcgcgcgcgcgcgcgcgcgcatgtgtgtgtgtagcagtttaatgtacctttgtgcaataggtcttatatttataataataatgtttggggtgaaggaaattcttagttttaactacccgtataattatacgttaaataattctatttgcaatgttgcattcagacataatgagtaagggaaattatcagtattatgtcatttgaatgtttgacgtttacaactcaaaaacttaagaggttctcttaaaagtgactgactagcaaatacaaccttaaaaagataaatatttaagttttttaaactggaaattacaattccgtttttaatcttagctctatggtttagttgatgtagacttccatttgctgattaatttataaagtaaaagtcacttaatgagagcatatctttgattaatgcgtacattgttaaaatattatctacttacaaaaaaggacttaccaagtactgttaaaggaaagataaatgttttacaagccatatgttgaaaataagagaaaaatttgggggcttggaacagaataacaaagtgttcagttttacagaatgtcttcatatatttttctgtgtgtgaagagagagagaattccatcatgataaatactgaacattaaagtcaattaagtcatttgtatggggaacattaaaaatgttaacacgtctttgtcctttatgtggttgcatattgattatgtgacttgtaagaaacatgtagtgatagttggaaagacaagctaagtacatgaacattaagtaatcgtgcaagattgaaacaagacaagtttcaaaagatgtcacaaaggaatatataattatttaccaaaataatattgggcaataaatgtcataagttcagagtagattaagatactcatttggatgaatttgaggtttcatgaaatcgtgggaacgtgctttggatcttgaagaattataggatttgtttggaccaaagtaggaatgggcttcctaggtaggaagaatgtcttaaggaaatgtataaagatgggaatacacaagggagatttgggagaatctgattagatcaggttggttggagagggtggtttatataggataatgataaaagacacagctagaaaggcaagttgaagctagattatgaggttaaatgtttaacgtgcttataatgtggaaatgaattgcagtgcttgtcgaggttgatcaagtattcctttctagcaatccagcctagcagttaagaaacaaactctggaaccagattgctttggttctaattcttgctccactagttactttaaactcactgtaaattaatttcctcttagtaaaatgcaaaaaacaatagtagctactgtactgggttgttgtgagaactgaattaatgtgtgcaaagcactttgcaattgcttaacatgtaataagtggtatgtgaaaatgattattatataggttgaacaaaccaaagcagtaacttttttttatagtgattaagcattttcctgatagtaatatatctgacatatctctacaaataattgtctgttttgtgtgttgcagtgtttgggaaatgggaagtaatgacagctggcacctgaactaagtacttttataggcaacaccattccagaaattcaggatgaatggggatatgccccatgtccccattactactcttgcggggattgctagtctcacagaccgtaagtttggttaatttatctaatttaagttctactgtgtgttaacaataatttttacagtgactgttctaaaaattattataggttctttaaaacacatttacagaaatagcaactgaaactgccctttaaagaaaaaaaaaattgatagcctaatttatctaacttcttagtgatgtttattttggttgtcatgttcagtaatctgttggagcttgttggaggtatcagcagcctattttactctaaggacttaagaattttaaagaacattgccagtcttttgagatttatttaatgtaactcaatttttcagagatttattcttttgttaggcatttgtaactataattcttagtccttgaataatgatacaaaaagctacctacaattttagttactgtgtcatcctacctgaataaataaaaggaaaaagatatgagagggaagggtagaaagtgagaggatggcatacttttctttggatagcattatgcaagatttgggacttcataataagggagctaggagaaagtatcttcaagaaatgtttttgtccatgttcagtatcctccaaatacaacttttctggcttttgttttgttttgtgaatttccagttggttttagtggggtaaaatagataacagcctgttagctttgagcttaggaaataagcgtaactagtttatgaggtctaaattaacaggagagtgctgtaggtgattgggtcagcattactcaggtaagaaaactttttgaaactggcattagtttttattatcactttgttgtaggtaaggcataaataggagttcaaaatcagatatactgtcaggaatttctttttggtttttctccccatgatctttgctatacctaaatattttgtctttccaggaagccctgttcattaagtaataatttattttctgtgtttttattaatgagaatcctgttggtacctattgaggctgagcaccatgataattatactgtataggtgattagaaattaagccaaaaacaaagacacctgatattttagtgagctttcttaacctttagacaaatgaacaaatttgttaggtgaacagagattaaacggctgaatttaagctactataaaacatttatgttcttttgtttgctattagaagagaataagtaggagacaactaggaatttggaatttagaagaatattttaatattcttacagaattctatgctatgaatgctttcttgctaaagtgaggtatttatttgtatattcttaagcttttaaaaaacgttacttgtctactttatgaagagtcagatattgttatttgtttgtatgagcgtactattgattctgaaaaatcttataaacaagaacaaatgagattaatgaattgctacattggaagttagtttgtaaccatgcctttttcgctagtcatttgttaataaaatttaagaaatgaaaagcaaggatgaatataagggagctgaattttattcctagagactagtataatctattatggtccaagtgatgttttggaagttttgtagggttgattgaggtttgttaggaagaggaggaatgccttttaataatttgtcacattgatatttataacttacttttaatcccaaaatacagataagcactaaagagacttctatagtcactcaatttctaataatctgattttattccaaatagtcctgaaccagctgcctcttccatctcctttacctgctacaactacaaagagccttctctttaatgcacgaatagcagaagaggtgaactgccttttggcttgtagggatgacaatttggtttcacagcttgtccatagcctcaaccaggtatcaacagatcacatgtaagtatgatcaattttatatctactataagtgaaaagttttggccttactaagagaatccgtattcctggttttatttcagaaatttttagatacatagtttattttttaaaaatatccatatccgagggagaatatagtcttattgcaataatagattaatgagatttaagtaggcaatatttatttttagataataattctgacccatgtagctctatggatattttttcagctcttttgaacttatcttgggggatccatcatttgtgcagagatctggtcatgaaactatatccctgtctgggcgcggtggcttacacctgtaatcccagcactttgggaggccgaggcaggtggatcacgagatcaagagattgagaccatcctggccaacatggtgaaaccccatctctactaaaaatacaaaaaaaaaaaaaaaattagccaggcgtggtggcgggcgcctgtagtcccagctactcgggaggctgaggcaggagaatcacttgaacccgggaggcagaggttgcagtgagccgagatcacgccactgcactccagcctggcaacagagtaagactccgtctggggaaaaaaaaaattatttttcactgcaaaaccaatacatatttatacaaacaacacaaaaatgtgtaaaaagtaaaatctctcattcttatcccttcatattccaccacacaatgttactcatgtaacctcgcattctttatttttttaatttaaaaattcatcatgtaggggaatgaggataaacacattataatggagagatatctacattagatgcggtacatatttttggggcatttttaaagctgatgactctaaggtgagatacttactaaatggattttctaatggagaagctaagaaatgattggttaaaatcagaaagaagtataatactactaatattttgtcactccaaaaattcagcaatatctaaatcacttcttttttttttttttttttttttttttgagatggagtcttgctctgttgcccaggctggagtgcagtggtgcgatctcggctcactgcaacctccacctcctgggttcaagtgattgttctgtctcaacctcctgagtagctgggattacaggcccccaccaccatgcctggctaatttttgtatttttagtagagacaggttttcaccatattggccaggctggtctcaaattcccgacttcaggtgatccacccacctcggcctcccaaagtgctaggattataggtgtgagccactgtgcccagcctctaaatcacttcttatgcttgtacatacttattcagtagttttcaccaaatatttaaagatgtaaaggaaatagcacacgtaaaataaggacttattttatggagagctcctgtaagattgccctggaaatgtagtgagtcttatcattggacaccatctttataggtcttcatggttagatccaatgagtagaacattgacatgtataatataaagttaaaacactgcctatacttaattttatcatcatctcccatggttatgaatttaatttgctacttatattgaagtttattgaaaattgctgctgtgaagtgtattgaaatttgctgtttggtttccgcttttcccgcaccatgacattatttgagaaagcaatgtaagatggaaaaattacataacctctgggtcttgtcttaatcagtgtggcaacagtatcttatttgtaagacattcccagaaagtcagactcactcatattcaggtgtaagaaaatatattccaataccaaatatcaactttttgtgtaactttcacttgtctacccttccattattttgaatagtttagaatagaatgtatttcttttctattttagaactacttggaaattattaaactcatagttcaataaaatagtgttttgggctttttttctcttgactgtgtaaagtaaaatgaagaaaaagattgtccttagaagaatccctctctgttatttttgataattatatttctcccagggatagcatatttgaaaattcataactgttgggtcagccacagtggctcacacctgtaatcccagcactttgggaggccgaggcgggcagaccatctgaggtcaggagttagagaccagcctggccaacatggtgaaaccctgtctctactaaaaatacaaaaattagctgggcgtggtggcaggcacctgtaatcccagctactcgggaggctgaggcaagagaatcacttgaacctgggagacggaggttgcagtgagctgagattgtaccattgcactccagcctgggggacaagagtgagacttcgtctcaaaaaaaaaaaaaaaaaattcatattgttggccataccagtgtgatttacttttatatgataagtcttcttaagaatcagtcaccattttaatttttgatacttattttctcaatgccagagagttgaaagataaccttggcagtgatgacccagaaggtgacataccagtcttgttgcaggccgtcctggcaaggagtcctaatgttttcagggagaaaagcatgcagaacagatatgtacaaagtggtgagtttcttaataactgaattcccatatcaaacttgttttatacatatttaaatccaggtgtcttctttaacaagctggcctatcaggaatgcgatgtttatgccttcagtcaagccaagaacaagaaggaaactaaactgataagattcttgtagtttaatatgtaactaaattccttgagaattagacaaagctttaagtgtattttgttaaatatgttggaatatatcagtttactcagcttaaaaatttttttgttttagaaaatcagaattaatttgaaataagtctttcattaattaaataaatatttgcaaagcttttgaacatgtacattgtagcaggtatatagagttttaatactgattgtgattatattcatggttttctagtaattgatttaatactcctgttgccttagcaacagaaaaattggttaagtattattattaaagaaaaattgattcatggtattataaaataataaaaatattacatccaacacagatataatttttatgtagtcatggagtacctttgggttaagagcattgttctgttcaagcttactgaatttgacaagcccaagtgcctgtttggctctcaagattaaaatagggcaggaatagcttggacaacttcagaaagttcaactttgttaattaaataattgtatttaagaattttatcagccgggcatggtgactcacgcctgtaatcccagcacttttggaagctgaggcaggtggattgcctcaggccaggagttaagaccagcctgggcaacatggtgaaaacctgtctctacaaaaaaatacaacaactagccaggcattatggtgtgcgcctgtagtcccagctacttgggaggttgaagtgggaagatcgcttgagctcaggaggtcaaggctgcagtgagctgagattgcaccactgccttccagcctgggcgacagagcgagaccctgtctccaaacaaaaagaaaaaataaataaaataattttgccaaattcattttggttttggtttactttgttggcagcacttccatgatgcttcccattctgtttcctttaaataatattgctttgctgattctgtgtacttgtgttgtttgaatggtattttgaaagcaattgcatagttactattgattcctcaaaatgcataatggggatgcttctgaccgacttgccttttagcaagttgaaggtaggtatgcacgacagggctctgacttcaccagaactaataagttagattgcaatagtaggagacagatataaataatgaaggaagctagagttatgacggctttctggaaaaatgttggaattgaaagaaaatgtggaaagagagttgagtggaagaaagactaatagagtaggagtattagttttatgagaatgtgagtaaatctaatattggataaatgaatctaaggctactaatactacatttttgcaacttacatttttgagtatttgggtagtaaatcactctgataaaaacttttagagtgttcacctctcagtcacatattttgtgttttatactacatatacttgttttttagtccaaaatattgtttgatttctgtataccctactttgtaaaagcataaactagcatttaaaattaatcaattaattgcatgttatttttttttttaaagcattttcctggtgatatatggctttgaaattttaaaagttggctgggcgtggtggctcacgcctgtaatcctggcacttgggaggccaaggtaggaggattgcttgagcccaggagttcaagaccagcctgggcaatgcagagagaccctgtctcattgaaaaataaaaaataaaaataaaatagaaatttaaaaagttgattttggggttggtaagtttaaatatgagtcatgcatgtggagaaaattgtaataaaatgcaaatcactttaatcatagttctttggaacttagaattaattgaaaaggactgttagaatttcatttacccgttttatttagaaagccattgctttcaaactagtaattccagtttgtcccagtgatggctgttaattcaggggggaaaagctttttaactcctgtctcattgagtgttcatctccctccaaaagaaaaagaaaaaaaaaaaaacctccagcaacaataattatagtaattaagctattaaagctatggagcaaaacaattctgtgctgagtttgagttggaaaagaaaagtcagaagttgaaatttagactacatacttaagaaaacacccttcaatggtagacttagaggcgattttgaaacctaatttcattcagctacaatctcttttgtagtactcttagcaaatcaacttctgtttgaatatttctagtgaaagccactttttataacaacagcaggaaatgaaatttggaaatacaatttgatgcttgcagctgccaaaaaagagattggctatagaaatcataagaaaattcagggtgttatttgtagatttttatctgattttgaaatgtctaaataagtgaatttttctgtgtctcccatataatgaaatgtcatgtgaataattgagaaataatgtctagcttggaaataaatgtaagaaccagaatgctcttcacaggtttttattttttaataaaatattccgttaatccctactatgtgacaaagagttattgtgaaagaaggaataggtacattctgttttgcttcagaagacattcaggtggaaattgcaggaattcaaactttcggcccataaataaagtacttttcaaaacctgtgtctgaaccatgataatacaaatagctttgtgaaattaagttcccaagcatgagagatgtatatgataaaatattcatgtaataaaaactaccctgagtcccgttgtagaaggaagtgtattgtgttaggtgcgaggttagataagacaacttttaaaaaaatcttttcaattctaaggctaaataatagaatattgagtaagcaagtaaatttttttaaaatattataatctctgtttctagtcctggattagttttatggaaaatggtgttgtaataaaattgttcttgaaatttacagttttacagcgtctatattttgctctttgaaatgaaaacattgatcaaaaaaatctctggaatgtttgaaagaataactgatttcagttatttaaaggacactttactgttagaagaaaataacgttctgtatttttgtgttttgcataggaatgatgatgtctcagtataaactttctcagaattccatgcacagtagtcctgcatcttccaattatcaacaaaccactatctcacatagcccctccaggtaatatatgtatatatcgtttattaaatattgtcttgtatggtgaatatgctggtgaatatatggttcatacatttaggtaatggtggattatttagagtttaaatagttgaaatacttaaatagtaatccactttgcatttgccttaaaatgttgtatatggaaatagtctgatatgctaattgaagtagctaccatcttagtaatgtaatttcatacagacaaaaaatgttaaaataactaatgtgtttgagataagaagatttacggagcatggctttaagtaccttaaacagattggtacttttatataagtaaacaaattacctgtttttaaaaacttttttattgtaactctttgattatgaattgtgaacaatttttgtatgttatttgactattttgcaagattcttctgtttgcatagattttacatatataaactaagagatcagaggactttgtgacagtcagatttcaaggaatagcgtgtttattttatttccttatatttttttatttgggttttgggttttagccggtttgtgccaccacagacaagctctgggaacagatttatgccacagcaaaatagcccagtgcctagtccatacgccccacaaagccctgcaggatacatgccatattcccatccttcaagttacacaacacatccacagatgcaacaaggtaagaaagttgtttgtaacttcactgggaatgtctaagtgctttaattccaagcaaatttgttttttaaaatataattattaaacacaaactaaaatactatactgtatacttgtcagtaaacctttttaaagatatggcttaaatcattaaaacaatgttacacttaccatttgaaaatttgtcattttaggaggtgaaaggagcagtgtcattttggctttttggattcagttattatataactaagtatatttaggtgtgaaattaagaagaactgcgtttttaaaaattgctccttcttcttacattagcactaagccaagggacaattacattttaattggtaaagtagatacagtcagcctttcacatacatggtttctgcatcatggattcaaccaaacacggagtgaaaatatttggaaaaaaaattgagtctgtagtgaacacgtacagacatgttttcttgtcgttattacataaacaatatagtatagcaactgtttacatagcacttacattgtataggcattgtaagtaatctagagatgatttaaagtactgtatagtgcatagggctatatgcaagtactatgcattttatatcagggacttttaagcatttgcagattttggtatccacagaaggtattggaaccaatccctcatggatactgagggatgactactatgaaaaatttactatactgtaataatttgtagtaaaaatttactgtagtacagtaaaggaaaattaatcttagatgcaaaaatttgagattaaattaccagttcttacttgattactagttcttaatgtcataatgttgatattatgatgtctttttaaggttatattgcctggagatatatttcatggttactaaataattgatttattattagtataaattgtatgttttaaagaaattttttaaagcagaaaagtgcaaaggataatataaaaaacatctttatttttgtcctccttaattaacagcaaattttaaaaacttgctttcagtcactagtttctacatgtgtattcttgtttattatgcatgaagttgaaactttattcattaataaacttattaatgtataaacttttaactttgtcatccatcaaaacagctaactctggtttcccaaaaccagattatgaaatattaggttgagcttttttacacacgaactcaaggagaaactgggaagcaaatttgacacatttgaaatagacacagccaggtgtggtggtatgcacttgtaatcccagcactgtaggaggctggggcagaggaatcatttgagcccaggagctcaagaccagcctgcgcaacatagtgggaccctgtctctacaaaaaaaaaaaaaattagccaggcatggtggcatttacttgtagtcccagctactcaggaggatggcttgaacccagaaggtcaagactgcagtgagtcatgatcacaccattgcagtccagcctgggtgacagattgagacctatctcaaagaaaagaaatagacacttagaaaattactgaattgagtgtgagtgccaaacatacatatctatgtgtatatgtagattcttaatatatgtaaaatactattatactcaagtacacaaaagtctgagggacattttacatgtaatggaggaaaaatgtcaaaagagcacatccatatacacatgaatgtgtgtaaaacagaatgtaaattttatctctaagaaatgtgatgtgttttcacaaaattaacttaggtttttaatgtagtttgaggacctattcagtattgtgtcatttcttagaaatgctcagataaagaactaaaaaccatactcagggattagcctcacccagatattaaagttattctaaataaaaaaatttagtcagtactacccaaaacagtttctatattcaacgtaatccctatcaaaataccaatgacattcttcacataaacagaaaaaatttatatggaaccaaaaaagaccccaaatttccaaagcaatcctgaggaaaaagaaaaaagctggaggcatcacactacctgacttaaaaatacattacaaagctgtagtaaccaaatcagcttgatactagcataaaaacacatagaccaatcccagaatagagaatccagatataaatacagatatttacaggcaacttacttttgacaaaggcaccaagaacataaaatgaggaaaggacagtctcttcaataaataatgctgtgaaaaataaactcaaaatggattaaatacttaaatctgagacatgaaactactagaagaaaacattgaagaaacactccaggatgttggtctgtgcaaaatactttctgtttaagatttcaaaatataggcaaccaaaggaagaaatagacaaatgggattacgtcaagctaaaaagcttctgtacagcaaaagaaacaatcaacaaaatgaagagacaacctacagaatgggagaaaatatttgcaaactatctgtttgacaagtgattaataactagaatatcaggaatatataaggaactcaatagcaaaacaataacaacagaaactgattaaaagccaaaagatgtgagtagacattctcaaatgaagacatcaatggccagcagatacagcaaaaaatgccgaacatcactcatcatcagagaaatacaaacaaaaagcacagtgaaatattatcttgccttaattaaaatggcctttttcaaaaagacaggtaatagtgaatactggtgaggatgtgaagaaaagggaatcctcatatactgttggtgggaatgtaaattagtacagcctttatggaacactgtatggtggtttctcagaatactaaaaatagagctgctgtatgatccagcaattccactagtaggtatgtatccaaaagaaagggaatcagtatactgaagagatgcacgcccatgtttattgcagtactattcacaaaatagccaaaatatggaatcaacctaagtcccccatcagtggatgaatagagaaaaggtgtatgtatacacaatggaatattactcagccataaaaaagaataaagtcctgtcattttcagcaacatagagggaactagaggtcattatgttaagtgaaataagcaaaacacagacaaatattatatgttctcactcatatgtggcaattaaagtggattttaagaagatagagaatagattggtggttaccagaggctgggaagggtagaggagggaggtgttgaagagagcttgattaatggggacaaatatactgtctgataggagaaataacacacagtgtttaatagctcagtagggtgactgtagttgacagcaatctattttatatttcaaaatagctggaagaagataatttgaatgtttttaccatacagaaaagacaaatattaaggtggtggatatctgaattacactgatgcaatctttacaaattatatgaatgtatttatcacatgtatcccagaaatacgtgcctctattatctgtcaataataaaacataattttatttgaaaaagaaaaaagtctggcagggaaaaagtggataggtcagtaggacagagagaatgcagacgtgagacagtttagactattgagaaaggttgcattttttttcaactttatattacaaaaatttaaccatgcagaaaagttctaagattagcacaatgaaccccttcaccaacaggtatcctgccactttgtccttaagtacatctgctaagaatattctcctatataaaaaattaaggtcagttctgtggtatcatctaatatccagaatacatttgacttttaccaatccagttgtcctaaatatatttttaatatcttttcaaagcatgttcaaatctagcttttcacacattgcatttgatttttacatctcttatggaggctcttttaatctaaagcaatcttacacctttttcaccccatgacactaatttttggtttttgaagagtttggctacttttgttgtagaatatttcatattctaaactccactcttttctgctggtgttgtttaatttgttttctgtatttcctatcaagtagaaattagctttaaggttttactagtttccagttacacatttttggcaagagtacttggtaagcagtgttgtgcactttacattgtatcttatcattatcataaaatggtctcagtatcagtggtgtttaggtggtgaacctctctttattgtaaaagtacatatttttccctttgcaattagtaaataatctgtgggatgatactttgagatcatgtaaatatacaatttcccattaatcttttacttaaagggggtagcattcagtgaatctcattttatcagtttttacaaagtcattggaaaaacgatgattttttaaaattttatcattctaaagattacattttaaaatcagcatataagaatggattgtttaataaatgatgttggtgattgtctaggtattttgcaattttagctggattcctggatcactgaaagcaaaagtgttctagattaataagctgtttgtattttttaagtcataaaattataagaaaaacgtgggcgaatttttggtattctaagagttgagaaggcattatttctaagcagaccgaaaacctcgattgtagaaatgagaaaaaaagattaattataaatttgtatataagagaacataaatatataaattacataaatataaaacaaatatgggggatatatgcaacatttattataaacacaaagtattgatttaatataccgaaatctcatacagatcgataagaacaagacaaaaatgaactaaagaagtaaacaggcaatttactggaaaagaatagccaagtcgatacagaaagatttaataaatatatgaaattgtggtcaccttagctcatagagatgcattcaaaattaagatgaaataaaattttatatcagattgataaacatttcagtcttcatagtgatataaattggtgcaacttttttagagaaccgtgtgtttgacagtatctatcatataatttaaaattcatatacctcactcagtagtccaaaatctacctcccttaaaagaaggggaaagggataaaaacatactcagactgttctaacaagttctaccaaacattaaatgaagagatatgctaatcttaatccattccagaaaaaagaaaaacagcaacactttcttaactctttttataaagttaaattacaatctggataccaaaatcaggtgaagtgaggggagtatgagaaaggaaaattataaatcagtcatcacatatgaacattcatgtcctgttcccgaattgaaacaaaatgtttctaattttttctaccactaggtaagattaaatcaatctctttttcttttttccatacagatggggtcttgctgtattgcacaggctagactcaaactcctgggcttaagtgatccttaagccttaaggtgaaacaaattttttaaacaaatattaagaaaccaggccaggcatgattgctcactcttgtaatcctatcactttgggaggccagaacgggcagattgcttgaagcttaggaactcaagaccagcctgggcaacatggtgaaactccatctctctccacaaaaaattagccaggcaaggtggtgtgtgcctgtagtcccagctatttggaggctgaggtgggaggatggcttgagcctgggaggcagaggttgcagtgagctgagatcacgccactgcactctagcctggacaacagagtgagactctgtctcaaaaaaaaaaaaaaaacaaaaaacaaaaaacgaataagcagtgttatcaacctatatgacaaaattggatatatatatgaattgattagtagaagacaattaatataattcagattatgggcctggggtcctgtgagccttttaataggtctcaaaagagcattcagaaagattcaacttccattcatgacatttaaaacttttcactgaataaaaatacattaagcactttgggaggctgagactggtggatcacgaggtcagcagattgagaccatcctcgctaacacagtgaaacccgtgtgtactaaaaatacaaaaaaattagctaggcgtagtggcaggcgcctgtagtcccagctactccgaaggctgaggcaggagaatggggttagcctgggaggcggagcttgcagtgagccgagatcgcctgggcaactgagcaagactccgtctcaaaaaaaaaagaagaaaaatacattaagctgggtgtgatggtgcacatctgtagtcccagctactcaagtggccaaggcaggaggatcacttaagcccaggagtttaagtctagcctgtgcaatacagcaagaccccatctgtatggaaaaaaaaggagaagaggttgatttaatgttacctagtggtagaaaaaattagaaacattttgtttcaattcaggaacaggccatgaatgcctataatgacatttatttagtgggtgtcccagccaatacaggaagataagaagcgttaaactatgtataattattggtaaggaagaaaaaagtgtcattttcaggtgacataattgtcttcatagaaaatccaagataagctacagacaagatactagaattaataaaagcattccacttagttactggacacagcatcattataatgaaatcaattgcatttttatatacagaaataagcagttataatcttttttgatagcattaacagtttaaaagagcaccacaagatacctaggaataaatttaatgaaagatgtaaaagacttttgtggagcaaattacaaaacttttgaaagagatagaagaaaagaaaatgaagagttatgccatcttcatggataggaagactcaatagggtaaagattattattacacccgtatctataaattcagtataacactgataaaaaatctcaaggaaggtttttgtggaatttaacctgcttctaaaaattcatatagaagttgttcaagaatagacaaaataataaggaatgaagtgtagcagctcagtctaacaacagtcaagatttattgtaatattggtgcagacatggaaaaataacatatagtgaagtagaacatgatgaagagcttaggaacatacccatggacaaatgtaaacttggtccatatggcattatatcttaatgggggaaagaatgatttctttaattaatgatgcagttgttcatatggaaacaagtaacattggatccctatctcacacttaaaaataagttttacatgggttaaagacctaactgaaaaaccaaaactgtaaggcttttagaagatacaggaggctgtctttttatgactttgtgtaaaggaggggatctgaatggccagtacacaagagaagatgcttggcttcactagtaatcaaggaaatccaaagtaaagtgactgtcagaaacatttcctacccttagaatgataaaaattattggcaaggatatagaacagtgggaactctcatacgctaccaatgaatacaaatggtcataagtaatctgttatttagtaaggttaaaatatgcatatctggcaatttcactcctaggtattggcacctagagctcttacacatttataaaaacagtccttatgtacaagaacatacattgcagcattgtttatggcagcaagcattttaagcgatttgaacatccacataagaatgaacaaataaatagtgtacatcatacagcagagtatgtgtaattatttaaaataaatgaatttacaccaggcacagtggctcacatctacctgtaatcccagtgctttgggaggctaaggcagaaggatcatttgaagccaggagtttgagagcagcctgggcaacatagcaagaccccatctctaccaaaaaaagaaaaagccagatgtggtggcagtttcctgtagtcctagctactcagaaggctaaggcaagaggatcacttgaacccaggagtttgaggttacagtgagctatgatcatgccagtgaactccagtctaggtaacagagctgtctgtaaaaaaaataaataaataaaagaatttaaaactatatatatatatatatataaaatctcagtataatattaaatggaaaaacaagttatataaggatagatacatatatcatctatataaaattataatgtaaaaacaacacaatgaattacttaggaatatattcatgcatagcaaaggtataaagataacacataggcagaataaactcagatcaaaatagtggttacctctagggagtaaaaggaaaggaatagaggagagaaataacagataaatggagatcttcaactatatttgtaatgttttagttcttttcaaaaatagattggaatctggcagagtgttaagatttgatgaaactagtcagtacatgagtatctgttatattattctctgtaatttctatatgcttaaaatatttgtgaataattactattctccaagaatgttaagaatcttttattaaacctttttttattcttattaatttcagcatcggtatcaagtcccattgttgcaggtggtttgagaaacatacatgataataaagtttctggtccgttgtctggcaattcagctaatcatcatgctgataatcctagacatggttcaagtgaggactacctacacatggtgcacaggctaagtagtgacgtatgtaatatattatcattaaggtgataaaatagttctaatatttgtcatataacctagtatttccatttcaaaatttgaatgatacctaccgtatatcattatactgggtactgagtacaacatggctcctgcacatacagagcttagtctagagcaggattggtcaagtgtgaccagtagcctgaaccacaaagtgagaatggtttttacatttataaagagttatttaaaaaaaaaaaaatgtgatagagactgtatgtggcccacagagcctaaaatatttattctctgttcctttataatgaaaagttggctgacccctgaccttgaggtttaggttcttaatgaaatatttcagttttaggttaatactgctcacactaaaatttttttttttttagataatgagcctgtatttattagtacttgactctttttccctctgatacttgtacaaagttttgtgtctgaaatttaatattgccttgatgttattaaaatattccacattctggaaatttgccttgttattgatttgattgtaatttatgtaagctgcatgtgtctaaggataacacagatgacaataaactctgccctcaagtcatttaccacctggtagagtattcatagctccttttgtagaaaaaagcaaacaaaaatggagcatactagtaatacaaattttcttattcattgccatgcttaggctgttgattcttttggatacaatttcaattcttctaagatataccaagaagaaaacaggaaagtgcagaagaattatgcttttgaattccaacactttacctgtcagtaatttatgtctcttattggttctcttttaagatttctataaagcctctcctgtcattcaaaagataaattgtatactctatttttaggatggagattcttcaacaatgaggaatgctgcatcttttcccttgagatctccacagccagtatgctcccctgctggaagtgaaggaactcctaaaggtactactgtaactaaaatttccttctgtatattttatatttgaagttgaataaagaactcagacttcctaaagcagatattaaaaagttattctgtatttttttttcattgtagaaaaaaaaataaacctgtacaagcaggtctggatcatgggatttaaatctgtccctattcattgattcatttatcttccacttacccagtaatctgttgatagtattctcggatacatccagtatccattctctttaataaatccagtggtcttttcaaaccacaacgttcttctcttaaacatttgaaaattttgatcagctttcctctttcctccaaaaagacttatttcatatgagcccatctgtttttctcccacttctttcattgatactttttttcttcattagctcctctccttattcttattcttctcaagatttctattattagaccttttatcactcattgtacttttttccctggccgttttattaagtttcattaacagcattgattattttcatgcataagactcctaaatcaatctttggctccagtcttgtctcccaagttctaattcttcatttccagacaaaacttccttcatacctagcggatatttccaattcatcttcaaaatggttttcactgttctttctaccatcccatctgtcttaatgctattccagtcctgaatcattgtaacttaaaaattttaagttatcataaagcctcttttcaactatttagtcatttatcaaatctaacctgttctgttaatttttaaatctctcacgtctacttttatctctgccttttaaaattcttttattccagatctaagttaaatgggtgatcttccatgggccctcccctaatctcctcaagctattagtttatattttttgtaagaacttttactactttatgcacacgaatttcagtttatctttgaattttcaaagaaccttgcatggtcttctatctgtaacagattcacaaaattgtgaatttaagtccaggtttgagccagtttttaaaatacttaaaattgtagtcaaatagctttaattatcagtttgttggaagagaaaactgtcttctactttttaaaattagcttataattaattttaacatagctggtaatatattctctcaagtaatgagaatttctaattatagccatctgaaacataaagatattttacctcgtatctgcttcatatggtaaagatctttttttcactgattgtgttcgtactatttatcaaggacatttttctttttttttttcaaaaattttttaaaaattttattttattttactttaagttctgggatacatgtgcagaatgtgcaggtttgttacataggtatacatgtgccatagtgatttgctgcacctatcaacccgtcatctaggttttttttctttctttcttttgagacagagtctcgcactgtcacccaggctggagtgcagtggcatgatctcggctcactgcaatctccacctcccgggttcaaacgattctcctgcctcagcctcctgagtagctgggattacaggcacatgccaccacgcccgggtgattttttttgtatttttagtagagacagggtttcaccatgttggtcaggctggtctcgaactcctgacctcgtgatctgcccgcctcggcctcccaaagtgctgggattacaggcgtgagccaccacaccaggcttgtcgtctaggttttaagccccgcctgcattatgtatttgtcctaatgctctcccacttcttgccccctaccctccaacaggccctggtgtgtgatattcccctccctgggtccatgtgttttcattgttcagctcccacttaagagtgagaacctgcggtgtttggttttctatcaaggacatttttcatagagtgaaagttgagctgttatgagccatttcaattctgtaaattgtatgaattttcagggataaaaacccggcttctgaaagagagaaaaacttccagagtaactatttgtaggttagatacatatcccacaagtgttgtcaaggtgagaagttatttagattgccggggaaagagaacagggagataggtgattgatctagataactagctttttttcttctgactcttgagattagatagataaatagtagatgaactttagatagaaatggaaaactttaaaacaaataacctcactaatatattattcaccaaaagcttgaacttctgtcatgaagttgttttctaactagttttgaagggtaagtgcattgtcagtctatcttgatttttagattaattattagaatttgaagtttgttctaaagtgtatataatttgccacatagaatttaaatacaaaggcataatggtatattacaattcagacttagacaaatcttgttttaaatcttcaggtttgttaactacataaccttgggcaaatttcttaacctctgtaggcttcatgttccatttctgaaaaattttaaagataatactcaagaatgttgtaaaaatcaagtgaattgatatgtaaagcacctttcacaactctgacacaaaatgttagactaacatttatagttaattgctcccatatcatctttatcacactagagtcaataaataaagttgtatgtttatatataacatttaaaatacattaaccttgctaactgaaagtccagatttatgtatcatggaaaaagactgaaagcttaattgaaggcagttctaggtttaagttctgtctgtaaaaaaacttttatcttgaccaatttttacaatttcttacaagtttttaaatattttatagtttagtgataagaaatgtatacattattcagatgcagttatactattatttctgaagcatatcaatgcactttttccttcatgtctgaaggagaatttttgtctgaaggcttattaactaggataatttttccatctgattatttttaacactttcctgtttcatataacattggttgatttaatggactctgggctcaatatattttattgggccttgaaatttactgaacttatttatttttctaataaaaagaggattagcaagctgaagagagtatgtgaatgatgttaagggagaaagagaagaccacataaaagtataaatcaatattttaccaccagtttttgaagtaagtaaaggctctagtaattgtaaattgaccacttgctttttgttatcatcccagtagtattcatgtaagatagtctctaggattaaattgttatttttgtgtaatttaacaaaagcgtacttattcttactttaatcaggatatatctgttttcccagatagtccatgaaagaacagagatggtcatacccaaaatatttgtgttgtatcatctttagaagcaatgaactttttacccctataaagctaaatatgtatactttataggcacaaaaatatagaaataatactggtctgaaaaattgaatactcatacttagattcaaacctagattttagattaactactagcaagctaaacaactgtgtgggacaagtttttaagctttcttttcatctttcgtaaataagtagcttggattatataatttcttatttttttctagtattactatattgtcacttattaatatttctatcacattgtaagaaaatgtgaaaccaccacaactgttacttctatcgaattatttttctaggctcaagaccacctttaatcctacaatctcagtctctaccttgttcatcacctcgagatgttccaccagatatcttgctagattctccagaaagaaaacaaaagaagcagaagaaaatgaaattaggcaaggatgaaaaagagcagagtgagaaagcggcaatgtatgatataattagttctccatccaaggactctactaaacttacattaagactttctcgtgtaaggtcttcagacatggaccagcaagaggatatgatttctggtgtggaaaatagcaatgtttcagaaaatgatattccttttaatgtgcagtacccaggacagacttcaaaaacacccattactccacaagatataaaccgcccactaaatgctgctcaatgtttgtcgcagcaagaacaaacagcattccttccagcaaatcaagtgcctgttttacaacagaacacttcagttgctgcaaaacaaccccagacttctgtggtacagaatcaacaacagatatcacaacagggacctatatatgatgaagtggaattggatgcattggctgaaattgagcgaatagagagagaatcagctattgaaagggagcgcttctcaaaagaagttcaagataaaggtaaaataatctcattattaccacttcatcatctgggcaaatatgtaattatagtgtcaaaaatttttttcacattacttttttcccgaatattttgtataatttatgtctactcaagtacatatttttattactaatactcataatgcagaagttaaattcgtaacaatttcatttattgtctgaaacaactatatgagatttggtaattctctactacaggtctgttactcattatgtactatatgattttacttatttgtgcttttctgctaaaatgaacattagcatttctatataacatgtatatttcacaagttacattaatattgttgtgcaccttcaaatttttttctgctaaaacaaggttaaccactgtagaattattttgaacaggtacacttaagaaaagctcatgtgtatgcttattaggcagttagatatttcacttggtttatgatcctactggcttaataatgtcaaatttttttagtaaacaaatcatggaaagagttaatattaaatagcaaaccttagaaattaagagtcttttggtggtaattacagtgaagtgttcccttttgtctgactagtatgttaggatggagtttcaagacatacctggtctatgagtttatgagctttccttgcgcttcataatcaaacaaaaataaattcatagtaagttcttagtaatttggtatacactgtatacaaaatttctttcatgttttaagagactgatgaatcagtgattcaaattagcaatataattgatgaatttgattgctatataaatgcatatacacatttgatcagaccaaaagcatgctttatgatttaattttatgattaaaatattttaggttgattttcagttcttatattttatttcttggtaatgataaaacttcttgatattgggtagagctgatttttatatatgatgtgttcagtgtttgacaggatcatgacaagataattgtgtttctatgctaagaaacatgctgaagattagtattatatttcctgtctgtcatgatggctcattttaatgttattgaaaaaaaatggactgtatttagtaattgttgtactacaatgtttgcaacatatgtaaatcagaaatagatgcaaataaagagattgctagaagtcttcattttactggctagggagctgggtttttttttctttgtctttttttttttttaatatagattcaggggatatatgtacaggggtttgttacgtgggtatattgtgtggtggtgagatttgggcttgtagtgaacccgtcacccaaatagtgatcatagtacccattagatagtttttcaaccttggcttcgtccctttttccccctttttgagtcccctgtgtctgttgtttctaactttatgtccgtgtgtacccattgttgaattcccacttataagtgagaacctgtagtgtttcattttctgtttctgcattatttcacttagggtagataatggcctcaaactgcatccatgttgctgcagaggacatgatttcattcttctttatgattgtgtaccacggtgtatatataccacattttgtttatccagtccactcctgatggacgcttaggttgattctgtaactttgctattgtaaatagtgctgtgataaacatatgagtgcaggtgtcttttttataaagtaatttttttccctatggatagaaacccagtagtgggattactaggtcaaatggtagttctattttttgttctttgagaaatctccatactgtttttcataagggttgaactaatttacattcccaccaacagtgtgtaagtgttcccttttctctgcagcctctgttattttttgactttttagtaatagccattctgactggtgtaagattgtatctcattgtggtttaatttgcatttctctgatgattaatgatattgagcattttttaaaatgtttgttggctgtgtgtacatcttcttttgagaagtgtctgttcatgtcttttgcccactttttagtgggttgtttttttcttgttgatttgagttctttatagattctcagtattagacctttgttggatgcatagtttgtaaatactttctctcattctctaggttgtctgtttactctgctatggtttcttttgctgtacagaaactctttagtttaattaagtcccatttgtcaatttttctttgtgttgtttttgctttttaggtcttagtcataaattctttaattaggacaatgtcccaaaagagttttttgcaggttttcttctaggatttttattgtttgaggtcttacagttacatatttaattcatcttgagttaatttttgtataggtgagaggcaggagtcccgtctcgttcttctgcttatggctagccagttttcccagcaccatttattgaatagcgtgtactttttccattgtttatttttgtcaactttgttggagatcagttgtttttaggtatgtggctttatttctgggttctctatcctgttccattgatctgtgtgcctatttttataccagtaccatgctgttttgcttactctagtcttgcagtgtagtttgaagtttcctaatatgatgccaccagctttattctttttgctgaggattgctttggctattcaggttctttgttggttttatataaattttaggatagtttttccagttctttgaaaaattacgttggtagtttgataggaatagtgttgaatctgtagattactttgggcagtatagtcagttttaacaatattgattcttcctatccatgaccatggaatgtttttgatttgtttgtgttatctatgatttattttatcagtgttttgtagttgtccttgtaaagctcttgcaactccttgtttaaatgtattcctaggtattttattttgtgtgtgtggctattgtaaatgagattgagttcttgatttggttctcagctcgaacgttattggtgtatagacatgctactgattttggtacaattattttgtatcctaaagctttattgaagttatcaggtctatgaatcttttggaggaatttttagggttttctaagtatgggatcatgtcatcagtgaacagagataatttgacttcctcttttcctatttggatgcctaatattcctttgtcctgcctgattgctctgggtaggacttctggaatttttttttaaactggtaaagttttgatattaagggtgaaatgttgcttgtacctcttctctttagtttgcagtatgaggttcaggaaataaatatataggttccaaattatatctcttcctctaacctgttataaaagtatacgcatatcaaatgaaaaaagtaatattactcagcttttcttattaacctgttcaaaattcctgaatcttaggatagccagttttgcaggaaacatacaatatcacaattccctgaccaagaaatattagttgccctgataactgaattttttgcatgacgttaaatctgtattatggaaaaatgtgttcttgaaaaagaatgtactttttaagtgaattttaatagatgttgatagtaacaaaaacagaggaggaatggtgaccttttttttatgtatcatgtttgttgaatccaaagtttctacttataaaaatggaattaaaataagggtcatatatagttctaattgcatattagcaaacttattttatactgcgaactttcctttggaaaaatagaacaaagtcaacagatacaacatactgttcttgtagaaacttgtatattttattttcaattatctaaatagttttttctgtaatctgtgatggcatagttaacagataactgaaaagttgaatgagcagagttgacattcaattttggtgaaaatacaggtatgcggtgataacctgaggattaaagtaggttttgctgatttcatattattgttgtcatttctaacttgtttcctgaaagccactttcctcttatttcgtggatttatagtcacgtatcacataatgatgtttcatttcacaccagactttatatacaatggtggtcccataaaaatataatattgtatatttactctaccttttttatgtttagatatgttttagatacacagatgcttaccattgtgttacagttgcctacagtattcagtatagtaacatgctgtacaggtttatagcctgggagcaataagctataccatatagcctaggtacatagtaggctatatcatctaggtttatgtgaatatactatatgatgttcacgtaacagagacacctcctaacaatgcatttcgcagaatgtatcctgttgttaagcaatacatgaaatacatgaccgcatttgaaaacttttggaacttagatgccacctaacccttttgatttgaacttggcatattgcattcagtttctgcattgtgtgatgggatggtatttgttatataagaagttaccttgagattttgagatgattaaaggtgtgtatattggtccaagggtgtaggtgaggtcataaataaaagcaaaattcttctgaagtggtggttttagagcccttaagagatgaaatacttccttgaaattaatttgtcccagttaccattatttttacttattaaagactaaatgttaaagtggacatttaatatattcaaacatttggcactgaggacttttttacaactgttgtattactactggtgatatggagcaggcaggactatttgtctggcctactagttgcactttaggatatgagtttgtttgccaatatattcgtttactgtgagagaaatattccactcaataaccagaaatcaaaaacactgtaccttataagtaagattagaaagttcaacaaatgtagaatatttgtggaattcaagtaaagggatagaataatcttaagaaatgttttacctaggctgtggtagaccctattgtacccttgttccgcagaagaaagacatttttctagccgctaggtatttatgtccctttgtcctgttctctcttctttgagcagttctgtatatacgttgataaggcaactttgtaacctaatattttataatattccaaaaggacccttttctcaatctttttgctcatacttttagtgtctctaattacataaattaattttaaaaggctattcatctttctttgcttctgggatgacctgtcattagatattaatacctttttcatgtgctgaaaatttctgctttcttttgtcaaagagggggttcctttgttcatctttgcctatttcatcttttcccaaggtccactttccatgttagcaagtataaggaatggctcagcttcactaatgtttttataatgttacaatattcttgcactatagcccttgttaaaagtcaatgattacctactgtcatttggaataagagaccgggattttggtacaaggaataggacaattagccactcagcctgtattgtggttgaggggtggtgtgttttcattttacataattggctaccatgtatacacaattattgtgctttctgctttaagtgttttcatttatcacttgtagatttaagtaagtggtatagtttgtttttcttgtaagcgtaattgagtttagaatttctgtaagggctgcatcttattttgagaatatcagcatctggatgacaagtgttggttttgagattatgataatccttttgtatgcattttctttaggaatatatgtattctgatagctaatcttatggttcccagtgctgaagagggcttacaggtaatcactgtcctaaataccaaaatgattcttcatagagatggctttccatgattattaggtggttatgatgtaatgaagactcataacaaaagtgggtggacaaaagtgacctgtacagattcagagctgctttataaggagtaagttcatggtggaattgaatcagaccaagtgaatcagaacatacatgctcttgacatacctaagaatccttgtcacagtaatgaaaattttccaggttttacaggagtaaagtacttttcagtagttgaacgattaaaattttgtatttaacagcattttgtatatactgaaaaacaatggtaagatgtttcccaatcttaattacttgtgtgcaaatactttcatacattttttattataaataatcataggattcatagtttaaataaaatatatcatttctttgaaattaacttactgtatttgctaaattttcattttaatgtctttacgtaaattggattgaggttaataatatataaactcttgagtattttgtaatcctttaaaaatcagccctctaagctatgttaatgtttttctgaagactgtgcataaaagagtcagccatagatatcttaaatcttcagatgcctgagacctatgtcgttgtgtatcttaagtatgattgattagtctaccattttaattatttttacaaagcatatttcctcaaaaatatagaaatcttaggttatattttttgaatttctagagtcttataaaagtttaagggataagcataaattgataaagcatcttattcatgagatatcaattggtttgccctgtggcagaacataaagatgatttttgaatggcagaacattctaaaagaggattctataaacataaatttagtattctgatttcttttttaaggtattgatgtagaaaacttcctataaattcttaccatgttagttttaactggtggaaacaatctaatgataatatattatactttagaattaaaatggtagtgttttgcaaatggagcatgtgtggtgatagatttgactggacaactgaaggagcagaaggacttagttttacaaaatataactaacaaatatcttaagtaaattgcggttatatttgattagattttaaactggcaagaactgctacttcccactttaaaaagaaaacagtggaactttgctatatagaagaagcattaccattaggaaaaaaaaatcacaacttggttctctaacaataaggagccatttttcagttgtcagtttgacttttaaccttgtgataccatcttccttatatgatatatcacattagtgaatattgcaagagaatctagagattgccttgttaaaataaataacagtgacttttaaaacatactcaagcaattcagcaaataaacaaaaggaagccaaacctcaaggtgctataatgtaaccattcccaagacctaactggagatttaatttatagaaaatgactagctccctcttaagtcagaaatggaatcatacacagaaatatatagatgttaaaaataccttcacattttattgtaatggtgaatttgtgtttgtgtgtgtgtttgtctttacatttcataatactgtaaattatttctttctgagaccagaatggatcccagaacattataactttatatcgaagagtaggaactgtttccttcagtggaagttgcttaagacaggattctaatttatacctattgctccctgattttaaattttctatacctatgaaatctgttgcttccttattttaaatttacttctatctaacattgtggttaacttttaaactcctttcacacttttaacacttcaaagaatttgaattattgattaaagttaaatgacaaattattaaattctttttttaaattcattttttcccaatggcatggtatatattttctttcttttttttccatacttatcttagatacagtaaaaacttatatttcctgtttggtatattggcagatttggagctctttatggtttttggctaacagttaaaagtaacctgagtgagactttatgatttgtaactggttgctttattattaggaaaagaatctgatttatccgtgacatctatgaacataaatatatgtttgtatttggtacattataagttctattcattttatattcttacacttatttatatccttaaagagtatgcagttaaattctttttactatatttattgagatctctcaagcatatttcttcaaaccttacctttcaaagtattgtgtcattcatgcttactattttatgtgtacatatttgcatttgcattttactccattttaaaaacataaccttaaaaagataaacaacgtccatagggtttttaataagataagaatacatgtctattactgatattgatatttatctttaaatttcagataagcctttgaaaaaaagaaaacaagattcttacccacaggaggctgggggtgctacaggaggtaatagaccagcttctcaggagacgggttctacgggaaatgggtcaaggccagcattaatggttagcattgatcttcatcaggcaggaagagtggactctcaggcttctataactcaggattcagactccataaaaaagcctgaagaaatcaaacaatgtaatgatgcacctgtttctgttcttcaggaagatattgttggaagtcttaaatctacaccagaaaaccatcctgagacacctaaaaaaaagtctgatcctgagctttcaaagagtgaaatgaaacaaagtgaaagtagattagcagaatctaaaccaaatgaaaaccgattggtggagacaaaatcaagtgaaaataagttagaaactaaagttgagacccaaacagaagaacttaaacagaatgagagcagaacaactgaatgcaaacaaaacgagagcaccatagttgagcctaaacaaaatgaaaatagactgtctgacacaaaaccaaatgacaacaaacaaaataatggcagatcagaaacaacaaaatcaaggcctgaaaccccaaagcaaaagggtgaaagccggcctgagactccaaaacaaaagagtgatgggcatcctgaaaccccaaaacagaagggtgatggaaggcctgaaactccaaagcaaaaaggtgagagccgccctgaaactccaaagcaaaaaaatgaagggcgacctgaaacaccaaaacacaggcatgacaataggagggattctggaaagccatctacagagaaaaaacctgaagtgtctaaacataaacaagatactaaatctgactcacctcggttaaaatcagaacgagctgaagccttaaagcagagacctgatgggcgatctgtttctgagtcactaagacgtgaccatgataataaacaaaaatcagatgacaggggtgaatcagagcgacatcgaggggatcagtctagggttcgaagaccagaaacattgagatcctctagtagaaatgaacatggcattaaatctgatagttcaaaaactgataaactagaacgaaaacacaggcatgaatcaggggactcaagggaaagaccatcttctggggaacaaaaatcaagacctgacagtcctcgtgttaaacaaggagattctaataaatcaagatctgataaacttggttttaaatcaccaactagtaaagatgacaaaaggacagagggtaacaagagtaaagtagacactaataaagcacaccctgacaataaggcagaatttccaagttatttgttggggggcaggtctggtgcgttgaaaaattttgtcattccgaaaatcaagagggataaagatggcaatgttactcaggagacaaagaaaatggaaatgaaaggagagccgaaagacaaagtagaaaaaataggattagttgaagatctaaataaaggagctaagcctgtagttgtgctacaaaaactgtctttggatgatgttcagaaacttattaaagatagagaggacaaatcaagaagttcccttaaacctatcaagaataaaccatcaaagtcaaataaaggtaagaatacttctactgatgtcatttataatataatcgattttaagtgttaagattactaagttttaaaaaggaaatttacaaaaattagaaagctactacatgaaaatataacatttatgtcaaacaacaggaaatttttttcaggagtatagataaaaagtttccagtgaatttttttttccccacagtttttttcttcccacccactactcaaggtagttatgaatgttactgctatttggttacacagagataagttattttgctgtttagttatttcttatatttctgaaatatgcttaagtgaatgttgtattaaaatagctgtctttaaaaactctctatttaaaaatgtcttacaatactacattcttacagacctgtgtctgagccaattattgatgaataatttgtatagtttagaaagttatataaaaggttatttttcattttgttggggagatggttagttaaatatgttttatatttttaaaacatatctttttgtccttgtttatgcaaaggtaatagggaatggtacttactttttaaatttggttaaattgtaagtttgtgggaggcgggggactggtgttatttttgcatggtttctgaattctctggttacttgagtaaaattatttccaaagggagaagaatgtcttaagtgccaaaagataatggccatttgtgcagaagatatacttctgtatccctttgtacacaagtatttaaaataactttttttatttttaaatagagatggggtcttgctttgttgaccaggctggtttcgaactcctggcctcaagtgatcctctcctctcagcctcccaaagtgctgggattacaggcgtgagccaccgtgtccatacagtctaaatatactgaggtgtagtgaaggcaatagaactgagagtttatttaagttttccttctgtgaaagagaattattaagaatttagatttatacttatatataaccaagtatatgaaatctggaattgcattggccaagagggtaaccattgccttttttggctatttaaatttaagttaactaaaattggaagttcatttcattagtagtcacatgtggctgttggctaccatattggacaaaacagaacatttgcatcatcacaaagttgtatagcactgcagtgtattaggagatacaaaaagtgtgtggttattgtttttcataacatgctgttgtagcttgtctaccaagaaagctctttgaaaacatattataaagaactctttattcaaagaatgacttgtggctaatctgttgttattcttgcttggtcttcgtcaacattcattttttcactgttaatttatttccttttgtcttacaataatgaaaaaagattgccttctgagtcgctaatatttgtgttctttgagtgaagcttttaaattttaaattatggcaattagacttaccaaaagtcagttaagacatcagccttaattaataagtaggcttttttatttaacttgaatgcatcttttcagagttacttgttaatataaaagaggttgtagaatgtgggggttaacaccacaattgttttcttttaggtaaaaattttctttaaaattttttagtgaaagtttgggagtagcttatatttataaactaaagagtatggctatacaattttagaagagtcaggtgaaagatggaaagtggtaccctcttgttcctttgatctggaccatctttctctccctcccctctcagcttaccctagccttgctttctaaactctgttctaacaaagagtcttttaaaactccttaaagaacatccagaagtgaatatagcttttagttagtaattggtatattatttcacctgggtttttcacatgcaataatattgcctatgaatatgtttttagcaccaaaatgcgtttctgatagtatacttttaatgcagatgtatatacctgatatggtcatgttagtatgtaagtaagctatctgggtgtctgcctattagagtgatgtgtgtgtatgtgtacatgtgcatgtttgtgtatatatacacatatattaatgtaactgcaattacagtaacagtccttttcatcaaaaaatactatgtcagtgcttagatgcatttcaggatgccgtgtagctatcttttggattaatttatttatgtcttaggatccatatcttttttttttagtaatgatccaattttggttttgttttagatttttgctactcagtttaaatagcagagttgggtaattgtggattttttaaaattgcatgtatatgaagcacagttgtagattactgaccctttgtagtatatactgggattttctttggagattcacagaaaatcacattttgatgtgttgatgattttctgagtaaaggagttagtctgaatactgctgggatacttgtatggttggttcctagggccaaaattgaagagccataaatttccatcttttaaatattttacctgatgttcatatagaaaatattcattctttaggatatattttaagctgataaattttgattgtgtgatagaggtatagatttattactcctaatttagattacttatttttgtcttttgtatgagcatgataaatgtaaagtggcattgttacatttgatttgatttctgtggcactatatctgtatccctagtacctaacaaaatacttcatacataataaatcatatttaatgcctattgaatggagatgatgttgccaccattttcaggaaaagcttttgtgtacagattaaaattagataatcgtcttttatgttcccatcaatacaccctagctcaagagctacttatttttcaaatcctgcttcctaaacattgttaataactcttcaccctgtcaactacctagtttttttgttaagatccaaagaaaacctgcttatagtaatatgtgtttaatttttctgtcacacttattttgatctatactgggattaatattattcccattcttatcctgcattgttaacttccctatctttccatcaccatgtttattccttgcctgggaggggtggagggggcagtcaggcagtgtaactgtttgtagaattctttttaagttcttcaaatatcttctactaaaatatacttcaatcagtatgttacatgccaaaaaatatgttgttaaaaattttattagactattaccctaatgtatagtgtctctaaattaaaataataaagttatgagatcctttaagattggcataatctcccagcattttgggaggccaaggtgggtggatcatttgaggtcaagagttagagaccagcctggccaacatggtgaaaccccacctctactaaaaatacaaaaattagttaggcactgtggcaggcacttggtagccccagctactcaggaggctgaagcaggagaatcgcttgaacccaggaggaggagattacagtgagctgagattgtgccactgcactccagcctgggtgacagagcgagactctgtctccaaaaaaaaaaaaaaaaaaaaaaaattggcataatcatcaactaacacatgccttcagtgttattaacagcttattatcagtaattacaaacatatttgattttgttgtttttttttttaactccagagtgtctcaaaatatctttgctttatgtctaaggaaaccattttttcttctctctccccctacttctttccaactagtatatcattctccattgtgtggactcagtgctttcaagaaatatccgtattatttgttatttgacatcatcctttaaactgaagagtaaagcagtttctgaaagtagtcttcactgggaatgtatctagcagctttaatagtcaatagcgattagcctatattgctcacttgatgagctaatgattgcaggccttactagcgacagtgatcgcacttcagttatctactgttacagttacactactaaatgctgataactatcatcagctggttgccttttacttagcactgaaccagtctagttagatggtgtttaggatcctcagcttctgcaagtctgaaagtattgtttctgagagtgaatttatagcacagtttattaattcctaaatgaggaattttcggtgttttctttaaagtagattgtaatattgaataatatttaatgatgcagtggaaatttattttgtttcatttgtacagttttataaaatacctttcttaaaaactcaaattttcagtttctgtaaagattgatatcagtgatatctttaggaaatgtttggagaaagtttattacagaagttggcataatctgtatctagctcttgtgactttagagcagtattttgaaaatttgtactcatgatttccatttgtagaaattttccaaagtatgcttaatagattgttcatacaaatattgcttaaaagaaatgcattaagtagaaacctttttataaaaactaaagtttgctggaggtattctctctcctttccattctgtctcttaagccagcccaaagacatagtttctatagggttcttgtgtctgtagaaataggtatatgatttaacagctaaggagctagcaaatattaattctgtaagaccctgtgcctatttatgaagaaataatctttgacatgctaaattcccttttatattctaaaaaaaaaaaatttaatgaaacccttctttacaagggcctgatgtgaaattaagagtatgaatacctactagtattacaccaccaataaaatgggttttttaatatggatctctctgtcttgcctataaaaatattagcgttttctggctgtaatgtatcaatttttaaaaattctcttttaaacttattacaaattatagtacaaagagaactaatatcaaaaccctgaataagccttaacctttcaaagcttggttcattcgcttttaaaataaagaaaccaatttccctcctactttatacagttataaagacaaaaatgaatgttgttatagtaaaagctaaagtatgtctgatttttttatataaaggaaagtacagtcattcaatttctaattgaattgaatttatctaatgaagaaagtaattttttaaaataaatctttttatgtatctgtactttatattcagtgtagatttaaagatattactgccacaatttatttttctcaccgtgtatacatatcaaggaaagaatcatttgatccctgccccctacttttctgtaatgagtagtaagttgttacttacataatgagtagtaaattgtcatttacatgcagtattgaaaatttttttttgcccccacttacctctaattgaagttgaagatccatttggtgcttctgtgttatatgggtaggttagtggaagaattgtcactgaactattccattatgcctgcccaagtttttttttttttttttttaggatttataaaatttggaggtttatgtgaggctcttagttttgtttctgaacgtgacttgtttccattgaccaaagcttcacttcagtcccaaagattttattagtttacgtgatttatttctatctcagagttgttttcctgttttaaaaagaaaacagaacacattgttagttatcaaatcaatgattcttttaagttttttgatgatttctggttttaataatctggcaagtgctaatttgagtgatttataatggaaatcaaagattgcttaaatgtagcatatctaggagtaaatgtattctttagccatattaaagccagagtatagagtgcactgtatctaatggaatatatgtacagaagctgaaaatttgatatctcacaaaattgtgactaaatgacattattcatcaagccagtaacataaagttttatgggaattcagacatgctgatttaaagaataaagtagttaggacaaaagaaattaggtgagagataatcataaagcactagtaatctgaagttttaggaacaaataacttggcaagcaacaataatccctaaaatcatcaatccctaaaatacatcatcatatactaagagatagcaagactttatgtttgcatttaatggattattaactaattcaggggaaataacataaccaattatgtcatacagataattttaagtacttgctgtttattcatttctgttaaactgagttagttatccagatcaggatccttttgtttttttaaagacagggtctcattctcttacccaggctgaagtacggtggtgctaatatagctcactgcaacctggaactcctgagctgaaatgatcctcccatctcagcctccaaatggctgagttatccagatccttgatgtcatattgaagatctcaggcctgaatatgggaaagtcatgcattttatttatttatttatttatttatttatttatttatttatttatttattgagatggagtctcgctgtgttgcccaggctggagtgcagtggcgtgatcttggctcactgcagactccgccttccgggctcatgccattctcctgcctcagcctcccgagtagctgggactacaggcacccgccaccatgcctggctaatttttgtatttttagtagagacggggtttcactgtgttagccaggatggtctcgatctcctgacctcgtgatccacccacctcggcctcccaaagtgctgggattacaggtgtgagccactacgcctggcccctttatttcttatctttgtaatcaagcaacctggcggagtccatttataaagagcttcatgaaatggaagaaaggatgtggttaattcagaaaatgtgtgaaacctgtggaatagacaattctgttcaaaatgaaacagcgttcacttttggaggatgatacatgtagagacattgattcctggattttttttctttaaagttggagcaccttcagaaataaaacatttggcctttgaattacattgtttaaactttcaaagttttacagaagttaaaatgatctagaggatactagagaggtcttaattgatagtattcttgttaatgtagggaataagaaagggtaaactactgttgataaatgttgatacctgctttattggatataaggcataggttatctgtgtttggctattgtgagtaatttttttaaaaagaaggagcagagtccttgctctgggaacataatccattgcagagagagcacaagaactagtacatattttaacctttgattattgtgttaattaacaaggaaaatattaattctgggatattagtgttgagtcagtgtgtctgtgatgtgaacttaatctaagcaaaacacttaggtacatttgctttaaaaaaaaaaatcccgtgatggatgaaaggccaaatactttgggttatctgtatttataaacctatgaagattataatgtttccaatatactgcaaaaaaaaaaatttgtattcttagaaattttggaaatgtactcatttgtctatcaaatacagcaactcaggaactatccaggaagtacatctgtaagtggacatgagaaattgtgaaccagagttaggcaatcaagaagcatctattgactatccatatatatgtactcaatattatgtaggtcatgtggaaaagggaagatgtatactctaaaacatgattttccatcaaaaagacacatattaaagtagagatattcaaagactttatagtgaggtgcagaacgtgttcagtttggggctgaaaatatgcaatgcaaagctaaagttgacttcttttacttctaccagtattctaaaaaagagggccctcactgataaaacttaactagttaaattaagaaagccaatacagagaaatattacctgatttcaaaatgacacagaagttaaactcaacgttagttagaattcttagcaatgaagtctttgggatattaccagtcatgagtatttcatgtttgttgggtaaaattgttcctatgcatgtccttagaagaacagaagcctaaaagttactgaaataactcctttgtgatactgaataaaagtttcagaagaataaaaaaagggttattctttcattaagattaatattttatatctccatcttgagttatttgattgtatcgtcttaatattcttgatagctatttacttttctgtcatgatttttattctttacgtaagcactattatcatttgcatgttataaaggatagtgttaatgttgattgtaagttactaatatttcctgctataaaccacaaaggtactctttgcttccaattcataaaatttatcaggtaagatttttctttttatacttccactcaaagtaagtaaaggaagctaaaattgccatctttagtaatcattaaggacaaattatccgaataagtagcttttgctacttctactttattttttaaactatcaggaagatagtcccagtttatttcttcataagaactatttgtgtatgtgtttgtgtgtatgtgtgtaggattaagtagtataatggctcttattgtcttgtcttcttttttattgccttgactcttgtgggaagatatgaacttgaatttctaacttgaaatgtacttttcagttacagacatttatattttaaaagatttgtcatctatttatcctgtgttacatgtttctctcgtcttcagttaaattgtatatattgatttgtctgtttgaagaagttctccgtaatgctaaaggcattaccatgccctcaaatagacagtaataggtaaaagcatatgtatagctcttgtctcagccaccatacacaactgccaagatcatagagaaggaggaggagtggtaagtgtcttccaacacttctcacttgtattgaggggtaacattagattcaaactacttcagacctacacaaaacaaaatttatgtactaccaagaatgtcaagtgtacctcttaccacaaatccacttgctaatgtcagtgaatctctagtttcagaaagtttttagtcagtgcaaattgaaggcattatatcaaaaatgtattatataattacccttcatttttatggtggtgtcatgtttttaaagtcattacataattatatgtatatatgtacacatacatatatattaactatattgtcactttagggttaagagtattatagttgtgttttattaaaataaacagttgatttagaaaacaaatactaatatttttattatgctaacttagttaaaattttccttttatcttcagatttacattttttttttaaatttacctttcattaataggtagtatagatcaatcagtgttaaaagaattaccccctgaactcctggcagaaattgagtccaccatgccactttgtgaacgtgtgaaaatgaacaaacgcaagcgtagcacagttaatgaaaagccaaaatatgctgaaatcagttcagatgaagataatgatagtgatgaagcttttgaatgtaagtatcacagaactctttgttattattttagagtttaaaagcaggttgatgtgtttttctcatttataatttgggggtttagcaaaagcacagtcaccttaattcttaataacacagtatagtaagtttttttctctatactttaaaaatgcgtgaaagatgagatcagttggcaccaagaaaaaaatattaaataagctacaattaattttaaaacacaggtaggtatgtgtctgtatgcattcagcaaacatttattgagctcctattatatgctagacactgagagtaaaaatgcaaataagatatggcccctgtcttcaaagagccttcagtctaatgggggaaatatgtaaataaataattgcagtatgctgataaaagtacaatgataacagtaaatccagggtgctatgggaacacattggattggcatcaaaatcagagtgggggctcagggaatgcttactggaagaggtgacacttgagttgagtcttgaaggacacgtaggagatagccagatgaagaaatatttaaaaccatactatcactaaattatgaatggattagccacattgcagattatctgtgtggtttggacctggcttctcctttttgcccagctgtgtcctggaattcctcccttgtttcactgttttccagagctggcttcttcactacacagctacctctctacaacactgtgatcacctgtctttgcactagacttgctatacctcgcctgtcttcctactggtccactgaaaaagttcttctcttttatccctatcttccttcttctggagcaagagaattgagcctagccaagaggggtcagcaaccttgtttgacttaaacggcattcagtggaaacagactatgggagatcttcacttgtgtgccaactgacttagtcataatgaccaaaagaagtgggaagaccaccagtgttctactttttccacctagtgtccatagattgaggtgtgacaagcaagggcaggaaggacagatgcatgctgccatttttaaatgtatattgctgatggaagcccttcacctcctccaaagtttttaatgttaatttactgatttttttttaattgtgagctcttgagctatgagcagtagactatgaatactgaacaaatctgaaaaaagttttaaaattgaaataaaatatacagcaaacttaacatttaatcatgtataattgttataattgtattatgaaatgtattgacacacagtatattaaaatggctaaagttaattttttttattacaatcagatattttggtcatatggggacgtggttagctctggaagatgagaagataaaagaaacatggggcccaggaactcattccctttaatatacatgccttaccactctgcctctttccctctaataaacatatcacccatatctagaacagccgagaaggaggagtccctgaattccagtttgatttcaaatgacatttcaaatccagttgactgaaagtgactgcctccattactaaattgcaaagatttctgaagctgtctcacagttaagtggaaaggataacataatcaaaaatttccaccaagtgtaaaatagtggagagtagagccacacatccctcatgtttgtcaccaatgcagccaccattcttttccccttgctttctatcatgaaagctattgtctcatcttatggaggcacatagcttcgttataaagccatggaccctgttatatctatgcccaactatatcgaaaggtaatatttattttaaagaacctaagcttcacacactgctagaagaaaggaaagtttctctggatttttaaagagatgtcaggagtagcttcctgtttttcttcacttatttctatacaagtaactatagaaaagtggacactggaggcaccgatttgaatggtgaaagaagtccaaatgattgttcacataaacaaccaaatggtcacaccacaacagaaacagtgtattgaaaatatagcacaatacaaaatgtgaaactattatgagaacgttaagttgcaagcattatgctgctgagagagagaaaaaaaaatttttgaaacttagcagtttaatcaaattggtttctcaaaatctaaaaccaaggaaatagttttgttgaaggttaggggaaaatgttgaaggataattttgaaagttggggtacacagatttggatggccatagcacaaatataaggtcactgggtgcctggggaaaatggagagaggggtgatgtaagaagctcaagagatacataggtgaaatttggaaagagaagatagagaacacccaagtcatgttttacgtacctctcttttgagtcctttcccctcccctgcttattccagggtaatgagagaaatggagaaagaataagctaaccacaatgagttggtatcctaataacctcattataacacaatgtgttatggaagttgttttttttttaatttgtcaccccatttttatctaaattgtctaaaatttgatgaatgtgaaataaagatttacaagatctgtggatagttaccaccaatacagcatattctatgtaattacaaaccactataagattcttcaagcattttctactcataggattgaatgcttgaaacagatttgttatgaaattaattaaaatgtacaaagactaaagcaggtcatattcaaggttgtaaaatactaatttctggcgcagtagctcatgcctgtaataccaacactttgggaggccgaggtgggaggattgtttgagcccaggagtttgagaccagcctgagcaacatagcaagaccccttctctgcccacataagaaaatagtgctttctgaagaagtttgcttattagttgtcatcccttgtaatgtaggcatttcagtacttgtgaaaaaaacatctaaggaattatatatagaaatgacctgtttctctgtcacacatacacacaccctacttatattagtgtatgaaacaagttgtcactaaaggaatgtactagagcatactgtaatcataaaagaggaacagtcctatcactcttcacatacgtcataaccaaattcatacctaattatgaagaaaatctcagatatttatatccatttacatttgtgctttacatgaacctttttgctatccaagcctgtgactgtaaagaagaggaaacaaaatgaccttttcctgccatgttgtccatagattagctagaagagtccagaaccagaaaccaacctagattcttgaacaggagtagttagggtagcatttaagaataagattagacagagtatagacatttattacccacacatgaagacactggcacaagcatagagtgcctgggccagaggttggcatccttacatctaagccaagtaggggacttaagcaaaacatttgtcttaagtatttgtgtatttatcatagttagggattcagaaaagagcagttgctagtcaaataacagactagaaagtttatcattgtcagcaacaagtgatcacaacaacaaccagtatatgatttcaaggtaggacacatcacttctctgccctggttttaacttggtggtacctactgcatcctagaacagacatggtaaatatttgtcacttatagtgccccccagctcttactgcagacatttctaatcagtctttcttgctgaactatgatgctttctcagggcttggggttattttcagcataatgttctaggcagctattgccagttgatgagagttgatgtgttagatgaaatctgtttgccaggtctgcctaaaggctcctgtcagtacgggtgattttagcagaatgctaaaatgatggggaaaagattgaaggtaacatacataatcatgcttatgaagcgtgcataagcttagaaacttttcttgggtttaagcaagacttttgttgaagaactgaattcattatgtgagtatttacaactgtacaggttttttctgtctcagtaggcttgtcatgttaggtcaccagggcttatggaatttatcgctgagttgtgggtttaacttagctattaattgatgatgtacatggttacccatattctgtaacactttctcaaaagttgacttttcctccaaaccctgctccccatcagtaatctaagtgctttaaggtggttctgtttttcatctaattcctaaatatagtttgttttacagcctcaattaatcttgaagtttaggtataacccttactgacttactgaataactgtccttgaagtgaacactgtagtttaatttcaagaaccttcctctctgtatttattagcagtaaacactgagttcatgtaaagatctttaaatctgggtagattgtgctaaaattagtgatactttttctatatcataacttaaacttctggatagacaaaatcactgaatttcctagaccctatggaatgaagatttttttccccatgtgattcatttgtaaagtacaagttttaatcatctttttaaatgaggtaaattatttgtcatggggatttgcttctagcctctaggaaacgacataaaaaagatgatgataaagcttgggaatatgaagagcgtgacagaagaagctctggggatcataggagaagtggccactctcatgaaggaagaaggagttcaggtggtggtcgttatcgaaaccgaagtccgtcagattctgacatggaagattattctcctcctcccagccttagtgagggtaattcatcagtgtcaacggatttcttacataaaccaatttaaatttagggctttaactttgaagaatattttatatctttttatgagttaataactaattttcaattaagacaaaaatacttagtttctatgtgcagtgattatcgtttaagtctttaacgttcaggaaaaaaactagaaacaaaaatggaattattttaagttgtcagtcctgcatttcagtacttctttttgttcgttttagttgctaggaaaatgaagaaaaaagaaaaacagaagaaaaggaaagcatatgaaccaaaactaacacctgaaggtaacacgttagtttatttaatttgtctttattcatattcttcagcttcacatgtctacttgtaatgtgagaataatgaatatatttttctctcttgcagaaatgatggactcttcaacttttaagagattcacagcctcaatagagaatattttggataatttggaagatatggattttactgcgtttggtaaaatcaacttaaaatacatttacacatactctaagtgtcttaactgtatcctctagagtaactcagttactctagtgatgtgtcctaccttgaaatcatatactggttgttgttgtgatcacttgttgctgacaatgataaactttctagtctgttatttgactagcaactgctcttttctgaatccctaactatgataaatacacaaatacttaaggcttaactcagttactctagaggatacagaggcatactctgtgctatcaagaaacttgaaatctagttgtaaagtcaaatctagtctgttaccaagaaattaaaaactttagtacaaaactcaagtatatattaatcaagtctggatagtatctaaagaatcatgagtaagtgagagtaatttaaaaagtctttatgcaggtgaggaggcttgaaaaggccctgtataatgaaggtactgataggagcatatatgcagaaataagcatctattcttctgttcatttattctaatgaccaatatttattgaatacttactgtatgccagtagtatgttaagtgctggagatgtaaaaataactaaaacccaaacacctggctttagggaatacagattctaatatggaaaacaaaatagtaaaccagttagaatacagtaggattaatgttatattcatgtattacttttacaatgacataaagattacatctataaatattaaaatgtttataaaaacactgcttgcaatgtatagagctattcttaacaatcttatgccaccttcagctggtaaagtaagtatttgttttgtgagaattacttgcctgagtatcattgtgtttgctgattatttagaatgtcagtttcatcttttttaaaactttacagttctgtgctgagaaattgtcttctgtatcatttagggtccaaaagtacaaagggcactctcaaaataggataatatgaggaggagttatttacaaagagaccagttaaaaagatggaggcaaaataataccagaacccagggttaacagccttaaaccaaaagagtgaggatacagaaaagtcaccagaactcattctgcaggaaaaaaagttgtagagtaggctgccttgaaagaagcaataccttttggtcaggggacagagccagcctgaggagaccttgtaagcaaagagtaagagatataaatactttgaccttacactcctctttgatcttctaacagggcaccctactggccaaacccaaacaaaagccagagggcatgggagactcttgatgtagtccattcaggtcagcctcctgaggcagagaatgtggttgagaaagagtcaagagtatatctaaagtagtaaagataagatatctatctcatcttcccatttcagtcataaatctgacttcaatttctgtcctttttcattcagggtttacttgaggtttatatatagaggcgtcttaggttatttgtttagtttgcatgtctaaaaattttattagaaagttaagcttgacattttgaactattttatttacctaaactttgtttgtgtttgtttggcttgattttgcaggtgatgatgatgaaattcctcaggaactgctcttaggaaaacatcagcttaatgaacttggcagtgaatctgctaaaataaaagcaatgggtataatggataaggtatctcaccaaagtaaaatttataaatttacttcatagaaacatttgaaattaatttaaggttttcagggtaaattataaaatttatgtaaagtaaatagtaaaaagaaaactcattgttgacttctgagagtctaaatgagtttttttgtttttttacaaaagaaaaaagtattctgcagattattctaaagagaatcatattactgcattgaaagaggcatggactttaattttttccagagtttttttttttcattttctcaaatatttagattatttaaatgcagaaatatattaaatttttctttgacatttgctttagtcatttagggtcgttgagtagaagttctaagtgggaaagttttcttactctttaagagggtgacaatgctatttcctccatagctcaaagggaataattgtacagattgtttcttgaataatatataacttttaccaacgattgataaagaatttatattgctattttagctttcaactgacaaaactgtgaaagtcttaaatatcttggagaagaatattcaggatgggtcaaagctttccactttgttaaatcatgtaagtttaagatccatactgttaattttacccttaatgttattaagatctatagtagtcccccacttctctattgtttcattttccattttctcagttacctacagtcaactgtgatctgaaagtaggtgaataatttttattacagtctattgttctgttttttattgtcattaatctcttcccatgcctaatttataaattaagttttatcttaggtatgtatgtataggaaaaaacatagtgtatatcgggtttgatagtatccatggcatgcactcgaggtcttggaatctatcatctgtccattagggagggactaatgtgaattttttcacaaatgactctcatgtgggggaaatttcacatttcgttaatttgagcatgttaccatgaattactagttacattcattagcattgctagtagaacttcacttttagtaattcagaattaatgttacacattgtcaattcacagctttgccataaagtaagaataataaagacatgaaaatgtttgtcaatttaaggggcagttctttagtttatgctcttccttatgtaagtatatgaatgtttaaattttgtttttgagttatgagatgatagtaggtagtaattctttttgttgagcttccctgaagaaataacatagttagaaaccttatgatttcctaatatatactaattaatatacattactccttatataccgtttttatacctacctcaaagggttgttcaaaggattaaagaattaattcatgtaaagcacttagtgtctggcacactttaacttctcagtaaatgttaactccagctgttactatattttaatatgcttatatcaaaagcagtagcaacatgcttgcaatggtttattaattgagtgaagcaaatttcctgggatttgccttcctagcattgtagtggactatgaattatatgtgcattcaaattgatcttgatatctctgacattaatgaatgcaaacactaatgcttataggcatttagtaagttctgagttgataaattttctttctctcccttttttttttttctcccctgatagagccagggtcttgctctgtcccctgggctggagtgcagtgctacagtcatagctcattgtagtctggaactactgggctcaggtgatcctcccacctcagcctcccaagctgctggaactacaggcatgcaccacaatgcctggccaattatttaaaatgttttgtagagccaagcgctcactctgttgctcagactgatctcaaactgctggcaacaaacaatcctcctgccttgtcctcccaaagctctgggaccacagatgtgaggcactacacctggccaaattttctttatttttaaaagcctgattataaaagtaacatatttattgtagaaaatttccaaaacacagaaagcaccaaaaaagctatattctaatccagcaatgaccattttgaacacttttgatatatatacttctcatgtatacgtatgtagtatatatatttaatatacaagcactagattttattttatcttatgagggaaatgctcttggtgtttacaaaagccacaggattgctaggggatctacatggaataaaacaagcttgtccaacctgtggcccactggcccgtgtggcccaggacagatttgaatgcagcccaacacaaattcgtaaactttcttgaaacatgaggattttttgcaatttctttttacgctcatcagctatcgtaattgttagtgtattttatatgtagtccaagacaattcttcttccactgtggcccagggaagccaaaagattggacacttctggaataaaatatgtagaaaaataatctcaggtggttgttttctggattattaaatatatttatatttttaagtgccctctctttactttttgcatcacagaaacaaaggcttagagaaacctaaagtaacaatctactccattgttagtctacaagttacttaaatacttcgccaagaaattgtgataatcatcatcagaaatctagagttctggagagctggctgactcagtcttaaggaaattactttcatccctaaaaaccgtaacagtatttaatatgttgtggatagccttaacgtttggcatgaatcatgagcctccttaactgactcttccaaacaaacagcaatgttcgcatcaaagacaagctactttatctttcctttgtgaggttttaggcattactgaacagaaagccctgtctgctttacatattatatatcgtgtttttgttcgttttcctagggtataagctttgaattggaagtagtcctgtaatatagtttatatttcataactaaagatgtgatagaaggatttttactttaacagtgagattactcctaatttgcaatgtcaagttgctgatgtgtaaattaaaataaagtcttctgtcagttcttaaattatccatttaaaaaaagtcttcattagtctgcatattactactttttaatctcagtttcagaaactgtgttgtcgaaaagcaggtgttaggaatgattgtcaattttagtactaagtaagattttaccctttgtcattaatttttgctttgttatcacagcagcaagcagaatttataaagtctttaaactatcataatgtttatacccaaaacacaaaattaatttatatgcagttaaagtcataagctaaatcttaaattcggataaagcacacaaaggatataaagataattataactttgtcagtagggtgtcatctagtggtgaaatgaggtagagtatatcacgtttgaaaacattgaaacacaaatcgtgctcaaagtagtatcagtatttgtacctcattctggatattcttaaaagaattaacacacatcataacacttttccaccagtgaaaatcaaatcataattttaatgtatattttaaacctataaatgtgtttatttccatttcattaacaatactgttttacagaataacgatactgaagaagaagaaaggttatggagagaccttattatggagagagttacaaaatcagcggatgcttgtcttacaactatcaacattatgacatcccctaacatgccaaaagctgtgtacattgaggatgtaattgaaagagttatacagtacactaaatttcatttgcagaatacactttatcctcagtatgatcctgtttacagattagatcctcatggaggttagttcgtataatatcaaaattattgtaaatttttgccatgttagatgagtcaaaataggacttaaaatggcaccaaaatttttgaatcatataacttgtaataaacactgattttgattatggatttgactagaatatagtacttgttcaattataatttctttaggaacatttatatataatagaagttatttctacttgtcagggaaaatctcagaaaatactaccttctggtttcatttatcacttcgccctaattttacccaaaatagcagttgtctacaaaatggattgattcaagataaatactccttttcttgttcttaacctttataaatgagcaatgaaatgtatacatttgaagggagtaaggtcatacctaagtatagttcctgaataatgaacttgacgatctattgtataactgcaaattaatttaaagggaaatataatcttactatcctgctccaatggagaaaagtagaaatcaagataaaataatattttagatacagggatttaatagctgctgaagattatctgatgcaagaatgtttctaatagaatatctctagagagtaattttctattttaataaataaaaagctttatcttccaggttctgtagctagaaaattgtgttctcttaattcaaaaaacagtttgagtactgtttattaaaaattattaaaagttgatgttttccttatcttgaatttgtttcattttaggaggcttattaagttcaaaagcaaaacgggctaaatgttctacccataagcagagagtaatagtaatgctttataacaaagtttgtgacattgttagcagcttatcagaattgctagagatacaacttcttacagacacaacaattcttcaggtaagattttttggtaagcattttgtatatttctaaactaaatgattaagtctagtataacctagctcactcaataataagaccagcactatattatcaagaatttttcctgttaagagtatgttatatctaaatcgaagaaataaaacttcaggagttttaaaaagacattttatcaggagacaaacaaatgtagtgtaaattccaaactctaaattctttgaaagatgggttatattttcatgcagatattaaatgtttgttatttctttatattcctgtgacatttgtaaactcaaaaagtagagattagaggactgatagctatgatacaatgtacctgttgtatatgctaacgtgctttgaggatgaagggaaacagagaaaagaatagatgctgattaggtggggaaaagaaaaaatgctttcttagtgttttccagtaagcttatgaatgtattggaatttagtaagatagaatgttactgaaatcaactaaaggtgtatactacttactcttcttttttaaacaggtttcatctatgggaataacaccattttttgtggaaaatgtcagtgaactacagttgtgtgccattaagttagtcactgcagtaagtataatcaatttgtatttttagttaccccacaaataaaacaatattgatgtcatttaatccaaatttccaaaaaataatgaagatacctggttttcagtacattcatttcaatctaaggactattttactaagtcttattagactttattaattgaggatttatttttctgtttggttaatttgttgggttattctgtttttgtcacatttaaaacacttccaaatatttgcaaatatttcagctaataattccttgatatttataataaagttagaatggtttaaaatcatttaaattcttgtctgactgcctatagccaagatttcatagtcctttaaatgaaactagtgtactctttgacttctataagaatgttataattaatgataggaaaatagagcagcttaccttagatactgaaaacattttcattctaaatggcaggtaattttttaaatcacatgatattattttttggtttgttttctattataagtttaacttggaatcttataattactaaacaggtattctcaagatatgaaaaacataggcagttaattttggaagaaatttttacttcacttgcaagattaccaaccagcaagaggagtttaaggaacttcaggtaattaattataacagaggtcaagtttaatgaagaaccaccattatattgaaccgtcatacatttattcttcatttctgtctgatttatattttaataattaaaaactaggcagttacatcagaacagcatgaaaaatagatgtgtgaaataacatggcatatttagggggcttagaaaacttcactgattctcaagggtaaagatctgtggcagggtttttcagtgttggcactgttgacattttaggccatataacactttgttatgcatagctgtctagtggaatacagcatgctcagcggcatccctgacctctacccattaggtaccaatagacacccttcctccttccagttgtgacaaccaaaattatttccaggcactggagagcaaaatcattccttaatatgaaccactagtcagtgagaagatcttgttcatcctgttggaaatatggctcaaaataatcagatcagttcaaagaggattttataagatttttgtgtctcaaaaaaaaaaataaaaaacagaaagattaatggcagtatggagaataaacatggggattaaatgctctttaatcactaagcacactgttaataaggagtgttacccactgctatggtcagcattattgtctttgccatcatagataatcaccggaattatcttaatattcctgagtgattaaaagtgttgacgtggcatataggattgtttttaagattgctttgaaggcttctttcttctctaaaataattattttatcttaatcattttttggactaattgtatactgataaacatttattgtctgttaaacctgaagaaaaactatgaagaaaaactatcaacacataaaagaatccttagattttttacaatatctatagaacaaaagatgtggaaattgattttttataatctgtgctaccaacactagcatagatgatcaagagctgtgtagcagattttaataccaaatgaataacagattcagcagatgaatagcaaaatatatgggcatttggaaactttgaagacttttatcattttcaaaatcattttgagaaatgtttagtagtagtatgaatttttatctgcaatgtatgtaaagcatacaaatttgtattaaatactgtatttttcctttgactattttaattatctcagcatgcataggcatttacttgatgtttttgctaacttacaacaaataattacacataagaacacaataagcactaagatcatgcctagaaatattggcaaacacagtatcgtgaaactttcagacaatagatgacatttaaatgagattatcttgatactccatacaaattttttttcttcattaaaggttaaacagtagtgatatggatggagaacctatgtatattcagatggttacagcactggttttacaacttattcagtgtgtggtacacttaccatcatcagagaaggactctaatgcagaagaagattcaaataaaaaagtaaggaatctattaaaggttttacaactgtacttttattgaaggaaatacctatattctctgtcattcttataaaactgaagttctttttttttctttcttttttttgagacggagtctcgctctgtcacccaggctggagtgcagtggcgcgatctcggctcactgcaacctctgcctcccgggttcaagtgattctcctgcctcagcctgctgagtagctgggattacaggcacgcaccaccacgcccggctaatttatgtatttttagtagagacgggttttcgccatgttggtcaggctggtctcgaactcatgatccaccctcctcagcctcccaaagtgctggggttacaggtgggagccactgcgcctggccaaagctgatgttcttaattagaggttcatggctgggctttaaggtccttttagagcactagacatggtgttggaagagttgagttctggttctgttgtatctatcagtcataaaacatataaatcattttaatctttctgagtttattcttcagctgtaaaatggaggtgataatacttatcaaaactgctataccaggttgtaagggtcagtgagatattaaatgtgaaagtgaataatacaatatgtaatatatatgcatgttgagtatccctgatccaaaaatctaaaatcggaaatgctctaaaatctgaaactttttgagtaccaaaatgatattcaaaggaaatattcattagggcattttgcatttcatattttcagattaggggtactaaacccatatataaatacataacataggattataattaacattaaattcatgtggaaaatgagtttattccctccctaataggtagctcatgccgacgatttgcgtttggttttacagcttttggagatgtttagaatttttccaagtgtatacttttatctcaacaaaagtttaagagaaacaaataattttgtttatctactgttagagccaagcatatgtgtgtatctttttgggaataataataaatatgtaataattattaataactggacaggcactttggctcatgcccataatcccagcactttgcgaggtcaaggtgggcagattgcttgaggccaggagttcaagaccagttgggcaacatgacaaaactctgtctctacaaaaaatacacaaattagctggtcatgttgttgtgcacctgtcatcccagctactcaggaggctgaaacaggagggtcgattgagccttgagagatcgagactcagtgagccgagattgtgccactgcaccctggcctggatgacagaatgagaacctgtctaaaaatgaatgaatgaaagaaagaaagtcaaatactctctgaaaagttcagatcctctttatttctcccatcccaatcccattgtttgtctctagtcttcctttcctaaccattggtgacaagtatcatgaatatgtttctttctttcttttaattatttttatgtaaatttgatatacaattatttcatttttacgtaaaggacagtgacatatttacagctaattttttcactcaacatcgcttttaatacatacaactcatactagattgttttttacttgagttaaaaacaccatatcatagaatcacaacttaaagcaaaagtttctgtagatacacttagaagtaaaattaagatagtatacatgcattaaatttactggaagttgtcaatttgcttactaaagtggtgtttcagtttatagccctacttcttacttaaaattatggtcattgagaaatacccatcttattttgcattttcctggttattagtgagcttgagccccttttcctatagttatttgtctgttgtatttttataactgtgaattgactgtttatatcttaatctttaaatttcttttttttttttttctttttgttttctttgagacagggtctcactctgttgcccaggctggttgcagcagcgtgatcacagctcaccacagcctcaaccgcctaggctcaagtgatcctcccacctcagccttccgagtagctggaactacaggcacgcgccaccatgccgggctaattttttttttttttttatcttggtgatattctctttttatttattttgtctttattcagtaatctgctttgatatcctgaatcagtatttccttaggtggagagagttttcatatattgaatattagattctttctccaatttttttttttttttttttttttttattcattcttgggtgtttctcgcagagggggatttggcagggtcacaggacaatagtggagggaaggtcagcagataaacaagtgaacaaaggtctctggttttcctaggcagaggaccctgcggccttccggccttccgcagtgtttgtgtccctgggtacttgagattagggagtggtgatgactcttaaggagcatgctgccttcaagcatctgtttaacaaagcacatcttgcaccgcccttaattcattcaaccctgagtggatacagcacgtttcagagagcacagggttgggggtaaggtcacagatcaacaggatcccaaggcagaagaatttttcttagtacagaacaaaataaaaagtctcccatgtctacctctttctacacagacacggcaaccatccgatttctcaatcttttccccacctttcccccttttctattccacaaaaccgccattgtcatcatggcccgttctcaatgagctgttgggtacacttcccagacggggtggtggccgggcagaggcgcccctcacctcccggacggggggctgacccccccccacctccctcctggacggggcagctggccgggcagaggggctcctcacttcccagtaggggcggctgggcagaggcgcccctcacctcccggacggggcggctggccaggcggggggctgacccccccacctccctcccggacggggcggctggccgggcagaggggctcctcacttcccagtaggcgcggccgggcagaggcgcccctcacctcgcggatggggcggctggccaggcggggggctgacccccccacctccctcccggacggggcggctggccgggcggggggctgacccccccacctcccttccggacgaggtggctgctgggcggagacgctcctcacttcccagacagggtggctgctgggcggaggggctcctcacttctcagacggggcggctgccgggcggaggggctcctcacttctcagacggggcggttgccaggcagagggtctcctcacttctcagacggggcggtcgggcagagacgctcctcacataccggacggggtggcagggcagaggtgctccccacatctcagacgatgggtggccgggcagagacgctcctcacttcccagatgtgatggtggccgggaagaggcgctcctcacttcctagatgggatggcggccgggcagagatgctcctcactttccagactgggcagccaggcagagaggctcctcacatcccagacgatgggcggccaggcggagatgctcctcacttcccagacgggttggcggccgggcagaggctgcaatctcggcactttgagaggccaaggcaggctgctgggaggtggaggttgtagccagccgagatcacgccactgcactccagcctgggcaccattgagcactgagtgaacgagactccgtctgcaatcccagcacctcgggaggccgaggctggcggatcactcgcggttaggagctggagaccagcccagccaacacagcgaaaccccgtctccaccaaaaaaatacgaaaaccagtcaggcgtggcggtgcgctcctgcaatcgcagctctcggcaagctgaggcaggagaatcaggcagggaggttgcagtgagccgagatggcagcagtaccgtccagcttcggctcggcatcagagggagaccgtggaaagagagggagagggagaccgtggagagggagagggagagggagaaggagagggagagggagggagagcttaatctttaaatttctgatgaaggctttgaatttttttttttgattgtatggattatatgtttcttaaactttgaggttgacatattttttctaaattctttttttattttcaatccatttctttctgttctgaccaggattatgataaacaactattgatattaaatttgttaaccacatatgttactcttacattattttaataacactctatctgtatttttatttgtttctataaagttttaaaatatgcttagtgtgctaattttggcttctcttattatatataatgtaatagtttaagcattttagtatttaaatatattacccctcttcagtaataacatgacaatagcaacagggctaacttattatttcttgtatctttataaactcactttttttcattctagattgaccaggatgttgtcattactaactcttatgaaacagctatgcgaacagcccaaaacttcctctccatcttccttaaaaagtgagtaaaattaatataaatctggtttttcttttccacagtatagagaatagttcatttttttaaaaagatgaatccaatttcctgccataatctgaaccttgaatacatcttcctgacacttggtttcttgatctttaaaatgaggcaattggagtattaaaaatctaaaattgggatgggactacacgggggaaaaaaatctaaaattttgtgaatttgcttatatgttagactccagaaattaaagtactagattgaaattctgtaatttgtcttcagtaaattttggagaattttcctagtgtacctgaataggaaagtttgtgaagagatgttatttagcctccatatgaatttttttttttttttaatgagacagagtttcgctcttgttgcccaggctggagtgcaatggcacgatctcagctaactgcaacctccgcctcccagcttcaagcgattctcctgcctcagcctcccaagtagccgggattacaggcatgcaccaccatggccagctaatttttgtattttcagtagagacggggtttccccgtgttggttaggctggtctcgaactcccaacctccggtgatctgcctgccctgacctcccaaagtgctgggattacaggcgtgagccactgcgcccagcccagcctccataagaatttatgatgaccttggccaggtgtggtggctcacacctgtaatcccagcactttggaagaccaaggcaggtggattacaaggtcagttcgagaccagcctgaccagcgtggtgaaaccctgtctctactaaaaatacaaaaattagccaggcatggtggtgcacgcctgtagtcccagctacttgagaggctgaggcaggagaatcgctggaacccgggaggtggagggttgccgtaagccaagatcatgccactgcactccagcctgggtgacagggtgagactccatctcaaaaaaataaagaatttatggtgatcttttaggtagaaaaacagtgatcatttttttaaatgtgtttcacttgcgagaaagtagtattagtattgcttaataaatgaattccctataattaaggagaaagtggagtttgtgaaatagactcattttaaaccatattttatttaatgtacatttatatattttgttactaaacatagaaaaaagaaaacttagctaacaatttcaatcatgttggtagacagatgactgacatgtgtcacctaaattgacatccttttcattatttgcctttgaacagatgtggtagtaagcaaggtgaagaagattacagaccactgtttgaaaattttgttcaagaccttctttcaacagtcaataagcctgaatggccagctgctgaactactccttagtttgttagggagactgttggtaagagtatagcatttaaagattattagattactagaagacaacataatgaggatgtactctgattcacagatgatgaattctttaaaaatgtgtaaggaaatatgaacattgcatctctttttgcatgtgcataactgtacacaatattgtcagtaccttgtagaaaattttcaaatgttgtgaagtttggtgctttcatttcattacataagataacagtgctttaacaatttttttttttttggaaatgttatattgttaaaagcatctcaacactgagtcataagttactcatttcaaagcaagaaaatgattaatatagactccttatcatctttaagagtatttctacaaatgtatggcattttgtagtcgtcatgtaacacagtaggtaaatgcaaagaaatgttgtgactctatttttaaactacatttgaacttgcacaatacacattgttacaaagcttctgggacctttttgtgaatgggaaaatatgttaatattattcggaaactataataacttttcataggcatcagaattccaccctaagaaattcttactcagtaataccacattttgtgcaaataatacagttgagcctgcatatttaatgagttgtgttgttcttaaggaagtttaatctgtaatttttttagtcacatgaaaatgttcagattccagaaaatcaaaaggcaaaaatgactttatgggacaatatcacaggaaaaaaaaaagtttaaattttaaattatacaatttagattgggaatttatatgataaattgctatttaaaatatattgttataaatctattcaatcaaaaactattttgatatttaggttcatcagttcagtaacaagtcaacagagatggctttaagagtggcatctcttgattaccttggaactgttgctgcacggctaagaaaagatgctgttacaagcaaaatggatcaaggatctatagaacgcattttaaaacaggtactaagataaaagattaaaattatgggaatgaataatagttattttctttgcatgtccttacattagttttgcatttcattttgtgtggattcaaaataagatttttacttctaaaagtgggcttttcaaagccccagtgagaaattttaagacctgagaatgaattatttagtctaacagggacttctgaatggttcatataaatcatttactttctttttgtgaagtactcttaataatgtataatgctgttttatatttgatttaacataaattttatttaagtttttaatttactgaatggtgatttagcatacacaataagattgttttgtacttttgaatgttttgtatcttctcataccaaggaggtgtgaggagagcttttttatactttattacattagagagttttcatcttgggggaaaaagtgttttattgcttttttttttttaatgtggatgaagtggtagtaataaagttacttgagaaaactggtgaagaaatgatttctaatcctactatatacaacttctgttttcatttttttctagtctttttttatgctcgtaatcatatccatgttggtagaaatgcctctaatttttttttagctatagttcgtgttttgaaataatctcaaccttagagaaaaattgtaggaatagtacaaagaactcccataaaagcttcttgcaaattcctcaattattgacaatttacaaaatttcctttctcatctttcaaaatatagatgtatgtgtgtctgtatatgcatttttttttaaattttgtttcgaaccacttgaagttaagttgcagacatgattccctcattacccctgaattctctaatgcagtgattttccaagtatgatccccttgacaagtaacaccaacattgaaatcatctgggaactaacaagtacatttctaacaaaagtacaaattcttaggaccctccctggacctactgaatcaaaaactcttggtttaacaagccctccaggtgattctaatgaatgaatgaatgctgaaacttgggaaccactgcttagtgtatatttctgcaaacaagagctctcacttaaatatctatagtacaattatcaaaagcaaaaaattatcattaatacaatattaacatctgatgtaatacaatacctactctggtaaattataatttgttgccatcattattttaatgctcaaatcgtcctagatttgatcaatgagaaccctttgaagctggcttttatatcattttgatatattcccatcataatttgagggctttctagaacaaaaaggtatttcaggcagatcttttaccttccctacccctgccctgggatcagttgtttctcctaggaatcttggttccttttgttggtgaattgtaatgtagaaaccaagatctagttactggatgactttctgtatttcttaaagtgggcctggaacctcttattgccatgtatggctatgttgattatacattgtgcagctcaaggggaaggatcatttgtaaatttttatggctctcaacacatatttccaaaaggaaattcttcctacctctgaagatttaacacatttttctgatcatttttatgtcaactacctatgagctctttttttaaaaaatgacatatggttcataaaaataatggccgggcgcagtggcttacacctgtaatctcagaagggtggattatttgaggtcaggagttcgagatcagcttagccaacatggtgaaaccctgtctctactaaaaatacaaaaattagccaggcatggtggaccatgcctgtagtcccagctactagggaggctgaggtaggagaattgcttgaacccaggaggcaaagattgcagtgagccgagatagtgccactggactccagcctgggcgacagagtgaaactccatctcaaaaaaagtaaaacaaaaaaggcaaacttcagctatcaatatataatatttttcggaaataatatttttctgttttttccttttagttactgtggttgtattttcatttttaatatcagtttttccttcagatttgtgtttacaattaggtgatttattaaagcacaccagtaatatcttttttgttcttatttggtttattctataggtttcaggaggggaagatgaaatccaacaattacaaaaagcattgcttgattacttggatgaaaacactgagactgatccttcactagtggtaggattcttttcccctgttttggagatactacatgtttatttaaattgggtttaagaaaattgggaggtagcatgatgaagaggaaaacttaagttgtttggaatattgattttcaaaacaaagggatacttgataatctaaacagaaaagaatgctttgggttgatttgtcttatatggaattctggttacagatactgtactgtactaaaattgtgtgacaagagaaatatttggaagtctctccgtaagtgatctttgaggctaggctaggtcattggttctcagagtgagtatgggccgagtggtacatgagatgatctataagcctgtaaaaataaactattggatttttatatgtatatttttaaatataattttacttctatttcatgtatgttacacaatgtaaccaaaatattagtataagaggttcatgtacaaaatttataaactattatttgagaacattatacatagagatattttattttattttttaactggtgggatatgcaattgaaagaaatgggatactactaagctcttcagccaaatactgtaggttttcagtttgtattcaaaggaacagatttacaggtgtgtctcagtgttaaactatttcagtgacaattgtcttgtgtgtttcttggagaactaaggcaaaatttgaaaacagatgaagtcttctaccttcagcattttatcaatttgttttaaactttcctagttgacccatcatctgtttaactttgtcatgatgttgtccttgattaagtagttgataatagtattctatatttaatacagttgtgtttatcaaattatcttgacttcattaatataagtattggaacatagtaaaataataagttttctaacatttaggatattctatattttctggctttcttaaaatctgtttttatcacatggaagttgttttaaagtaaactttaatatttgtattcctgtaatgtgagcactctaactttattaacttggaaatcttgttgctaatttcatcaagctcaagtctgtctaatttctttccagttttctcgtaaattctatatagcccagtggtttcgagacacaactctggaaacagaaaaagcaatgaaatcacaaaaagatgaagaatcatctgaaggaacacatcatgcaaaggaaattgagacaactggccaaattatgcatcgagctgaaaaccgaaaaaagtttcttagaagcattatcaaaaccacaccttctcagtttagcacattaaagtaagatccaaggagaaaacagtttacatttatctccttgatatctatttccctaagttacaaaaaaagaaaaataaatttttaatgactttttgttgcaggatgaactctgatactgtggactatgatgatgcttgcttgattgttcgatacttggcctccatgaggccgtttgcccagagctttgatatttatttgacacaggtaaactggataagaattccttatacagtgatattgatttttctgattctggatgcttgtgagcagtatataatatcattcattgttgagtacagatacttaaaagatcatagatgtagtatttgtttttaggttctccggccgggtgtagtggctcacgcctgtaatcccaacactttgggaagccaaggcaagtggatcacctgaggtcaagagttcgagaccaacctgaccaacatggtgaaaccccgtctctactaaaaatacaaaaattagcggggcgtggtggcacatgcctgtaatcccagctactcgggaggctgaggccggagaattgcttgaacctgggaggtggaagttgcagtgagccgagatcgtgccattgcactccagcctgggcaacaagagggaaactccatctcaaacaaaaaaagaaagtccttgttctacatcccttttacatattcttgttttacaaatatatatttgtatgaatgcacacacatacagtatcagtagagtaagtgacattataaaaacatccaactaaatcccagcactttgggaagccaaggcgggcagattacgaggtcaggagatcaagaccgtcctggctaacacagtgaaaccccatctctactaaaaatacaaaaaattagctgccatggtggcatgtgcctgtagtcccagctactcaggaggctgaggcaggagaatcgcttgaacccgggagatggaggttgcagggagccgagattgcgccactgcactccagcctgggcgacagagcgagactccatcccaaaaaataaagtaataaaatacaaaacattcaactaccaaattatgatttgaatgatactaaatatctttgattcaagttacacatagcaaggttttaatggggctacaggttctgcaaatgaagcaaaacaattaaaaaacaggtttaattggataaacgaaaggctccaaagtatggactatacacttaacacctgtactgatttttaagttaaactttgaatcattaggaaagatcctttactcatttatatacagattaaagagaggtaaataatagatttgttttcttttgcatgttttcatgctatttttaattaaattttatgtattctaaaatttacaaaaatgtcaatgtttgcttggcagatcctacgagttcttggtgaaaatgcaattgctgttcgaacaaaagccatgaagtgtttgtctgaggttgttgctgtagaccccagtattctagcaagggtaaagagcaaaaatgattctttcttttctactcgaattggaatattcactctatttaggtataaattgtttttttctcttcatttttctttagcttgatatgcaacgaggtgttcatggacgattgatggataattcgactagtgtccgagaagcagcagtagaattactaggtcgatttgtcctttgtcgacctcagcttgctgaacagtattatgatatgctgattgaaagaatattggtatgtttgtcatttttataatgattcgtgaatataattttgcctttcaagcatcatgttttgttttaaagtgttaagttagaaaaataaatgtaccaattatatatttatattgtcaaatttatgaactattgccactttctaaacaagtacatattttcaagaatagcccttgcaatatcataaaacaaatcattggtaataattggattccttttttcagttgctgtttctttttaattataccagtttacaatgagtagatgataggaaccacatggggtagttaaatgtttttgaacaagaatctagagtgattttatgtatatatttatgtatgtatatatataaacaggaagaattatttcagtgagagacacgtacagaacgttggtacctgacaatatttttggatcccttaggtgcatcttcttgtttccttaaagctgattaatgatagctcagatacctacaagttaagcccaaaagtccattgaggtttaagagcaaactaaagaggttctacatacatcatggaattctctggctctgaagcatttttctgaaaaatgaaaggaaacattggcattaggaaatatctgtggaatctccacactacccattgcaggcatattgacttattgtagaactcaacatagatgcactagtgcacaaaattaagtattacctcaatgacaagagtttattttgtcacccttggcctaatatcagaacattgtgtgacagaagtatagagtcatttttagcttcaactaggcataaatcttggttgagaaacaaataatttaaagaaaagctggaaaaatttttttccttcttagggcttccatcttttgaagggtaaaatcaacaggattcccacgtatctgataaactctgatatttgtaaccctagtaaaatatcctaaaatattttggggattgctaaaatcacataatggagattaataattttgcacacttcatgtatgatgctttttatttttaaaactctttaatatgaaagtttgttaaagaaaaatagtacagtgaacacccttgtacctacctccatacttcatctgtactttctgctaaattattttaagtcaaacattttttacttcttttcttgtgaacacttcagtttgtaacaccaaaaaaagatactgtgctatataaacaaaaccattatctcacccaaattagcactctagtatcatctgaatactagttcttagatcctccattgtcctaaaaatgttttttcattcttcttttttaagaatcagaattcagtcaaaggtaatacattgcatttgggggtcatgtcttaaaattgaagactattttcttattctttttttttttttttttttttttttacatcccatatgacattgacggattaaaaaggcctgatcggttttgttatcttcccacacttcgtttaatttaacttgtgttttgtatctcttataaaccataagataggccaggcgcagtgcctcatgcctgtaattgcagcactttgggaggctgaggcgggtgaatcacccaaggtcaggagttcaagaccagcctgacaacatggtgaaacactgtttctactaaaaatacaaaaattagccaggcgtggtggtatgcacctgtaatcccagctactcgggaggctgagacaggagaatcgcttgagcctgggaggcagaggttgcagtgagctgagatcgcaccattgttaccccagcctgggcgagaagagcaaaactccatcccaaaaaaaaaaaagaagtaaccataagatagtgccaaaggtttgattagattcaggttaaacatttttatgaagtctacttttaagtgatacttcatgtgctgtttaagtgccagacactattctaaagcttatgtttgttttctcatttaattttgacaagcgtatacttctagtcttgtgtccagggcttaactataaaatatgtttctatgtcttagatatcatactttaaaagtaaagacaacataaaaaaataacacatttatagtagcagaaagcatgtaaaaagcaaatatgtcaagtgtgtttatcatgttaacaaatagtgaatatactgcgtatggatacttattttctaatttcatacactaggcatctcaatttttctgactcttaaaaatacctttctgtttttaggatactggtatcagtgtcaggaaaagagtaataaagattctcagagacatttgtattgaacaaccaacatttccaaaaatcacagaaatgtgtgtaaaaatgattcgcagagtcaatgatgaagagggcattaaggtagtgttgactgttttaaatttatttttcattaatgtttaaaataagttaaatgtttattgcacctaaatgttgattttaaatatatccaaacactttacaatgaatcgtttatagtttataaacttaagaaaaatacatactttaattttttttgtttctagatttttatattaagtattataatctgattttaaccaaccaattcctcagtggtaatatttatttaagactggccatagtagctcatgcctataatcccagcactttgggaggccaaggcaggagaatggcttgaggccaggagttggagatcagcctgggcaacatagtaagaatcctatttctataaaaaataaaatgatgaaaataatttttaaaaatttcaccaaacatagtagagcatgcctatagttccagctactctagagattgacacaggaagattacttgagcccaggaattcaaggctgcagtgagctgtaatcttgccactgcactcctgcctgggcaagggtgagactccatctcaaaaaatgtgcatgtgtgtgttgattgatttattgattgttattataagagattgcattatattcaaaggtttctcatgggattattttaattttcaaatgattttagttttctaaattattaaataaatactttgtttcattatgttaagtgaaataagccagacacagaaaatagcacatattttcactcatgcgtggaagcttaaaaaaaatttatctcatagagatagagaatagaaagatggttagcagagggagggaagggttgtgaggggttgaataaagaggggttggttcacagttatcaaaaatacacccagaaggaataaaatttagtgttcagtagcacaatagggtgactatagttaacaataacttattgtacatttaaaaataactagaagaatggaaataggatgttcctaacacaaagaaatggtaagtgcttgaggcgatggataccccagttaccctgatttgatcattatacattgtatgcttgtatcaaaagttcaactatacttcataaatgtgtacagctattatgtatccataaaaaaaaaattttaagtttagtcctaaattcattagtaaatttacatttatatataataatatgtataattgtcccttttttttaagtttagcaaacactgtaacaacttcttctccaaaagcagtaaatatattttttagtttgatcataaacatttgagtgtatagtatgaagaagttctaggctagggatagtatcacccattcgtattgtttaaaatctttaccaaattgaaaatttttatagttttgagaaattagtagttttagaaaaaactgaggaaattaataccagaaattcctggcagtttgtgttttgattagttatttatagctttgtgttgggcctaatgagaatttggaattgtgaaattgccgtatttgttataattagttaatttgaaatttctcttccttctagaaattagtaaatgaaacattccagaaactctggtttactccaactccacacaatgacaaagaagcaatgacaaggaaaattttaaacattaccgatgtggtaagaaggactggaacaagggtgtggtcactgttgatccagacctaattgaggcctacatgtcttatgaaggaagagacaataatgagatatttcattaatcttgacatttcgtactgctgcctttactttatatttctggagatgctgaagggatgcaagtaacatgtcgttgatgcttccatatagccctacttcttggcattaattgatgtaaacactgatactgagattttcctattcctccagcaattaaaaacagggagggaaaggagaaatggaagaacagatacaatcgcccaagggtaataatctgcaaagatagtaatgcctacttttttcagaaattatgaatatggattagctacattttttattatgcataagctatacattttgtgtttttaatataagaaatttttgccagtcacagcgcatatgcctataatcccagctgctcaggagtctgagacgggggatcaagagatctttgaaccaggagttcaaagctgcagtatactgtaatcatgcctgtgaataggcactacactccagcctgggcaatataatagcaagatcccttctcaaaaaaaaaaaaagaaaagaaagaaaaattctgtatattcaattacatcatcttctacatttctattgatgtctttaaaatgtgccatctagaagcgtaataagaaaaatatttttgttcttaatgtttaagatattacagattttcctcacagagtgtagttcaagttattgtgccattttaaacttatgccactttaaacatttagtgccatattaaacctcaatacattaaactaatttcttcaatgttttccaagatattttttagaataaagttctgtaacgttggtaaatggttgtgttactgaaaaaatagtttactttaaaaataaacttttgaattgagaaaattgaaacatgtttcaggctaaagcataacaaaagtatattttattcacatttataaatatacttctaactttgattcttttcatcacccttaggttgcagcatgcagagatactggatatgactggtttgagcaactgcttcaaaacgtgagtgttcttttgactcctgataacctaaaatttaataggttagttttttgttgttggtgtttttttttttttggactgtatgatttaaaagaacctttttagttcttttggtagggaaaatttatttcaatatgttaggctggatgattttgttaatttctataattaattcagttgcctggttgtggtttttttttttttttttttttttttgaggtggagtctcgctctctcactctgtcgcccaggctggagtgcagtggcacaatcttggttcacttcaacctctgcctcctgggttcaagcaattctcctgcctcagcctccagagtagctaggattacaggtgtccaccaccacactcggctaatttttgtatttttggtagagacggggttttactatgttggccaggctggtctcaaactcctgacctcaggtgacctgcgtgcctcggcctcccaaagtgctgggattataggcatgagccactgcgcctggccttcagttgtctattgtacaagtaagttttctgaatcattaactaaaattctatcttactttctttccagataattttttttctttaatctctgtgattaatagatacaagatttataaatggatcaatatattgcattaaaaatataattacatgatttagtatgttatgcatagaatttcctttagtagtacagagtcaaaccacaactagtgggttttttttaagtttcataaatagaaatgtttatctccctatgaattgttaaattttttattttagaaaatttcacacaggcagaaatatccatcacccagcttcaaaaattatcagcattttcccagtcttgttatagctatccttcccctatctggttttctccttttctttctttcttcttttgttttccataatactttttttttttttttttttttgagatagagtctcactctgttgcccaaactggagtgcagtggcgccatcttggccggctcactgcaacctccgcctcctgggttcaagggtttctcctacctcagcctcccaagtagctggggttacaggcacttgccaccacacccagctaatttttgtatttttagtagagatgaagtttcgccatgttggccaggctggtctcaaactcctgacctcaggtgatctgcccacctcggcctcccaaagtgctgagatacaggtgtgggccaccatgcccagcctgtaatacttttaaaacaaaggccaaactttatattatctcattcataaatactttagcatctatctatctgtagcagatgacttttttaaaaaattatcatttataccaaaataataatgcattattccataactaatacctattcagtgttcatattttcctgtctcaaaaatgtatttttatagttggtttgcagttgctttggttgatatactcttaagtctcttatgttagtttgccccttacctcccttttctcatgcgacttgtatgtttttctgtagaatctcccacattctggatttaatagtccactttttttctggtgtcatttaagttgttcctctatccaccagttttcaagtaaactcttagtgaaatctagaggcttaatatgattaaagttcaatttttaatctaggagacaaatacctcataggtggtgttgaatattattgcatcacagcaggaagcacatatctagttgtctcattttcagtgattgatctttgatgaatttaagtgatgatatacagtcatgtaacgtccaacacaatgaacatacaggatttcaccctaaaatgcctttttgcagttgatcctctcttcctggccctagaaaactattgatctactttttctcactgtagttgtaccttttcatgtacattgttcctatcaatggagtcatacagtatgtaatcttgtgtttgactttttaaacttagaatgttgattcattcttgttgctaatatattaatatatctttttattactgagtagtttcagtagtgtggatatatcataatttctttatcattcaccattttgtggactttggggttctttccagtttggggtgttatgaataatgcttctgtgaatattggtgtgtaaggttttgtgtagatgtatgttttcatttatcttgggtaaactcccaggaatgtgattacagggtcatatggtgagtgagaaactgccaaaatgtttttccaaaattgctaaaccatttttcatttccaccatcagtgtatgaaagttccggttgctccacatcctcaccagttctcattattgtcactttttttaaaactttagccattttggtgtggtggtaaaagtagtacattactttcttaagatgtcttttttaaaaaaccttcatggtgttttcaatgtgtaatcttagactgtcttcttaaatcatctttcatttcatatttttacatgatatatttggcatcatttctttcctaaatcaaatagttagctctatatcatagaaccttatgaccaccttagttaagtttatgtcagccatcccaaaaggtacatcatgatttctaaaaggctctaaatcatatatttcatttgatagttattataaatgatcaagtaagaattcaatgtaattatcagaaatgtcactatttaggattactaaaaagaatctacaataatgtcatcttgtattagcaaattagaagcagaagggacatgaccagatttatactctcttaacaatgatagttttacttgtacattctttgtatctttattctctagtcccatttatttagttagtaagttagtttatccatcctattcatgctctctattctatgctttcctactttagtttctgccagcaacttagtttaccaatgatattgtgactttgtgatatatttccttatactagcagagtttggtttagtgaaagaaagcaaactcatatatatatatatgacagagacataactactctgagcaattataacatatatgcataaatgttaagaaaagctaggaaggatataaagaatggactgctggagttattacaaattcttgagtccagaataattaacatgcttactgtttttacatgagcacatatgcatgcattgcattcagtccaatttcagatatttctaatttttatttttggattgggtttttggggtttgttgttgttgtttgttttttgtagatcattgactctccccatttattgaatttttttttagggaaacttgaagtactactaaaatagcttcaaattcccacatgtactaaactctgttcattgtctaaataattatgttagtatatctttttttttttggagacagggtctcgctgtgtcatgcaggctggagtgcagtggcaccatcatggcccactgtggcctcaacctccctggctcaagcagtcctctttcctcagcctcccaagtagctggaaccacaggcatgcaccaccatgtttagccttttttttttttttttttttttttgagacaggatgtcactatattactcaagcttttagtatatcttttgtttttgtttttgaggcggagtttcactcttgtcgcccagggtggagtgcagtggcacgatctccgctcactgcaacctccgcctcctgggttcaagtgattctcttgcctcagcctcccgagtagctggaattacaggcacccaccaccacgcctggctaatttttttatatctttagtagagacggggtttcaccatgttggccaggctggtcttgaactccagacctcaggtgatctgcccaccttggcctcccaaagtgctgggattataggcgcaagccaccgtgcctggccagtatgtcatttttaaatgtatggtgctatcattcctttataacctttaacaattcatagttttttggcatttttcagtaggatgtggaagattaacttctgtcctgaaggtcctcacattttttttatttctaaaatgtactccagttagtttaaaccactaccataaattgagtagccctttatgacagtcttcttcaaaaaacacattgatagccatgtgatgggtacacaaaaattaaatagattttacagtgccattcattttaattacttaagatctaagactgaccattttctagtttgtaaggaaaatacaggcaatgaaaaacagttaagagtaacctgtttcatctcttcctgtcctttgtaatccagagcaagatctttccgagtttacaataaaatattttatctctatcaaccagtgaatggataaataaactatgacaatcccatgcaatttaatagtactccacatcaaaaaggaacagggtattaatacatacagcaacatagataaataatgaaaacattgtgcagagtaaaagaagccttacgtagaagagtacatattataattccatttatacaaaattctaggagaggtaaaactaatctatactggaaaaaatcagaagagtggctgcagggagctggggattgactgggaaaggacatgagggaactttcagggatgatagttatggtccctatcagtggttctaaaggttaccagcattacctggagttttattagaaatgcaaattcttaggccctactccagacttaattcatcagtaactctgagggtagagcccatcattctgtattttaacagtctctctccagatgattcagatataagttgacgattgagaacaactgttctgtatattggtgtagggacttgagttacagtggtgaatgcatttgacaaaactgagcaaatgtacactaaaaatttgtgcattttattgcatgtacattttatctcaaggaaaaaacggggagtatactgaagtctccagtttaccttgaaatgcattgaaagtaaaatggatataggtgtgtgtgtatgcatatgcatacatgtatacgtgtgtgtgtgtgtgtgtgtgtgtgtgtgtgtgtgtgtgtgtgtgtgtgtgtagtgtgtgtgttcatcccagcagaaaaaatcttaaaggtaggatccaggagccaggctcagtagcttgcacccagaatcccagcctcttagaaggttgaggcaggaggatcatttgaagcctggagttttagaccaacctggacaatgtactgagaccccatctctgaaaaacataaataaataaaattaactgggcattgtggcctgtgcctgtaaattcagctacgtgggaggcagaggcaggaggatcacttgagcccaggagttttaggctgcagtgaactatgattgtgccactgccctttcttctggggaacagagtgagactctatctcactcaccaaaaatgtttttaatggtagaatctagatgatggtcgttagagagtgttcatgataaaacttttttcaactcttttgtttggctgaaatttttcgtaatattaagatggtgtaaaaaatatacctgtatcactgagaatgttggtacctttaaaagatattttttaagtgagcaagctaaattatactttaaaaaaattttatgcaccttgattacttcttatttatattataagtgcatggctaatatatgtgtgtaggttaacattaaagtagaagaaatcatttcagagtgggcaagaaaaacttttgataaaattcaatatccttgaatgattacttataataaacaaggatacaatgtaaattccttaatctgacagataaaactacaaaacctaaaatgaaaataatgcaaaatgggaaactgtgagctttcttcaaatcatgaataaaaaaatttaaatatatcaaagtgattgtaaaatgtatatggaaaagcagagaaaaggtaaaaataactaatttctgaaaaaagctgaagcactgacttgccttacaaaatattgggacttattttcaaagatacattacataattaagagcagtaataagtagattagtacgaaatagaacaatggaacaggatagagatcccagaaaacaggcttacacatatagaatatgcttgctataaaacagaagtggcactgcagatgatggagaaaagatagactgtttagtaaatggggttgggatatttgactgtccataagaattaaaaaaaaaagattcctacttcagctcaaaaatcaactccatatagattaaaggagaactttaaaacttttagaaaatataggagaaaaaaatttttaattacatatgtgtgtgtatatgtacatacacacacacacacacacacatatatatatatatatatatatatattttttttttttttttttttaatggcttggtcttgctgtgttgcccaggctggactcaaactcctaggctcaagtgatcctcctacctcagcctcttgagtagctgggactacaagcatgcaccaccatgcccagcctgaatatatttttgatctctgagtaggaaaggatgccttaaacaagtcacaaaaaccattaaccttaaaagattgaagaaagtgaaaatacaagtcacaaaatgggaaaagatatttggcacatatataaccaacaattaataccgagaataaatacataagaacttctctcctacaaaaccagtgtaagtcaagagtcccagtagaaaaataggtaaagttaattaataggcatttcatggagaaaatagcatataggacctatactgtgttcaaccccattagtaaagtaagaaatacaaatcaagaccacattctacaccattttattgacaaaaatggagaagtcagacaatcacaagtaatggaaaagagggatcaggtagtgtcttttaatacagataataattgagaaagtattacagccacttgaaaaatgatttcataaaattatctcataaaagcattatcttgtgaagttgaacaatgcatgtatccaatgacccagcaattcgacttcaaatatatatacacacaaaagaatcttgcatatttgcatcaggaggcatatacaagagtgcttattgtactaaaattgggattaacctatctacaaaagagtggataaatgaattaaggtataggcacacagtggggtgttgtacagcagagaaaatcagtaaaatacagctgtatgcagtaacctagatcatagtggcataatgatgagtgaaaaaagcaaatctcagaagactacatcaagtatactacctttttagaaagtggaaaatcaaagaaaaatataaatagcatacagcttatactttttttaaaaacaaggagatggtaaatttctgatagtggttatctcaagtgtgaaacaggaaaatgggataagggaaggagcacattgggagctacaagatattaaaattattcgtgttcttgatttggattcaaagtatgccattatttattagtaaattagaagggcatatacgagtggcaacagtgtgtcatgagtcaaaatttatgattaattcttttgtgtgtacctgaagccttggaaatgaaaaaggaaaaaccaaggatgagagaggatagttttctactcctgccgttaaataaaagaccaagctaggccgggcatggtagctcatgcctataatcccagcactatgggaggctaaggcaggcggatcacttgagcccaagagtttgagaccagcttgggcaacatagagaaccccatctctacaaactgtacaaaaataagctgggcacgatggctcacgcctgtggtcccagctgtgtgggaggctgagcctgggagggcaaggctgcagtgagctttgattgtgccactgcactccagcctgagtgacaatgagaccctgtctcagaaaagaccaaactagaatgtgatattaatagctgctttaaggaaattagagaatggggcaggaagaatttgcggttcatagttgaaacctagtacattgaagctgtctgctttatttatttcttcaaattggaggaaaaggggcagtgtgtgtgttatgttactctggttgctgtcagttgttttaatcatttatgcatcttgtggggaaagtttaagcttgtgctgcccaagcttgtgcccaactgtaagccacatgcatttttttaaatgttaacttaatttcaatttttattttatttaattttaatttctcagtcacagtaggtacattgcaagtgcttaataactgcatgtgactcttggaaaccatattggacagcaaagatatagaatatttccattattgcagagaaagttatatttaacagcagtggaactcttcacagaaatcaaatacacatttagattccttcaatatccccagaattagattagctagcttttcttaggaaaacagatataccttatgacttttctgttgacctttgattatgaaagattagattggttttactttttagctatatttagaatgagctctatcctcatctcattattcataacacttttctagcattgtttgtgattttgcaaaggataatgcagaaaagaaatctaccgttatgttttataattgccttttaaggtgcaattcagatgcagttattaattatttaaaataattcaactagtattatgtgatactgtgtttttgattggaatagggagaaagggaaggtcatcttttctacatctttcacgtattaccttaggtcttacacagcaatttaagtactttgtagtaaaattgtttgaaagtattggtaaattactggtttataagatatttttaaacatatatatttttgttttattaatttgcactttgagtattaaattgttaatgacaaattgaaaagtatgttacttatggacacttttaatgtgtttatattattattgcctaatgaataattataccgggatttttttttcttttttgtatatatatatgtatatatatatatatatatatgtatatatagttgttgaagtccgaagaggattcctcatataaacctgtgaagaaagcttgtactcaacttgttgataacctagttgagcacattcttaaatatgaggaatctctagctggtaagacattttatatatatattgatctttagttgattttataagatatttttaaatattttgagtaaatttctcatttttgcctctggctctgcttgtctaatgattacttcacttttaaatgaaatacatttttgttatataggtatctgtttgatgttgcatcctagattatattaagattgactaagattatctagagcattgtaataaaagcatgggcctcacctctttcacatatcttttaatagcatattataattttagatgtcatattgaataggagtaaaaatccaggggctaatatgtatctagctaatgatactcatcacaaaactgatatctcctaagtcatataaaattatgtctcaaaatgaaattgttttagctattataaaaatgttttttaaagatttatattacattcctaatatttattatttataattgttacataaagtttgcttaatcttgagctagaaatttattaaaatgtttaaaatcacaaattatttaagtacttaatattttatattatctcacattatttaccaatcacaaatctgaagttttttaatcaattataaataaatgattacttaagaaatataaaaattgggccaggcgtggtggctcacacctgtaatcccagcactttgggaggccaaggcgggcagatcatgaggtcaggagattgagaccatcctggctaacacaatgaaaccccgtctctactgaaaatacaaaaaaattaaccaggcatggttttgggcgcctgtagtcccagctacttgggaggctgaggcaggagaatggcatgagcccgggaggcagagcttgcagtgagccaagatcacgccactgcactccagcctgggtgacagagggagactccgtctcaaaaaatatatatatatatatgtatatatatatatatatgtatatatagatacatagatagatatagatacccattgcttgaagcgcacaaagactagcattacttcccatctaatgcacattaatgaggaacaacgtcagcctcagttgttctccaaaattgggagccaatagcctctaacagccgtccatttatggcacctacggaagttgttgatatgctttatattttttatgcagtcttttttttttttttccatgtgtacctcttttttttctttttatctccttgttccgtttttttatttttccccatcctggaatttaggggtgatactgatgtcccttaatgttaaaaagttgctaatttcctctaaaaatttgtttcctaagaaccagtgtatttcctgattagcaacattttcttcccacctgaacagcattttgtttagagctgtcttatagcattgttccaatttctgtttgttgctcccattttttaacattcttctactgcaacaacatgtctttttgtaccagtacccttaaacacagtttcacctcagctaaattgctttttttcccatattcacttccttttttttttttttttttttttaaagacagggtctcactctgtcacccaggctggggtgtagtggcgcaatcatagctcaatgcagcctagaactcctgggctgaagcaatcctcccacctcggcctcccgagtaactgagactacaagtgcacatcaccacaccgggctaattttttatttttctgtagagatgcagtttttgcgtgttgtccaggctgatctcagattcctagactcaaaccttcttcctgtgatggcctcccaaagtgctgggattacaggtgtgagccatcacacacagcccattgattttagataaaaccaatacgacatttattcccaaaagcccattcctaagcttcccaatttccattagtataaaacttgccttctatagagagcatggcctcttgttctttatcttgagtattatttctatatcaaagaaaaaatgagatggagaaagtctagtatcataagaactactaattcattatattgaggcctatactggacctatttaggggataatattaagtaatttaaataatattctgtatagtttccactaccttgtcatattttagtgtcttatttctctgtttgtttttccagactctgacaataaaggtgtgaattctggaagattggtagcttgcataaccactttgttcttattcagcaaaataagaccccagctcatggttaaacatgcaatgactatgcaaccataccttaccactaaatgtagtgtaagtatagagctgtcttattcttgtatcttacataaaacattaagtgctttaaatttagagttcacatgcgtcaaccacattctcactgacagatcaactgtgtcatttacttagatatatgtactatttgtagcaagtgatctataaacatcaagtctgacataaataaagttcaggttccattttgctgtaaactcctcaagccaaaccctcagtagatgcttactaaatgttatagctattgttaagatctcaaaatgaatgaagcagagttcctctctttgagaaatttactatcttttgggtcctgaatttacttttcatttgtctgtcatttataatataataaatataaaaattgatacccattgcttgaagcacacaaagactagcattacttcccatctaatgcacattaataaggaacagtagtcaacctcggtcattctccaaaattgagagccagtagcctctaacagaggtccatttatggcacctaaggaaattgttgatatgctttatatttttcatacagtcttttttaattttttatattttataaatatattttatttttataatagaacaatatattaaatatggaaaatctataatatcataccagagatgttaggctgttaatattaacatacactatgtttttctaaaataaggtgtgagtagtaagacattgcttaagtaaaattatccatcaaataaagattttaaagtatatatgacagcatagtgagttacgtggtttacatgtataatgtcatttgctttatgaagtaggtactattatctctgttttacagataaggaaactgaagcttaaagagtataagtaactgctaaaaatttgaaattttaaaatactctaaaaacttaacaaatataaaggtttctcacatactgtgttcctaatgttcctaaggagctaattttaactgtttctctgctgcatttgttttgctgctgtggtcagtttttttgattatccaaattacaagctctaggtgaaaacctcaggacttcctgagaaaactttaagaactgaggagagtagtaaaggataataaatacctaaaaacaacatgcatttacttctgagacactaattctatctttagggttcgtattagatccagaaataaattgtttaataattgtggctaataatagctaataattttttagcacagtaccaagcactgtgaaaattttacatgtattatctcattaactttgtgaagtaagtactattatgatctcagttttacagataaggaaatgaaagcttaaagaatataaataactggcccaatgtcacagagctaagcagtcccaaagttagaattcagccccatgtctgccagtagagtctggactataatgaaacctgttatatattatttatatcataaatagtccttgcatgattttgaaccagtgatttttttaaaacaaaatcacttttaaaatgtcttgtgcattttttatgtatgtatgtacacaaatataaagttgtatataaataagagtatctcatacatggtaaactttttcttaatgttttgtggttttgatttttgtttttatatcctatctccatctttattcatcttcccttcagaataaacatcttagagtatccttaacatacttttatagttgtggacacagaggtatatataaatggttgaccgggttttgtaaaaattgaatcatattatatagatatttgttaggcatatttggtaatctcacattacctggtatatatctaattccttgttttagatggctatatattatccattttatggatgtcctatgatttatttaatcatttccctatttggcaggtgtttacatatttcctttggatcaccactacaaacaatttttaaataaacattccaatttaaatacctaagtactggtgactttattttgttggaacagtttctgagaagtggacttgctaggttgaaacaatggttattttggtgttcatttttaattgatcttgccattttgcagtggatgtgttttatacaaccttttggaaagctgtatgtgacaatcattgtcattatttagtattctttgccagtctaacaggtggtaaggaataattcattattgcttcagtttccttccctgactgcaaagaaggttgagcatcttttcttggtactgaccagtggggcttgcttttctgttaattcactatttatatcattttcatatcattcgttcattttacctttgaataataggcttttttttttaggagagctctttattttagatattaaaccatcttatagtatattcattacaaatattttttcctattctgttctgttgctcttttacttaatggtttccatctttctttaaatttttcttctagaatttaagatatttcttttacttgattttccaggccaggatgttaagggaaggttcagaaaatgctacttttttgttgttatgtggtggtttttttttttttttttttttttttttttgagactgaggctcacactgtcacccaggctggagtgcaatggtgcaatcttggctcactgcaacctctgcctcctggcttcaagcgattctccttcctcagcctcccaagtagctgagattacaggtgcacaccaccacacctggctaattttttgtatttttagtagagacggggtttcactatgttggccagactggtcttgaactccagaccttattgatctgccccgccttggcctcccaaagtactgggattacaggcatgagccactgtgcccggcctatttcttttttttttaagacacagtcttgctctgttgcccaggctggagtacagtcctgcacttctggctgactgcaaccttcgcctcccaggttcaagcgattctcatgccttagccacccaagtagctgggattttacaggtgtgcaccaccacacccggctaatttttgtatttttagtagagacagggaattgccatgttggccaggctggtcttgaactccgggcctcaagtgatctgcctactgtggcctcccaaagagccgggattataggcgtgagccactgtgcccagccactacattttttttttttttaagtaaaatgctagcactggttctcaaatgaatatcttacccaacaaaaattcttctatccctagacccactttaactcattatgggaaacaacaggatttctatgctacttaaaaagaatttatcttttctttttaatcctgtggggatcctaaaaggaaggatgaatatgatgtgggaatttcttttttttgtaattaatactcctacaagccaagtggtgggaatgtttttaactagtgtgttaatgcactcaaaaagtccaaaatgggctgggcacggtggctcacgcctgtaatcccagcactttgggaggccgaggcaggcggatcacgaggtcaggagttcaagaccagcctggccagcatggtgaaaccctgtctctactaaaaatacaaaaattagccaagcatggtggtgcgcacctatagtcccagctcctcgacaggctaaagcaggagaatcgcttgaaccttggaggcggaggttgcagtgagccgagactgtgctactgcacttccgcctgggtgacagaacgaggctctgtgtcaaaaaaaaaagtccaaaatctatgccggtaatccattactaacaatgaggattagtagcttaaaaactagattaaggctggacatgatggctcacacctgtaatcccagcactttgggaggccgaggcaggcagatcacaaagtgtggagtttaagaccagcctggccaatatggtgaaaccccatctctactaaaaatacaaaaattagccaggcgtggtggcaggctagttgtcgatccatattcccgacatgctggtgcttctccttccatgcctccagctactctggaggctgaggagaatcacttgaactcaggaggcggaggttgcagtgagccaagatcgcgccactgcattccagcctggatgacagagcgagactccgtctcaaaaaaaaaaaagaaaggaaaaaaaaaaactagattaaaaacatgcattgaaagccttactacacacacgcgcgcacacacacacacacacacacacatataactttgattgcctttggggaaatgaactgggtggctggaggatagatagaaacaagactttttattgtaaatccttttctaccttttggttttttttaaaaagtctctacctgtttttttaaacatgcttattagtttttctaatcaaagaaataacacatttaaatttaaaataaagaagtcctaggctgagcatggtggcccacacctgtaatcccagtactttgggtggccaaggcaggaggatcacttgaggccaggaattcaaaaccagcctgcgcaacatagtgagaccctgtctctacaaaaatgaaaattaaggccggacgcagtttctcacacctgtaatcccagcactttgggaggccgaggcaggtggatcacgaggtcgtgagtcctagaccagcctggccaagatggtgaaaccccgtctctactaaaaatacaaaaattagccaggcatggtggtgggcgcctgtaatcccagctactcgggtggctgagtcagggggttgcttgaacccgggaggcagaggttgcagtgagccaagatcatgccactgcactccagcctgggcaacagagcaagactctgtctcaaaaaaaaaaaaagacaattaaaaaattaaccgggtgtggtattatgcgcctgtagtcctagctactcgagagactgtcaggaaaatcgctcaagctcaggagcaggattgcattgagctgtgattgtgccactgcactccaacctgggcaattgagcaagactgtgtttcttagaagtaaagaagccttctgcctggttctgggattctacatgtttatctgtcatagaaaattttaacacagggtttctcaacctcagcactattgacaggactagatgattctttgttgtcaaggattgttctgtgcattgcaggttgttaagcagcatccctggcctctatccactagatgccagtagtggctcccattgtgacaaccaaaaatgtctccagatactgccaaatactcctgtgtcaggatacgggggaagaagcttattcctgattgagaactactgggttaacatacacagtttggaaaatactaatcgtaaaaactgtaccagtctttgtataatgctgtcaatatgtaaatacctttgtttagaattgacttgtgttacattttagggaaaaaatataacattgtgattaagtgaccccaaagtcacattttggtaagttagttgtcggtacatattcctgacatgctggtgcttctccttccataccttgaaaaaaaaactctaacagacttttttttttaactggacctttacgtgcaaaatgccctatttctgcccccaaatacgtaaagctgtatatagtttcttttcaggttttggatattcataaagcattaattttattcttatagacgcaaaatgatttcatggttatctgcaatgttgcaaaaatcctagagctagttgtaccactgatggagcatccaagtgaaacttttcttgccactattgaggaagatctaatgaagctcatcatcaaatatggcatgactgtaagcactcagtttaccatttctttattcattagtgtaaagttctaatgtattttattaaaatttttaaagcaaatatttgtaaaaagctaagtttttaaaatagtatatttttaacttttatctaaacattttctatatcttttaggtagtgcaacattgtgtgagctgtcttggagctgttgtaaataaagtgacacaaaattttaaatttgtgtgggcttgtttcaatagatactatggtaagttcaataccagggttttaaaattattctgctaggtcctgcagggggtcagctcattttaaacacatttgataaaaggctagactcgaggaaattatgaggtgtgattatccaccgtggtcctctcagaaacaatattttctagtgtcttttgtatttcctgaagaacccactgtgattacttcagaaatttatctcctgataagtaaagattggtaaattttttgcgcactgtgaaaagtaaaatttaaattttcttacattagtttagactctgaagagcactctcataattctagacatatttaatatttagaaccattagtaaaaattaattggctggggacagtggctcatgcctgtaatcccagcactttgggaggccacggcgggtggattacctgaggtcgggagttcgagatcagcctggccaacatggtgaaaccccgtctctctactaaaaatacaaaaatttgccaggcgtggtggcacacgactgtaatcccagctacttgggaagctgaggcaggagaatcacttgaacacgggaggcggaggttgcagtgagccaagatcatgtcactgcactccagcctgggtgacagtgagactccatctcaaaaaaaaaattgtaattcattagtagtaattacttgaacttagtaattcaaagataaatattataagtaaatattacttatctttattaggtgccatttcaaaattaaaaagtcaacaccaagaggacccaaataacacttcacttctaacaaacaaaccagcacttcttagatcccttttcaccgttggagcactatgtcggcattttgattttgatctggaagattttaaaggcaacagcaaggtaaaggtagtaatacttaaaatgctataaaacatagagctatatggcactgtgatctgagaatgacagtagtgacccaggatgaaggcaacattagagtagtctggtttaatgaaaattctgaaaacagtgctgctcaaaacgtggtcctcagactggctgctaatccatcaactttttgttactggtgtgtaaccagataatgaaatttccctgacaagttatatcagttttgtaacagtagcacactgttgacatcaacagctgactttttaaaaaaaatttttttcaatgaaggaaacaatgcactgatttacattccgaaacaagcttctttgtcacagactgatactttgaatgccactgttctaaaataaatggaattggttacttatttttttaataaagttcacacaaattctcattgttttaaggtatttttttcctttatagttgaaaattaatctaagttactgttcatgaacactttaatgtgttttcctccccttaggttaacataaaagataaagtacttgaactattgatgtattttacaaaacactcagatgaagaagtacaaacaaaagctatcattggtctaggtaagtctaaatttctttataatttgtagctatttgagagggatagagcatatttttaaatattgtgaatctaaattgttgatttactttaatatgtttctattagcagtaggatttggtgtatagaatgtaggtctgaggattaaaacaactgggttgcattcttgtcatggccattgacttcctgggtaaccttgagcaagccatttgtctgttcatcagtttcttcattagtaaaatagagataacaatactttcttctacccctcctccatagggtatcttaagaacatttattaaagccctttgataaagaaaaataatatagaagaattctgtgctctttgcatttttttaattgttctttttcattgcaaagctttgtcactacaggaagctgccacatctggttaaaacaatgatcagtctacactgacttatttatataaaagcaaatagtaagcaacccagaaggaacaatttggatatatacctgttttataatgtttttccaggaaggattgatgtaataaaaacatgttttgcaattgttaggcaggtctatgtggcttatatctaggaaggaattagaatatgaggaaataggaggtgaatggcattaaagtacctgaattgaatgcacttcaaaaaaatacaagaacagtctgtccaggtttttggtttttgttgttgttttttttggtacaaatacagttggccttccatatccatgggtttcacatctgtggatttaaccaccaaggatcaaaaatactgagaaaaaaaaattacacctgtactaaatatgtacagactttttttgttattattctctaaacaatacaacagcaatttacatagcatttacattgtattagatataaataatctagagaagatttaaagtatacgagaggatatgagtagattatatgcaaatactaccccattttatatcagggacttgagaatccacggattttggtatccctgggaggttctggagccaatcccccatggataccgagcaatgactgtacacgtaaagctacccaatgagattaaaaacttatttggaaattttattttggtgttatgattaaggtttatactttaatctgcatgagtagttatttatattagtcttttgaacaaaaatgagtaagaaaagattctaacttacccataccttattaaatcatgtttatgatttctgtaaataaattgaaaccttatcattttattcctcctccatccctttttgaaaattacatatagcacatagagtaaaaattcagacatcatttactaaggagttaaattgatgcaatattaacttcaagccaatgtgtaccttcagatattcagtctggacataatttatacggagtggcaaaactaatagtgttacaagtatttcagagtacaaaaagatgaagttttaacttaagcagcgctattcagaaaatattgcctctagaccagttaataaaagacatcttgcctgggccatagttatcctgagtgaccttgggctagttatctgatcactctatgctttgagtttagtttgttgtttgttaccaataatacttgctatcatcagagatcttcattttttcctcaaataaacattatatacaaataaacatggatgatatattgctacttattaacccgtggttataggattcagcattgtggccttattataatgccatatgaaaaagaaatggaagatatttttagctctggtttattatattgtttcatcaaatgaatatattttaattttttttttaaaataatgtcaatgtagtaccttctgctggggatctgaaaaatgtttgcagacattatttcttaaatcctgaaaacatccctgtgaggtaggtgggtggtaaatattattatccccattttacagatggagaattgaggcacagagagattatgtgactcacccaaggtcacactacaagtcagtggtggagccaggaatagaacccaagactcctgactcctaatccactcccctagccactaggccctgctccctcctcaaggtttcctcttgtgtgaaattctcctttgaaatgcaatttcttgtttttaattcatggggaaagaagtacctgctctaatgcttctctaggtaaggccaccagcatattcttccagtcattttaagttttaattttttgaaataaggagccgtttatataatttattaacatatttattaaatgttttatttaattttaatatgaatatatgatgagatttttcccctctcccataggatttgcctttattcagcatccaagtctaatgttcgagcaagaagtgaagaatctatataataatattttatctgataagaactcctcagtcaatttaaaaatacaagtgttaaaaaacctccagacctacctacaagaagaagatacacgtatgcagcaggcagatagagactgtaagtgaaaatatatttttaaatttcatagctacatttatattataatggctttatcttctttaatctaaatatctaaatttccttatttgttagatgaagaaattcagttaaatagcagtccttatgctgaggtctatagctgggctttagcatattcttaaattctctaaaatagttttaaaattgtatatgtgtgtaaacattaacattttgagggaggaaagagattatagttctcactgggttctcaaaggggcctctgacacagacacacacacacacacacacacactcacacacagattaagaaccattgagccagaacactagctgtaacgttttgtgattttggttatggcctaattttgaaatatttagtaaagttagtataggtgctcttaatgtgtgtttatcctttgcttgcttttgtagggaagaaagttgcaaaacaggaagacttaaaagaaatgggtgatgtttcctcagggatgagtagttccatcatgcagctttatctcaaacaggtgcttgaggcattttttcacacccagtcaagtgtacgccactttgccctaaatgtcattgcattgactctaaatcaaggtcttattcatccagttcaggtaagcatgttttatggcagcagcacttactaaaagagcaagattagttgtaatttgatacattgtgattatagagaataagtagttcttcgttcctcttactcttctttgtactaaactcttaagaatctggcagttttagataatctcttgggttatgattactgcaaaatacccatatattcataatattgtctctgttataaacttgtaatttctattggcagaacatatactcaaattatttttctaagtatgggtgatatatttgttttaattcatatttacttttgtccctaagatccaacaatctataatgtgaagagagttaactgggtttaaaagtataatctgttcaacagggtggagtcttagtccacagaaaagtaaattatataaactcaattccttcatctttaagttgggtataacaccaactactcgacacctcatagcattaatatgaggacacaacgacgtaataaagacattagtgttactgaagattggcagccaatgctgatgtagtagtatataccatctgatggtcaagagagcaccataggctacaaaagtgtatgtattaagtaagcagagtctatacccttcaagatttttattttgggtatttttcatggaacgttttaaaaatatgatttatttaaacatactgtggtcttccctgtgtcctgaaacaaaacatgttaacaaatatttatcctgttcttcatgactccgggctattatcataaagaatcatacattataatgaaacagtagtacattgagactgtcacctttttaaactaccgagggttctttgttgggtgctttttattatatatgccttttaaacttttttttttaatttcacacaaaggagtcaggtgcagtggctcacacatgtaatcccagcactttgggaggcagaggtgggcggatcacttgagtcaggagttcaaaaccagcatagccaacatggcaaaaccccgtctctactaaaaatacaaaaattagccaggtgtggtggcacatgcctgtggtcccagctacatgggaggctgaggcaggaaaattgcttgaacccaggaagcagagaacccaggaagcagaggttgcagtgagctgagaccgtgccattgcactccagcctggccaacagagggagactccatctcaaaaaaaaaaaaaaaaaaattcacacaaagaaattgcaaaagtgatacgatgaattcctttattctcttcacctctattcaccatttgttgacattttgccacaattgctttctctctctccctttatacatctgcttttttctgaatcatttggtaggaagtttcaagtaattatgattctttaccactaaacacttcagcatatattttctaagaacaaggacattctcttacaaaaccgtaatataatcattaaatttgggaagtttaacactgatacaatattatctaatatacagttcatttgcagattctgctagttaaccaagggcgttctctatagcctttttcctcttctttttttttgaggcaagatcttgctctgtttcccaggctggagtgcagtgatgcagtctcagcttacctgcagcctccgcctcctggattcaagcactcttcccacctctgcctcccaagtagctgagactacaggtgtgcgccaccacctggctaatttttgtgtttttgtagagacggggttttaccatgttggccaggctggtctcaaacttctgagctcaagtaatctgcctgcctcagtgtcccaaagtgctgggattacaggcatgagccaccgcacccaccttacagccttttttctttcctgattcgagatttaacatgatcatttctttcatttagtgccatgtctgtattttaaagttaggtttgttgttgtttttctggccttcacattgctttttaattcagactcacttaacatagtagtactgttttttgactctagaagtacagtgaatatgactgttatcaactctctgttcctcaaagccacatctgaaatcaactttgaaaaacaattatattttcgtagctttgagtatggaaaacaaattactgtttgccctatattatctttacaaggcaaattcagtcaagctttaaaaactactggattatacatttgtagtctatatcataatcttaaatagatattcttagtgtgagaatgctttatgtttaaagaacctaaaatttacaatgaaattgtttaaattttatcacgtcagtatttttgctggtgctccagtgctttctggatttaagctgaatctcaaaagatctgtcattttaaaaagaacactaaaacatagactttataggaaggcctataaggttaaattcatatatctcagatatatgaaaagttttgacatatgtctaaatagagaatttttactaccatgatatctcgtaatttttttttttatttccagtgtgtgccatatttaattgctatgggcacagacccagaacctgctatgcggaacaaggctgatcagcaacttgtggaaatagacaaaaaatatgctggattcattcatgtatgtattttaacattttataacctaaatttaaacatttttcttgagtaaagcatttctttgataaatgctctgcccacattcataattggaataaaatgtcttacttagtacctatcttctaaacatgcaactaagttagtcttccaaggtgtttattctagtctaaagttaaggttgggctagaggtgacagtaccaagcacaccagactaaaaatcaggaaacctggattttatatcttactatgtgaacttggctgcagtgactctcctgggcctcattttttttttcttctttgaaatgagggaattgtaagagataatctctaatgttccttctagcacttcattctgtgattcgtattattttaattaaaaaaaaacaatgaagctagcctcagaatgtaatgctctaagtatatttttaatttgtgtcttttaatttccctgacaaaaatgagacttttattgatttcagatgaaagcagtggctggtatgaagatgtcttaccaggtacaacaggcaatcaacacatgcctaaaagatcctgtaaggggtttcagacaagacgagtcctctagcgctttgtgttcacacctttactccatgatccgtggaaaccgccaacacagacgagcctttcttatttctttactcaacctctttgatgacacagcagtaagcacaaaaacttattattttaagaaaataagtgctctagaaattttatggataaagtagtcattttttaaatattaccattttattagtatatgatagtaacttcattaagtgttttcttaatcttctaagttatttacaaagtacacagtcagaagtgaaggggaaattttgtatgagaataagtgtaatgaggaataatgtataattttgcctccatactgaatatcctataaactttgataacagtttctgtaagcgtatctttaaataagcaacatcactaaactaatcgctttgggaaccgattacctcaaatattgttagagaataactgttctaggtttttggctattgagatccctagttgttcaacttgatttcccttaatgaagggaagtcacttttctgtatagtagtccacttttgtgtatagtagtcctcccttatcattaaagatacatttcatgacccccagtggatgcatgaaaccatggatagtactaattattatatatacagtcatgcatcacttaatgacagggatacatttggagaaatgcatagttaggcgatttctttgtggggtgaacatcttacttacacaaacctagatgttgtagcctacctaggctatattgttcctgggctacaaacctgtacagcatgttactgtactgaatactgtagataactataacacaatggtaagtattcatgtacctaaacatatctaaacatagaaaaggtacagtaaaaatatgataggataatcttatgggaccatcatcatatatatagtttgtaattgactgaaacatgttatgtggcacatgactgtactggtttttccaatacatacaaacctatgttaaagttttaatttataaattagtcacagtaagagattaacataataataaaatagaacaattaaaacaatatactgtaataaaagttatgtgaatgggatcttgcttttctctctctctcaaaataccctgttgtagtttactcacctatttttggactatggttgaccaagggtaactgaaactatggaaagcaaaacagcaattggggagattaccataattacaattttgacacttctggctgttgcactagttgcattggccaggaccataggccaagaaaactgaatattctttaaagtttaccttttaatttatttatttcacacagtatttattctgcatctgctatgtaccagccattgcgctaagaagtttaacgagcataaaatagtaaaaacagatatggtttctgcccacacagagcacgcatgaacctatgtgtatagcaacttttaaaagaacaaaagaggccaggagtggtgactcacgcctgtaatcccagcgctttgggaggccaaggcaggtggatcacaaggtcaggagttcgagaccagcctgaccaacatggtgaaaccccatctctactaaaaatataaaaattagccgggcgtggtggcacgcgcctgtaatcccagctactcaggaggctgaggcaggagaattgcttgaacccaggaggcagaggttgcagtgagctgagatcacgccactgcattccagcctggccgacagagcgagactccgtctcaaaaaaaaaaaaaaaaaaagaacaaaagaaatactttaattacttgttagcctgacagcagatttttgcaataaagcaaaattataattaccatagtgcagatatcttactagacctcttcaagtactacatgaaatttatcatcaacattatcatcatatcattatcagtattaagtttgcattgtgtataggacactatacgaggagtgccagatgatataatgtagtgcttttgccctgaaaggattttccctccagctgtggggataggatacaaaattaatagtgattacggttagtatatcctgagtgccctgatggtttgtgttgataatattgttccagtccttgtttctgtccaaaagaacttcatttctatgtgatttcactgcctgctttatgtcattgactagatgttttgtcatctcagcatttgaaatgctaaactggaaacccagctctcacaatgcaatgctttcttctgactacctccaacaaagaatgtcagagaaggaacaaatgcctgaaggcccagagggatagaatgagagggatctgctatataaaccagggaaggaagatgttccagtcagggccaaaaaattaattaaaaatacaaagataagaatgtgtgggaaataatgaatagtttgttatttgactggggcagaaaggtcataatgaggaataatatatagaggatcctgtagatggcaaaaaaaaaaacattgtaagtgtgtgaataaaataatgaggacaattgccaaagagcagtttaggaagatgaatttttttagcattgtggtcacactggaggtaataataaattactatgataacagtaggggagaaaaagaatggatagtagaggctgggtgtggtgcctcatgcctgtaaccccagcatttggggaggccgaggcagatggatcacctgaggtcaggagttcgagaacagcctggccaacatggcaaaatcctctctctcctgaaaatacaaaaaaattagccaggcatgatggcgcgcacctgtagtcccagctacttgggaggctgaggcatgagaatcacttgaacctgggcagcagagattggcagtgagctgagatcgcaccactgcactccagctgagcgacagagcgagactccatctcaacagtaaaaaaaaaaaaaaaaaagaatggatagtagaaaagaaaagaaagttgaggaaagaattaaatgagactgtgtgaaaagaatagttagtggacaactggaatatttttatcttgagcacctgaaacaataataggattgttgccaaagtcagattgcaaaggagttggcttgaggagtacataaaaagggagtagtcaaagaggtaggaagagaaaacttaggaagaagatttcatgaaggaaagtgtgggtaatagtcagatgctactgagaagtcaaggagagtaagaagtgaaaaatagagtagaatggtgaacttcgtggacaaaaacagtcaagcagtgagggacaaaagcagattgtaattgaaaagggagggccaggtgagatgactcatgcttgtaatcccagcacccaaggcagatgatagcttgagcccaggagttccataccagcctgggcaacatagtgagaccctatctctacaaaaattaaaaaataaaaactggacaggcctggtggtatgcacctatactcctagctacctagctactgaagagaccaaggcaaagggattgcttgagcccaggagttcaaggtggcagtgagtggtatcatgtctcctttaaaaaaaaatagtggggaagacatgggaggagcagtctaaactattctttgaagaactttgaaaggaaagagaaatacagggcttttatggatgttgaagaaaatatgtatattttcttcaatattatatgagttttgaaaatatatgaattatagtgttaaaactaatagatgaggtagggttttatgtctacattttttcatctgtaacgtgggtgttgatacatattgtaaagtaaaaatagagtgagagtgatactcttatgaatattaatagcaaggttattccatctgtgctatgggatcttgctgctgctgctgttgggttttatgttgtttccatggcaggggaaggtagatggtaggagtgagtgttttttagttgtgagctttttttttccttgagctataaatatttaaaagaaatttgaatattaatatgcctttctgtttatgatcatgaaatgcttgaattctctattacttctttttaaagcaagcaactaaataatcataatttttctcttaaattttgcctgcctcacagtttttacagtgtgaaactgatagcattgtcaaaacaactctgacattctgaattacatatacacaggaaactgacaaatgtttatgagtacatgggatttgggttttttcttttaacctatgtattagtactataattactagttattttgagggcagaatagtaactgtgtgtaactgatctccatataggttaaactcttagtagcacaatgatataactagaactttcatgtatactttctgatatggtatggatttatcataaagattccatatactctaagaaaacttcaaggaatttcacatggatgcaataaaaaatttcacctcttctcttgagatagcatagtgtaagtcattataaaattaaaaaaaatgggcctaagattattttataaaattccatttctgttcccccttttccctttttgttacacctgtctccctttccctttttcccccctctatatttctctccctcctcctctccctctgtctctctgtgtctctccccactctctccgtgtgtgtctgcttatctctgtctaacattaagtgaggtgaaagtgccctgtattttttctaaaaaaggttttttggttgggtttctagattatccgctaaacatgtgtgctttttcttaaaatttacagaaaacagacgtgactatgctcttgtatatagcagacaatctagcctgttttccataccagacacaggaagagccgttgtttataatgcatcatatagacattacactctcagtttctggtagtaacctactgcagtcattcaaggaggtaagttacacacattactattcttaatccatctgtcaaagtgcaggcatgctgttttcactgttttgtttctcattattctttttatcctcttcacgagtatataaaatctttctaagtgaacttaatgaaatctgggcaatacttgacttgggagaggatgtacattgccactttacctctatttagaaacatctaaaatagatatatggattgttctgttgataagccatcacatttatttctctcactttaagcactgaccttaagtgtttgcatccattcatacattcatttaaactccattttaaaacattattctgtaaatcttgtaatgctgtaatcacaacattacacatgaaaatatatagcttatttacacttaaacagaaaatttatgacaccattgactttcttatccctcaactacagcaccgttatagagtttgcatatgtgtgcccaaaatctttgctaaatttcttgttgaaccttccattgtttctgtcatgacttttaggaggaatgtaatttatttaattataaaagtacctggtgtagcactaggcatatagtaagcactcagtaaattctttacaaattgaatattctcatgtatctaatgatccaagtagatctcattttataaaattgtattgctcacaactcagccttgtcagactagtaaatcagacagattattttagatgcctcctgagggctggaattacagaggtgtcttaaacccttactacttgaagtatagaccacacaccagcagcagtggtttcacctgagagcttattaaagctgtagaacctcaggccccacccagatttgctgaaacagaatctgcatcttcaacaaaatccacagatgttaatgtgcacatttaagtttgagaagttaataatttcccaggagctttagccctcatgttctcttattttacctacttactggtatggctatctttgtaaatgtttcttccacttttgaagaaatgttgttataatgtgccccacacacacacaccacacaaactgcttaagtccagttgactttgtttctaagagctaacattttcataaagtacaaagaaacaggatttaagtcttcagagaaaattgcttattatcttgccgaaatgttcttgaaaaggagagtttgctagaagctgggatgtccaagattactttattctcctcagttaaattataattactgcttttcctcataatgacttacctatgcaccaaattgatacttttataactatcttttattactgtccttagaagaaaattgtttccctttgaatgatatttcagaaggatttttttgaaggagtggttgtaggggagggggtggatattatatataattttatttagttttagaaactatcccctaagattacatatccagttgttgatataaagtcaagaggtttataaaatattagtttaaggaagctttttcaagctgttgaatggagcatacttatatttactagtggcattttgtttttattgtttatcaaacgattttttctttcagtctatggtaaaggacaaaaggaaagagagaaaatcatcacctagtaaggaaaatgagtcaagcgacagtgaagaagaagtttccaggcctcggaagtcacggaaacgtgtagattcagattcagattcagattcagaagacgatataaattcagtgatgaaatgtttgccagaaaattcagctcctttaatcgaatttgcaaatgtgtcccagggtattttattacttctcatgttaaaacaacatttgaagaatctttgtggattttctgataggtaaggttacataagcagtgagagaaaaaacttcactctgttcaaataataaatatttgggctgggtgtggtggctcatgcctgtaatcccaacattttgggaggctgaggcgggcagatcccctgaggtcaggagttcgagaccagcctggccaacatggtgaaacgccatctctattaaaaatacaaaaattagcctagtgtggtggtgcacgcctgtgaccccagctactcaggagactgaggcaggaaaatcgcttaaacctgggaggcggagattgcagtgagctgagattacgccactgcactccagcctgggcaacagagcaagactctgtctaaaaaaataataataaatatgaaacccagttttgtttgcatgcttactttaatgttagaaatgttccttttttaaaaaggagtttattctcttctattgctggatagtattctattgtgtaatatgccataatttatttttattaaagggaaaaaaacatattcctatacttggtgataatgcattacaaattgaaggacttattttgttgatttccttaaaaagactcaagctaaccttaaaatagattacaagtttaagtttttaaagagctctgaagtaacagatgtaaaccaactaaacagagctccagtagaactcaaatagtatttaaagtactctataaagtaagagagagaaaaggtacagctattataaacaccctgtagttttacccaccagtagtcattaaagatacctcttttctgcctgtaaccatggaattttggtcattttttacattcattgaaatctaagattaggaatcacaaaatcaaatgttaataggctacctggtcaatggccaactggaaagagtgtgttgcatgtaaagaggtcatttaagtggacctgtctcaagtttccataagcttgttgccaaaggagagggtaggcataatgtggctagagctcccactttttcaggagacactagaaatccagatttttaagaggaatatctgtatttgcaacagggtctcgctctgatgcccaggtggagtgcagttatgcaatcataaactcctgggctcaagtaatcctcctacttcagccacctgagtagctgggagtacagatgcatgccaccacacccagctaattttttttattttttacttgtagagatgatgtctagttgtgttgctcatggtagtcttgaactcctggcctcaagtgatcctcccacactggcctcccaaaactctgagattataggcatgagccactgctcctggccttataaggaatatcttgatgttaaatgttggcaagatgcaaaataatttaaaaccttgtaaggttttgaggcaatgctaaggagttggaaagatttttaagcagagttgttaataacctgaaacaggtttataaacaatcattctggccactatatagaggatggataggttgggggtgggggagcaactagtagaaagaggtaaaccagttaggtggtattaagtaattgtattgaagctgtcctaggatcacaatagtattaaaaatagacatgagaaactaatttcattaatatggtgcttcctacctataattggatttctccaaatacgttgtttccatagttttaaagtttttggttttgttttcccaaaacagtaaaattcagaagtactctccatctgaatctgcaaaagtatatgataaagcgataaaccgaaaaacaggagttcattttcatccaaaacaaacactggacttcctgcggagtgacatggctaattccaaaatcacagaagaggtgaaaaggagtatagtaaaacagtatctagatgtgagtagtaaaaccaaaagtttttacttctcataagggcttttttgacaagtaaatgtggggggccggtggggagataactatctccttcacattgaatataagcttcatgaactatcaagataatttttctctatcttattttaatgagttactttaagcttgtctttcccattgcacccatggcatcctaattattttttcttaggaaacagcagcccacgaataattttattttagcaaaaatgaaagattataggaaaacctgtgtgtgttttgtagttgtcccctggtatctgcgggaaattggttccagtccccccatggatacccaaatcctccgatattcaagggcctgataaaaaaatggcgtagtgggctgcgtgaggtggctcacacctgtcattccagtgctttgggaggccatggcaggtggatcacttgagctcaggagtttgagaccagcctgggcaacatggcaaatccccgtatctataaaaaatacaaaaaattacctgggggcagtggtgtgcacctgtagtcccagctactcaggaggctgaggcaggagaagtgcttgagcctgagaggcagaggttacagtgacctgagattgcaccattacaccccatactgggtgacaggagtgaaaccctgtctcaaaaaaattatttaaaaagcatagtatttgcatataacctacatacatcctcccatatgctttaagtcatttctagattacttataatacctaatacaatgtaaatgctatatacatagttgttatactgcattttttttaagttgtattttttattgtaatgctgtttgttttgttttgagacggagtttcactcttgttgcccaggctggagtgcaatggcgcgatctcggctcaccgcaacttctgcctcccaggttcaagcaagtctcctgcctcagcctcccgcatagctgggattacaggcgccagccaccacgcccggctaatttttgtatttttagtagagatggggtttcaccatgttggccaggctggtctcaaactcctgacctcaggtgatccgccggcctcccaaagtgctgggattacaggcatgagccaccatacctggccagtgctgttattttttattgtggcattttccaaatagtttttgatccactgtgggttgaatccgcaggtgcggaatccggggatacagagggctatgtttttaattcagaaaaatacatggcttatatgtcataaaaggtaaaactgcaagcagtcattctcttaccgtgtttggctattctgttcctttcttttctgataaccaatattattactttttcgtatgttcttatatgagtaatgccaatatatatatatgtagattttctcacttatcaagtatgcaaatgtatgtatataaaatgtgctttaaaaatagagacagataatagactagaggttaccaaggaccggggaaggaaagaacggggagttattgtttaatgaggacagctgtggtttccagtgattaaaaaaaaaaagaaacagctctggaaatggacagtggtgatagttgtacaatatgccaatgaattatacatttaaaatggttaaactggtaggctggacatgctggcttatacctgtaatcttagcaccttgggaggcctatgtaggaggtttgcttgagtccaggaagtccaggccagcctgagcaacagggtgagaccctgtctctacaaaaaatacaaacattagccagacatggcggtgtgcacctgtagtcccaactgctggggaggctgaggtgggaggaccacctaagcctgggaggtggaggctacagtgagccatgatcgtgccactgcacttcagcctgagtgacagagtgagaccctgtctcaatttaaaaagaaaaaaaaaaagggttaagctggcaaattttatgatatttctattttatcacaatataaaagtttttaaaaatgtttttgaaattagaggactatcctaaaaaataaaaataaagttttatattttaatctacttaatttcaggtgtagtggctcacaagcactttgggaggctgaggtgggcagatcactcgaggccagaggtttgacaccagtttggccaacattgcaaaaccccatttctatttttcttaaaaaaatttttaaaaatctactttaaagcaagtagctgaacataaaataaggttttttgaactaagaatataatctacacagtggcttttcatattattcattgactgcaaaccttactctaaaatttaaaaatattttagttcttatttaaaatttttcaacattctttgctttctcttgtatcgtcttagcagagagcaaagaggggagataactagaaaatgtctatcagtaattatcacctgattgcttgatgacttggaccaagggtctgaaaactctggctgtttttgtatctaacccattgcctgtttttgcaaacaaagttttattgaaaacattcatgcccactcatttatttgtctgtagctgctttcatactacagtggcagagttgggtagttgtgacagactatttgaccttcaaaatgaaaaatatttaccacctggctgtttacagaaaatgtttactagcccctaatttagatgatggctaacgtctgtttcacccacaccaaactactgccatagaaaacatttaggaatttgacaatcttgcttgaaatatttacttaaaattctgaaataatatctgttttttgtagttcaaacttctcatggaacatctggaccctgatgaagaagaagaagaaggggaggtttcagctagcacaaatgctcggaacaaagcaattacctcactgcttggaggaggcagccctaaaaataatacagcagcagagacagaagatgatgaaagtgatggggaggatagaggaggaggcacttcaggggtgaggcggaggaggagtcaacgtatttcgcagcgtattacgtaaaatgatttttatgtgcttatatatgtcagtctattaaatgtacaccaagtaatgtaatacttaaaagagaaaacattttgtagatagagattctctacttacccgtttatacatccttttgtagaaagtttaacataaaagacaataaaaaaacagaaatgagatttatccagcataaagggttaatttttctttgaattgtattaatgtgtgttatttttattgttgctaagttttatgtagctatatggttcatatgtatatataattttatatatcaataagagtaaagacacgggtacaaattaagagttatatggttttacaagtatatgttaaccccttggcgctggcggtcacggtgcgtctcattgccggcaatggaagtgtgccgggaaatcccaactcccggcgtcaagggattaaaagcaataaaaacaataatttcactaaaattcttttgtgtaacacttggtcttttttcccccctcccaatgttttagtcattgagaaggtcaaaacgaaattcagactctacggagttggcagcacagatgaatgaaagtgttgacgtcatggatgtcatcgctatttgctgtccaaagtacaaagatcgaccacaaattgcaagagtagtgcagaaaaccagcagtggcttcagtgttcagtggatggcaggctcctacagtggctcctggactgaggctaagcgccgtgatggccgcaaactggtgccttgggtagacactattaaagagtcagacattatttacaaaaaaattgctctaacgagtgctaataagctgactaataaagttgttcagactttacgatccctgtatgccgccaaggatgggacttccagctaatgaatttgtacatgcagccaaatttacaggaatttttttaaaaggcagaaaaacttgaaataccaacattctggcaaaaaaaaatcagttttatgaagagtaagtggaacctgggatgcaggaacaaaagaaggaaatgttgggcaaacatttttgtgggagctcccttcgctgttgtgcagcagaaacagattctcagttcatttttactcccactgtattatagtttaacaaaaattgtttatatcttggaaaaaaaactttctgtttaaaaaaaataaacaagtgaatgttggaaattagtctgttaatgttcttaataaagtgttcttggagtttaacctagcagcggatggctttctttagcttagcccagtttccagggaagcattgttttttccaggctgtaaaatggcagaatctcctggatatataatttattctgttgaaaaaaaaaaaagcatgcagtatctatgacctatctgcagaaggagtttttgtaaatgtagattttgatgtattaggtcaccctgaaaacaatacaagaaaagggatccccaggtaatctggtggagcgaatactgcaataaatttttttacttctctttgttacttgtctgtttccatttgaatttcttattgtaaaaatctgtttaaatccatttatattattttacagtcttttatgtaaaatttattatatcactggttttcaaagcaaaacataaaatattgtttatacagtttgtataggctgacttctgaataattggtatctattattttcattcccataagagggtgtaaacaattaactccagggttttattgtatcctgcaatatttagtattaactatatatgatttagcactgtgccaaacacattttcaagagtacattttgatataaaaagaaactatagtttattccttgtatgcttcaatttctttctagtgatgtcatgatgctgatatttattctttaaacctcgggtaaaggtaacctgttatttggaaaaccagcatttctcttggttaaaatgatgtccggttattttagaactagagttgagatgaatatgacacttcataattacactcactacatttttcacaaattattttttaatgctgaaaagagtaattttacttgttgagatgtttattcattttctaatctatgctaaaagcttttatcataagtcttgggaacagttgtcatttacacattacttactgcagatatcttgactaaatcaggagggaggtgtttaatcatttgatatgtatagttgacactcaggaatagtaatgcctaaaatttacagtggatgaggtctgtttcaagtttaattctttttaaaaatgttttacttatttttaaatcactttgaaaaaattgacctccagaatgctgttttatgaaattggcaaataaatgaaggtattcaatttttgaggaagaatgacattgccacaaaatacctttttgtgacacctattaaaccactatgaaaataa

SEQ ID NO: 2 - DNA, 167191 bp, Homo sapiens
  source 1..167191: mol_type = genomic DNA
ctgctcagcttggtctgtggtggtggtggtggtggtggtgtgggtttggggtgcggccgggtagggggttcgcctgcggccgcgtctgctcggggcctgaggcctcgaagaccccagcccaagcccccaggtgagccctgcggcaggaggggggttgccttggcctcgggccgaacccagcgggctgagggcaggtgcccagtggatggggagcctgggctgtaacctaagatggaggccgggactgacgcgggcccgagcagggctggcgggacgatcggacaggcctcagccgcgccaggtgccgcctgggttggggttcgagacgcgtagggtgcgggagccgtgtgcggcccgaggccagcgccgtgccccgaggtaggtgaggggatcggaatgccacccacgacgcccgcaggccccgacactccaaggaggcgcgcgaggcccctggggagcccgcctcaggccccgcccgggcagccgggccggcccgtaggccccggccgcgagcgggcgcgcagggggaggggagggggcggcagcggcagctccgctgattgggcggcgctctcacaagcccgacttcacccgccctgaaccccgaagagtgagagaagggaacgcgcgcgctcggtgggggaaggggtgcgcgcgcactcggggcccagccgcacgcgggccggcgcgaggcgctcggtcgcacgcgcggccgcgggggcgcgcgcggtgggggtgtgaggaggaggaggcggcggcggaataggccggggcaggtcgcgctcgctgccttctcccctgaagagagacgcggggggaggggggtgcggcgagcggccccgctctctccccaccgctccgctcgcaccccagtgtaatgagggtcaccccctccccccagctggcccgggagggggcgcggggcacggtaactagtgcgctggggtgggcggcgggcaggcgcgaggagaagggagggaggagggtggccgggcggggaagatggtggtggccgtaaggtgaggggctcgggggagggccaggcgcgatgcggggttggtggccggcggcgctgcagccgccggcctcctccccctccccctcctccatcactaccagccgggctcaggcctagctggccgggctgccgcgaacttcctcccggcgcggcccgtgccccgccggccgcctgcgaacacctcggcctccgcctcccctcaggtagcaggctgcggggcgcggggccggctgccctcccgcagcaaactttgcttgctgctgaatattgatgagagcgatcggctcggctgggaggtgctgccgcggctgcgggaaggagcgcggcccgggcaggcggcggcggcgtcggcagcagccatgtttttcgagctgtagcagctgctgctaccctgactgggcttcgctggccgcctcggtttctccctctgccgggtccaggcctcttcgccctgcagctgcggatccagcaggcctgcattcaggaaggcgagctctggggtgcagccgcctcggccggctcgcctgcggcctgcgcaccgccgctgcaaaggctccggcgctggctgggcgcagggtgcagcgctattgtgaccgctgcgccctagcgagccaggaaggggggggtacctttttgtgcagggtccaggagcccccctcggaccccgcagccttttgcttttgagagatccagctgctcgacccctggcgagggagggggaggactagtcctgtttgagaattgggaattttgacgggcagaggggttttaattttagttcatcccaagtgtccaccagtctacagaggaggaaaaagagacgggctgtttctatgtagcaggatcggcccagcttcgggaaaatggagttttcagaggctcatcgaggccattttttcatctccagtcgggggaactttttctgcccatggaagtgcagcagaaaggcatagaggccactaggccttgaagtggctgccattttaaagagtcgagtcagatggcctattaactcagattaattgctgtgcttttggattccaggttgatgccggcccaggatggatcagacctgtgaactacccagaagaaattgtctgctgcccttttccaatccagtgaatttagatgcccctgaagacaaggacagccctttcggtaatggtcaatccaatttttctgagccacttaatgggtgtactatgcagttatcgactgtcagtggaacatcccaaaatgcttatggacaagattctccatcttgttacattccactgcggagactacaggatttggcctccatgatcaatgtagagtatttaaatgggtctgctgatggatcagaatcctttcaagaccctgaaaaaagtgattcaagagctcagacgccaattgtttgcacttccttgagtcctggtggtcctacagcacttgctatgaaacaggaaccctcttgtaataactcccctgaactccaggtaaaagtaacaaagactatcaagaatggctttctgcactttgagaattttacttgtgtggacgatgcagatgtagattctgaaatggacccagaacagccagtcacagaggatgagagtatagaggagatctttgaggaaactcagaccaatgccacctgcaattatgagactaaatcagagaatggtgtaaaagtggccatgggaagtgaacaagacagcacaccagagagtagacacggtgcagtcaaatcgccattcttgccattagctcctcagactgaaacacagaaaaataagcaaagaaatgaagtggacggcagcaatgaaaaagcagcccttctcccagcccccttttcactaggagacacaaacattacaatagaagagcaattaaactcaataaatttatcttttcaggatgatccagattccagtaccagtacattaggaaacatgctagaattacctggaacttcatcatcatctacttcacaggaattgccatttgtaagcagtttttggtacaacttaaatatatacatatatgtatatatacaggccacttaaagggaaacttgtaacaaatttgtttttggttgcttatcagttcacagctgaaatcctattgctaatcataagctttgggcaaaattttactttgatttttaaatttatctctgttgtatgaatttggttgttttaagctttttccaaataactcttcattgagagtaggctaatgcttttaaaggcatttgattgagttcaggtttaatttctcaagttggaggtatacatatatgattaaaaaaaaaaaaaaaagatgggttttggcctgccagcaccatgagtgcaggtgaaccaatttagtacttggagtcctgttgctatatgtggcagattatttttttacttgatgacttgactcttacttcaggttgaagggcattttgaacacagattaaagtggctaagatgaagttttcttggacattgtcaaaatctaaattaggctagtttttctgaactacctgttttgaaggtatagcatcctgtgcttttgataactgccaccattagctcttttttttttttttgaggtggagtctcactctgttgccaggctggagtgcagtggttgatcactgcaacctctgcctcttgggttcaagcaattctcctgcctcaccctcccgagtagctgggattactggtacccatcaccacgcccggctaatttttgtatcaccattagctcttgaagtttttctagttttgttttgttttattttattttattttaacagaaccctaactaagacaaagttttatatttatttattgtttagagactggccttgtcatgttgcccaggctggcgtcgggactcctgggctcattcgatcctcctgcatcagctagaactacagtagtttcagattttgaagtgtgtatgtgtatgtgtgatatgtatatattccgtgtgtatagaaatggagagtatcttatttgagttgttgttttcagtaatgctgtcaagtattgttagagggtgataaatgataacatttgtttttatttgagcttatgaagaatttcttgactttctagctaaatgatcagttcacttctcttagcctcaattttattgcgtctaaattccagaagttcttgattgctataagattccttcagctttaaatattaatatttgatattgattttgtttctgcccaaacacattgtttggtcaccgccggtaatgttagcaaagagaattttttttggccaacaaatgtctcataccacattcagtttttataagaaaaacttttatggtatgttgttattctgagttcattaaacattcgctttaccttatatccctgctgttctttaaagttacagagggagaatgtgggtgtgtcacttttgtttctgttgatttgtatcttaattatgccttggtactccttggtttcttggcaattgcagatttaaaaaaatttgctttagtggttatcttgagtctgaattgtcctacacattagggtgggtaggctgttttgaaaacctattggcagctcagacaaatcctttttcttgggttcacgttgaaatttattttatatatatatcgtgtctttgtttttgcacataaatttaaatctgagaatggagatagatgtttctctagaagcatacaaatagaattgtaaacctgtttctcgtcaaagagatgttagtggagtattggttctattaaaaaaaaaatgaaggctgagtgtggtggctcacacctgtagtcccagcactttgggaggctgaggtggacagatcacctgaggtcaggagtttgagaccagtctggccaacatggtgaaactccgtctctacaaaaattagccgggcgtgatggtgggcaactgtaatcccagctactcgagaggctgaggcaggagaatcgcttgaacccaggaggcagaggttgcagtgagccaagattgcgccattgcactccatactgggaaataagagtgaaactctgtctcaaaaaaaaaaacaacaaaaaaacaaacaaacaaacaaacaaaaaactgaaaatattggagcctttagatagtaggttacatgtctaaaatgggagttagcaaatgtataaatgtagaagtttttttttcagggagaaattgaaattgctcaaagactttatcaccttgaagaagcaagtatgtagtttatttatttttttgagacacagtcatgctgtcacccaggctggagtgtagtggcgcgatctcagctcacttcaaccacctcctcctgggttcaagcgattctcccacctcagcctcccgagtagctgggactacaggtgtgcaccaccatgcctgactactttttgtatttttattagagacgaggtttcaccatgtgggccaggctggtcttgaactcctgacctcaggtgatccgcccaccttggcctcccaaagtgctgggattacaggcgtgagccaccgtacccatcccctaatttattattttaggaatttggttcaaagttgtgattgaaatctattgcctttatttttgcctttgatatttttaaactgaagacatttttttttttgagacgaagtttcactcttgttgcccaggctggagtgcaatggcatgatctcggctcactgcaatctccgccttctgggttcaagcagttctcctgcctcagccttctgagtagctgggattacaggtgcgcaccaccaccccagctaatttttgtatttttagtagagatggggttttaccatgttggcccagctggtctcgaactcctgacctcaggtgatccacccgcctcagcctcccaaagtgctgggattacaggtgtgagccacggagcccggcctcagactgaggacttaaaaagtgaggtcagggtgggcatggtggctcacgcctgtaatcccagcactttgggaggctgaggcgggtggatcacctgagatgaggatttcaagaccagcctggccaacatggcaaaaccccgtctctactaaaaatacaaaaaattagctaggcatggtggcaggagcctgtaatctcagctatttgggaggctgaggcaggagaatcacttgaacccgggaggctgaggttgcagtgagctgagatcgccccattgcactctagcctgggcaacaagagcgaaactccctctcaagaaaaaaaaaaaccatcctggccgacatggtgaaaccccgtctctactaaaaatacaaaaattagctgggcgtggtggcaggctcgggaggttgaggcaggagaatcacttgaacccgggaggcggaggttgcagtgagccgagattgtgccactgcactccagccttgagacagagggagactccatctcaaaaaaaaaaaaaaaaagcggtcaatcttagaatgcaaagttaggtaagcaatacagcttgagaaaagtgtaattaaaaataacttttctatgtagtcatgtgatattaatgtattcaacttgttcacagttgatttaagttattgatatagtaggtattgttactatgctgggaattttagaaaatccttagcaaattgctatttgtctctttttgtctgtaattttggctgggcttggtggctaacacctgtaattctagcaagttgggaagccgagacaaaaggattgcttggggcccagagtttgaaactagactgggcaacatagtgagatcctgtctctacactcagttggttgtggtggtatgcctgtagtcccagctactcaggaggctgaggcagtagtaggatcacttgaggccagaagtttgagactgcagtgagccatgatcatgccactgcattccagcctaggcaacagagcaagatcctgtcaaaaaaaaaaaaaaaggagaaaattctcttggcagtgggtaagagtagttattagggttgtagatttcctgtctggaattagagaaagaagggtcatattttctgttattttgtgtatctacctctaagtggactgtttgcctcttgtcacgaattagtagcctcttcagtttaccatcatgtgctcttattttctctgcatacagtgaagtgattgtcattacaatttataatcctgacctggtacttttatatttaattgggctgatattttctaattcttcccagtgtacaaaggttttatgctttgttgttgttgttgagacaggctaggtgctttggatgtggagaattaaatgagcatggcattttcagaggatacttgttggagattgcttgggtaggatggatgtagtcaggtaatggggcctagaaattcagactgaagcatttggtattgatgtgatgggaactggcagcccttgagagattttagctgagaagtgatgtaaaatctgtttggaagactttgagtagaggagattagaggcaaggttaggatgtagggtatgttgcaatagtaattaagacttaagaatcggcccagtggcatgtacctgtagtcctagctactctggaggccgaggcaggaggatcacttgaggctgcaattagctgtgattgtgcctgtgaatagccactgcactccaacctaggcaatataatgagattctgtctcttaaaaaaaaaatgagcacagtgagtactctaaagaaagggggtaaatctaaaagattatttcaaagggagaaaattggcagctttttgggggctacctgatctggaggcagattggagtctggatttgaggaatggagagagatgaggcagatgatgtctaaggcttatagttttgctgcctgagacaaaaatgattcctcagaggttccttcctcttctctacccatcatcccacaattttctactccctccttagctatcttggaagaaaattgatctcttcacacctgaggttctgctctctctccgattccctcctggctgggtgaccttttttgtttgtttttgtttttgttttgagacagagtctcactctgtcacccaggctggagtgcagtggggcgatctcggctcactgcaacctctgcctcccaggttcaagcaattctctgcctcagcctctggagtagctgggattacaggcgcccgccaccgcaaccagctaatttttatatttttagtagagacggggtttcaccatcttggccaggctggtcttgaactcctgacctcgtgatccacccgccttggcctcccaaagtgctgggattacaggcgtgagccaccgcgcgcagcctttttttttttttttttttttttttttttaagatgaattcttgctctgttgcccaggctggagtgcagtggtgtgaccttagcccacggcaacctccatctcctgggttcaagagattcttgtgcctcagcctcccaagtagctgggattgcaggcgccctccaccatgcttggctaatttttgtatttttagcagagagaggtttcaccatgttggccaggctggtctcgaacccctaacctcaagtgatccacctgcttcagtctttcaaagtgctggaattacaggtgtgagccaccacgacctgcataccacttctcaaacagtccttttttgcgtccttgttctctttttcttcctctttctctgcagtctcattcactttcattgattctgctgctactccactctatgaaactctcttctgaactgacttcaaaccaacaaattctacttgtcaactaagctgctcctctaccttgtgttatattcacctaaaatgtaatattatttccttttttatttttcctttggacagggtctttctctgtcacccaggctgtagtgcagtggtgccatctcggctcactgcaacctctgccttctgggttcaagtgattctcctgcctcagcctcctaagtagctgggactacaggcgcccaccaccatgcctggctaatttttgtatttttagtagagacagggttttgccatgttggccatgctggtctcaaactcctgacctcaagtgatacgcctgcctctgcttcccaaagtgctgggattacaggcatgagccactgcgcccagcctattattttcattttgaacccatctcttttattgccaaacacgcatttacttctgtgttcatgatgacatcattatcctattcatctcaaagctggaaaccttgcagtcaatcatttaaatgattaaaatacatttgagtacctcttgagccaggcactgccagtataataaaaaataaaaaaattaaaaaaaggaaagagatagtttgcttttaaggaacttcactgtgtggcaaaaactagtgtaaacaatgacaatacagaatactaagtggtctggtaggtgttatgtatgcagtactttgggagtgtggaggaaggcatgcctagaataatcagggaggacttcacagagtggttatttatagtttaagcagagacataccagtaagagggaatagcatatgcaagtggccagaaatccttggctagctatctgggaggagtggggttgtcaggagataaaggtataaagataggcttatatgccgtgctgtatagttgaatgtttttactattacaaaattttacagatgccctcagtttctccctttattcatttttctatgacatctttattgttggtcttcatttagtctttccttccagtctatcctgtgtaaaattacttcctacttccaaaatgagaaatactgggtctctacttaaatttgtaacctaaatgcctcacacctcattttctgaacaaataaagcccaaattcagtgtcctttttgataggatcctgtcctgacctttccaaatctgatgctagagccttgtgtaccctgagttcagccaaactgaactcttaatggtcccttgctccatactctccccttgctcatgcctttattctcctggtctgattcatctttgcatcttaacagtgtatagcatggtgccttctttttactggggacatatcgagttaatgaatgaatgatgctattacagaggtacagtttgggaaggggagtgagtacattttagaaaggtgataagtggattgtcagccttcatcattttcaatggaccaaattactaaaactttacaggttggttggttttttttcttttttcatttcctcatgtactcaatttctaaggctttttgaatttgagcttcctaatatctcatgcattaatttttttctccattctcaactttcactcttttaattaaggataataatttttttttttgagatggagtcttgctctgttgcacaggttcgagggcagtggtgcgatcttggctcactgcaatctccgtctgccgtgttcaagcaattctcctgcctcagcctcctgagtagctgggattacaggtgcatgccaccacgcctggctaatttttgtatttttagaagagatggggtttcaccacgttggttaagctggtcttgaactcctgaccttatggtccgcctgcctcagcctcccaaagtgctgggattacaggcatgagccactgagcctggccaaggataataaattataatggttttaggttggacatctctgactgcatactgcactgtgtttactggaagaagtcccttaatgtctctaaggcccatttcctcagttctaaattacggctagtaccttcattggagggttgttaagtctatgatacaagataactttttttttttttttttttttgagacagagtctctatcgcccaggctggagtgcaaaatggcacgatcttggctcactgcaacctccacctcatgggttcaagttgattctcctgcctcagcctcccaagtagcttggattataggcatgcgccaccatgcccgactaattttgtgtttttagtagagatggggttcaccacgttggccaggctggtcgaactcctgacctcaggtgatcgacccacctcggcctcccaaagttgctaggattacaggtgtgagccatctctcctggccatgatacaagataatttatatgaagtaatacactgctggttctgaagtaggtgtgcagtaagtgatgcctactgctgcatgccaagagtcaaatgtatatttgaaagagttgtgaatttcaagaaagatatttttgagtttttttttttttctttctgagacagggtcttgtactgtttcccaggctagagtgcagtggcctgatcttggctcctggctgggcccaagtgatccaccgccctcagccttccaacgtattgggattacgggaatgagccactgcatttggctaagtttttgtttttttttttctctatttttccaaacttatttgattagtaagataaagacattaactgctgttgacagtttccatttttaattagtaatcaggagcatttgttgtatttttgtttgataatcagaataatttaatttgtgcaataggatcaatagctttctgtattccaactgttaagtggtgtaagtttattacattgttgctttttgcaggttgtcctttgttctagatagaaatgtttaatttattcttcctggttttcaggggagcccattgaaaggagatccagtctctgaaatttagtggtaggataataacaattgaacagttacttttgaatctaatttaaataatctcaattgtagccttttaaagcaattcctatgaacctttttgaatttagaaaagtaatacttggccgggcgcggtggttcacatctataatcccagcactttgggaggctgagggggtggattatctgaggtcaggagttcaagaccagcctggccaacgtagtgaaaccctgtctctactgaaaatacaaaaaaaaattagctgggtgtggtggcacgtgcctgtagtcccagctactcaggaggctgatgcaggaggatcgcttgaacccaggaggcagaggttgcagtaagctgggattgtgccactgcactccagcctgggtgacagagtgagactttgtctcaaaaaaaaaaaaaaaaaagtcaaacttaaaaatggaatataaaaatctcttgatttttgtcagttttcatatactccctcatttacactcttaatattctattagaaattgtctcttctctctacacacccctttttttcccttttggttaatatgttaagacatcttttcatatgagcatgtaacatgtaacaagattttttttttttttttggacagtgtctcgctctgttgctcaggctggagtctagtagtatgatcacaactcactgcagtttagacctcctgtgttaaagtgattctcctactttagcctcatgagtagttgggactacaggcccatgccaccacgcctggctaattaaagaaaaaattatttggtagagacagggtcttgctatgttgcccaggctggtcttgaatttctggcttcaggcaattctcctactctgcatgagccacctcagccgcgaatattttcttattatgaaatttttgtttagataaatgttgattcacatgcagttgtaacaaattccatggccaggctgggcgtggtggctcacgcctgtaatcccagcactttgggaggctgaggtggatcacctgaggttgggagtccaagaccagcctgaccaacatggagaaaccccgtctctactaaaaatacaaaattagccaggcgtgatggtgcgtgcttgtaatcccagctacttgggaggctgaggcagaagaatcacttgaacccgggaggcggaggttgtagtgagccaagatcgtgccattgcactccagcctgggctagaagagcgaaactccatctcaaaaaaaaaaaaaaaaaatcaggaaattccatgggctaggcacagtgacttatgcctgtaatcccagcgttttggaaggctgaggttggaggattgcttgagcccaggagtttgaggctacagtgaacactgactgtgccactgcactccagcctgggtgaccctgtctcttaaaaaaaaaaaagaatacagagaggtcccttgtatattttgcctggttttgcaatggtaatattttgcaaaaaatatctaataccacacaaccagaatattgatgttgatgtacttcaccaatcgttttttttttttttttttgagtcggagtctccatctgatgcccaggctagagtgcagtggctcaatctcggctcactgcaacctccacctcctgggttcaagcaattctcctgcctcagcctcctgagtagctgggactacaggcgtgtgctatgacgcccagctagtttttgtatttttagtagagacggtgtttcaccgtgttatccagggtggtctcaatctcccgaccttgtgatccgcccgcctcagcctcccaaagtgttgggattacaggcttgagccaccgcgtccagccagtcttacttaggcattgacgttcatgtaatttatccatcttattcagatgtccttaaattttatctttttccttaaaagaaatctgtatttctatcaggacattctggatgtccccagttttactggtagtctttcattgtgtgtatattaagttctttgtttttatcacctgtataggttagtatatccatgactcccgtcaactttctaaatgttcgctgggtgcagtggctcatgcctgtaatcccagcactttgggaggctgaggcggctggatcacctgaggtcagtagttcgagaccagtctggccaacatggtgaaaccccgtgtctactaaaaataaaaaaaaaattagctggatatggtgggtcatgcctgtaatcctagctactcgggaggctgaggttggagaatcgcttgaacccaggaggcggaagttgcagtgagctgagatcgcgccgctgcactctagcctgggtgacagagtatgtctctgtctcaaaaaaaaaaaaaaaagttgctaaacatttctaataccataaggatccctgctgttgccagccgttttaaaactacatccatcgtcttcttggcaaccttccatctctttttcgtatgtgacagcgtcttgctctgccgcccaggctggagtgcagtagttgcatctcagctcactgcaccctctgtgtcccaggcttaagcgatcctcccacctcagcctcctgattagctgcgactacaggcacttgccaccatgccccactaatttttgtatgtttttgtagagatggggttttaccatgttgctcaagctcgtcttgaactcgtgagctcaagcaatccgcctgccttggcctcccaaatggctgggattacaggcaggagccaccatgcctggcctagcccctccatctctagcctttgtcagttactaaactttttttcctgaagttttgtcatttcacaaatgttagataaacatgagtcatacagtatgcagccttttgggattgtctttttttcccttagcataatttccaggggattcatctaagttgttgactaaatcaatagttgttttttttgtttgttttttttttgagacggagtttcactcttgtggaccaggctggagtgcaatggcatgatcttggctcactgcaacctccgcctcccaggttcaagcgattctcctgcctcagcctcctgagcagttgggattataggcccctgccaccacacccagctaatttttgtatttttagtagagatggggtttcaccatgttggtcagggtagtcttgaactcctggcctcaagtgatctacctgcattggcctcccaaagtgctgggattacaggtgtgagccactgcgcacggccctagttttttcctttttatcactaagtaatattccatgatacaaatataccatggtttgcttgaccgttcacctgttgaaggacatctggggcaatgctagcttttggtaattaaggtaaaagtactatttatgttcatttatggggttttgtgtgactgtaagttttcacttctctgggataaataccagtagaacaattgcagtattatatggtaatggcatgttaagttttttttttttcctgagagggagtttcgatcttgttgcccaggctggagtgcaattgcgcgatcttggctcgctgcaacctctgcctcctgggttcaagcgattgtcctttctcagcctcgcatgtagctgggattataggtgtcaaccaccacacccagctcatttttgtatttttagtagagatggggtttcactgtgtttgccaggctggtcccaaactcttgaccccaggtgatccaccctcctcagcctcccaaagtgctgggattacaggcgtgagccacggcgccccgccaatgttcagttgtttttttgtttttttgagacaatctctctctgtcacccaggctggagggcagtggcgcgatcctggctcactgcaacctctgcctcccggattcaagcgattatcccgcctcaggctcctgagtagctgggaccacaggtgcacaccaccacaccaggctaatttttttatttttagtagagacggggtttcaccatgttgggtcaggctggtctcgaactcctgacctcaggtgatccacccacctcggcctcccgaagtgctgggattacaggtgtgagccaccacgcctggcccaatgttcagttttataagaaactaccaagctgttttccctagtgtctgtaccatttacattctcactagcagtatatgagtgatccagtttcttttattttttgttttttgagacggagtctcgccctgttgcccaggctgaagtgcagtggcacgatctcggctcactgcaacctctgcttcccggcttcaagtgattctcctgcatcagcctcccaagtagctgggattacaggcatgtgcaccatgcctggctaattttttgtatttttagtagagatagggtttcaccatgttggccaggctggtctcgaactcctgacctcaggtaatccacccatcttggcttcccaaagtcctgggatttcaggcatgagccattgcacctggccgagtgcttcagtttctatgcatcctcaccagcatttggtgtggtcactattttaattttagccattcgtgtagatatgtagtaatgtctcatctcattatgttttgtttttttttttgagacggaatgttgctcttgttgcccagactggagtgcagtgatgccatctcggttcactgcaacctccacctgctgagttcaagcaattctcgtgcgtcagcctctggagtagctgggattataggtgtgcatcaccacgcctggctaatttttgtattttttagtagacatggggtttcaccacgttggccaggctgttcttgaactcctgacctcaggtgagctgcccacctcggcctcccaaagtgctgggattacagttttgtatggtggattccatgcagagagagttttttctgtagtctagattagcagtccccagcctttttggcaccagggaccaaattcctgggaaacagtttttccacaggtgggagtgggatggtttggggatgaaacttttccaccttagattatcacgcattagttagaatctcataagaagcgcgcaacctagatcccttgcatttgcagttcacaatagggttcatgatcctctgagaatctaatgccacccctgatgtgacaggagtgggagctcaggcgataatgctcccttgtctgctgttcacctcctgctatgcagcccggttcctaacaggctgagaggaccagtaccattctgtggcctgggcgttggggacccctgttctagatgatccacattcttttaaatgcctatatacaaaccatactttctttatttcttttctttttttgagacagtcttactctgtcacccaggctagagtgcaattgcgtgatcttggcacactgcaacctctgcctcccaagttcaagtgattctcctgcctcagcctcccgagtagttaggactacaggtgtgtcccaccatgcctggctaattttttatatttgtattttttaatttttatttatttatttatttttttgagatggagtctcgctctgtcacgcaagctggaatgcaatggcacgatctcggctcactgcaacctccgcctcccgagctcaagcgattctcctgcctcagcctcctgtgtagctgggattacaggcacccgccacgacgcctggcttttttgtatttttgtagagacaggttttcactgtgttgtccgttctggtctcaaactcctgagttcagggaatccaccgccttggcctcccaaagtgctgggattacagtcgtgagccaccgcgccctgccacaaaccatactttgaaaacgttgcttccatttttagataatttgttaggaaaccaataaaatcatacatacttgtgattttcccttagtaaaacacaaattttagtgttttttgctgttattattaatacttctaaagttcctttcacattgctagtgaccttatataaaataccataatgctcttctagcaattgctggaaagataaaatctattttagagaatgaacaattatattttcacattagattaaattaaaagtaattactggttatgtgatattccctcacataccagagtgagtctgaaggtagtctttctttgtaaattatgaggctatatttcctgtgttatctctgatttctcttgatgctgtaattggagttgttgggtctccctggtgaaagtaggtgatgtgcaagttgtgtctatacccagtgaaaataacagacattaatgctacactaatttgtcattggaattttacattcaaaagcatttctttttaaaaatatgattgtaaattggtaatttatagttgtatataccaaaggcatttctttaacgttatagttggttcaactgaaaatacgttaagtctgtttttataattagtatattgaggaacagcacttccatcgtgtcacaatatattaagaattgccagcagggcacggtggctcacgcctataatcccagcactttgggaggcctaggcgggaggatcacctgaagccaggagtcgagaccagcctggctaacgtggccaaacccctatctactaaaaatacaaaaattagccaggtgtgatggcgggtgcctgtagtcccagctactcgggaggctgaggcaggagaatccagaattgaattgaacccaggagacggaggttgcagtgagccaagattgtgccattgcactccagcctggacaacacagcgagactcagtcttttttatttttatttttatttttgagacggagtttcgctcttgttgcccaggctggagtgcaatggcacagtctcggctccctgcaacttctgcctcccgggttcaagcgattcacctacctcagcctcccgactagctgggattacaggcatgtgccaccacgcccggctaatttttgtatttttagtagagatgggatttctccatgttggtcagacttgtctcggactcccaacctctggtgatctgcccgcctcggcttcccaaagtgctgggattacaggcatgagccaccgtgcgtgtccttttttttttttttatcttttgagacagggtctcactctgttggctaggctggagtgcagtgatgcagtcacaactcactgcagcctcaacctcccagtctcaagcaatacccccacctctgcccctttgagtaggctgggactacaggtgtgtgccttcatacctagctaattttttttgttttgttttttgagacagtcttgccccatcgcccaggctggagtgcagtggtgccatctcggctcactgaaagctccgcctcccgggttcacgccattctcctgcctcagcctcccgagtaactgggaccacaggtgcccgccaccacacccggctaattttttgtatttttagtagagacggggtttcaccatgttagccaggatagtctcgttctcctgacctcatgatccgcctgccttggcctcccaaagtgctgggattacaggtgtgagccactgcacctggccatgcccagctaatttttgtatttttttgtagggatgggatggcactatgttccctaggctagtctttaattcttgggttcaagtggtcctcctgcctcggcctcccaaagtgttgggattacaggtgtgagccactgtgccgagccaggttgtgtgtgtgtgtatgtatgtatgtatgtatgtatgtatgtatgtatgtatgtttgtatatatttatatttatttttttggaactgcatctcactttcatccaggcccgaatgcagtgacatgatctcagctcactgcaacttctgcctcctgggttcaagcgattctttttttttttttttttttttgagacggagtctccctctgtcgccaggttcactgcaagctctggctcccgggttcacgccattctcctgcctcagcctcccaagtagctgggactacagatgcccaccagcatgcctggctaattttttgtatttttagtagagatggggtttcactggggtttcaccatgttagccaggatggtcttgatctcctgaccttgtgatccgcccgcctctgcttcccaaagtgctgggattacaggcgtgagccactgcgcctggccatttcttttttttttttggcaagtgattcttgtgcctcagcctcccgagtagctgaaattataggcgtgtgccctcaacgcctgggtaatttttgtatttttagtagagacagggtttcaccatgttggacaggctggtctcaaactcctggcctcaagtgatccaccctcctcagcctcccaaagtgctgggataacagctgtgagccaccgtgcccttcccaggttttatatttattcttttttccttttaaattatgtttttatttaggtattgtacgtaaagtgcttttctaacagagctttggggcagaagtgttagggcaggtcattaaaccactgaaattagttctttggaggagaagataattgttagagttgtaagtgaagtcttgatagataccttatcaatttcatagtaatgtctgtggaatttctttttctgttttttttttttttaattatttcttgaggattaactgctgatagtggaatatcatatatatagttggctcttgatgtacttatttctggatggctttccaaaaggattttaccattttacacacagttctaaatagtatatgaatttagcatttgtcccacacttagatagcactgatttttttttttattaagtgggtgcaaaatgctactacaagattgctttaattactacagttttattgatgaaaatgatttctacttgtttactgtttgtatttttttctaggagttttgtgtctatattctttgctgatgtatctttttggatttaatgttttatacatattaaatttctgtctcattggatataaatattttcccaatctggttttcattttagttaatgattttctgtagttgtatagtcaaagtttcatttattatatagctagatctgtgttttcgagtgatttattgattcaaagcttattgtgcttctagatatttgataaactgactttagactcttgtaaaaatttgaagaactcatatctactacagtcttactgatttaataggggttttaatatccagtactatgctaataatttttatagtgtttttacgacaattttttgagaacataagtttttagagctgtggatggaatgttttctgctctatcagttatcccttctgcgtaacagacccctaagtgtagcagcttagaggagtaaatatttattatctcacattttgtaaggaatcatggagtggcttagctggatggtgctggctcagtctctctaatgaatttacagtcaagatgtctgccagggctgcggtctctgaaggctgtaggatccctgtccaagacggctcactcatatggatgctagctctttgtatgaggcctgttctttcccacttgcacttctccataggcctgcttactgtatggtagctggcttttcccggagtgagtgatccaagagacagggacagaccaagcaggaagatgcagtaactttttatgatgtgtattctattggctggccacacataccaagcagatagggaagggattacacaaaggcatgaataccatcaggctgggataattgggggccagcttggaatctggctaccatatccaaccaaataagaaattaatagttttaattaaaggaaaaggattatattaaatagacattcgttagtttttacttttaagctgacccaatcatttttcagattgaagttttgaatagatatatgattaaaaaatacatgaaaagttaaccagtgaagtgacctctgtgccatgtttgctcaggtaacgcacctccaattcttgtgctttcccggagaccaccttttttaagagaaaggtagtggactgtgcacacttggtcttcctttttcacataatggtgtatgttgaaatctttccattttagagcatagctttccctttttaattttattattattattatttttgagacagagtctccctctgtcgccccagctggaatgcaatggtgcgatctcggctcactgcaacctccagctcctgggttcaagtgattctcctgcctcagccacctgagtagctgggattacagtcgcctgccaccatgctcggctaatttttgtatttttagtagcgacggggtttcaccatgttggccaggctggtctcgaactcctgacctcaggttatccacctacctcagcctcccaaagtgctgggattacaggcgtgaggcaccgtgcccggcaattttttttttttgagtcagagtcttgttctgttgcccaagttggagtgcagtggtttgatctcggctcactgcaacctgtacctcctgggttcaagtgattctcctgcctcagcctcccgagtagctgggactacaggcatgccccaccatgcttggctaattttgtattttagtagagactaggtttctccatgttggtcaggctcgtgtcaaactccctacctcaggggatccgcccaccttggcctcccaaagtgctgggattatagacgttagccaccgcgcctggcctaatttttgtattttcagtagaaatttttgtatttcactgtattggtcaggctggtctggaactcctgagctcaggtgatccacccgcctcggcctcccaaagtgctgggataacaggagtgagccactaggtgtgacctaatttttgtatttttagtagagatgggatttcaccatgtcggctaagctggtctcgaactcctgacctcaggtgatctgcctgccttggcctcccaatgtgctgggattataggcataagccaccgcactggctttttttttttttttttttttaaacctggatggttttattttgcatgaatgtatagatatttcctgttcatacattctgaaagtgaacaactgtatatatgcaatttatttttattcttatttatttatttgtttattttttgagaccagagtctcactctgtcgcccaggctagagtgcaatgacacaatctcggttcactgcaacctctgcctcctgggttaagcaattcttctgcctcagcttccccagtagctgggattacaggtgtccgctaatttttgtatttttacaaaatacacccaggtaattttttgtaattttggtagagacaggtttcaccatgtcggccaggctggtctcgaactcctgacctcaggtgatatgcccgactcagcctcccaaagtgctgggattacaggtgtgagccactgcgtctggcctgcatggggattcttaatgaagattaattattgtagttgagggggaaaaggaataataaatatttattggaccctaaataccttcgaatatggaataccctaggtattctagggcatttagggaccaataaatatttattcctccgtactcttccctcgctcttttcagatttttttttttttttttttttttttgagatggagtcttgctctgtctccaggctggagtgcagtggcgcgatcttggctcactgcaacctctgcctcctgggttgaagtgattctcttgcctcagcctcctgagtggctgggactacaggtgcataccactatgcccagctaatttttgtattttttgtagagacaggctttcaccatgttggccaggatggtctcgttctttagacctcgtgatctgtcttcctcagcctcccaaagtgttggaattacaggcgtaagcctccgccgggccttttttagatttttaagagaatttttgttaaagcatgaacttaaaaaatcagacttggcttggagcggtggctcatggcctctagtcccaggactttgggtggctgaggcaagtggattgcttgagcccaggagttcaagacctgccttggcaataatatcaagaccccctcttcatgaaaaacaatcaagctaatacttgatactattttacataagaattttttatagtatgtcatgttttaatgtatattggttatatagttgcaaatttaaaggcatggtggtggctcatacctgtaatcccagcactttgggaggctggggcgggcagatcttctgaggtcaggagttcaagaccagcctggccaacatggtggaaccccgtcttaggctgaggcaggagaatagcttgtgcccaggaggcagaggttgctttgagctgagatcgcaccacggcattccagcctggaggacagagcgagactctgtctctaaataaataaataaataaataaatgtatactaactgcattagcaagactccgtctctaaataaataagtgaataaataaatgtatactaattgcattttaaaaatcaaagtataggccgggtacggtggctcacaactgtaatcctagcacttttggaggctgaggtggatggatcacctgaggtcaggagtttgagaccagcctgaccaacatggtgaaactttgtctctactaaaaatacaaaattagctggtgtggtggcgcatggctgtaatcccagctactcgggaggctgaggtaggagaattgcttgaacctgagaggtggaggttgtggtgagcggagatcgtgctgttgcactccagcctgggcaacaagagcgaaacttcgtctccaagaaaaaaaaaatatataattcacataagataaaattcaccctctttggccaggcgcagtggctcatgcctgtaatcccagcactttgggaggtagaggtgggcagatcacttgaggtcagggagtttgagaccagcctggccaacatggtgaaaccccatctctactaaaaatacaaaaattagcccggtgtggtggcatacacctgtaatccacctactcaggacgctgagtctgcactcagtccctgggctacagggtgaaactgtatctcaaaaataaagaataaaatgcagctacttaaagggtgtagagttgaacaactgttaccactgtctaattccagaacctttcatcaccccaaaagaaaacccattcccagcagtcatttcccattaagtctcctctagcccctcacaaccactaatctaattcatgtttctatgtatttgcctattctaggcgtttcatacaaatacagtcatataatttgtggcctttcgtgtctgacttgtttaacttagcataatgttttaaggcccatttatgttgttgtatgtatgcatacttcattccattttactgctgaatattgctttgtactgatgccactttttgtttgtcttttcatcacttgacggacattttgtttcttccactttgtggctgttacaggcagtgctactgtgaaaatttgtattaaagttttagcgtgaatatatgttttcagttctcttgggaaaatacctagaagtggtattgtcggatcatagggtcattctatgtttagcattttgaggaacagccagactgttttacatagtggttgcaccgttttacagtcctactttagcctatatgggttctaatttctttctttctttctttctttctttctttctttctttctttctttctttctttctttctttcttttctttcttttctttcttttctttcttttctttctttctttctttctttttttagaacagagtctccctctgtagcccaggctggagtgcagtggcatggtcttggctcactgcagcctccgcctctcgggttcaagcaattctctgcctcagcctcccaagtagcttggactacaggcgcccgccaccacgcctggctaatgtttgtatttttggtagtgacagggtttcaccacattggccaggttggtcttgaactcctgacctcaggtgattcacccacctcggcctcccaaagtgccgagattacaggcatgagccactgcatccgggcgtgggttctaaattcttaatattctcatcaacatttattgctgtctttttaattttagcctgtaatcccagctactagggcgactgaggtggtagcatcgcttgagcccaggaagctgaggctgcagtgagccaagattgcaccactgcactccaggctaggtgatgaagtgagacttcatctcaaaaaaaaaaaaaaggaagtaatggcaaaaactggaattattttgcaccaacttaaatatttagatctttaatacctttggaaagttttttatatatagtttgtgtgtgtgtgtgtgtatatatacacacatatatatatacacacacatatatacacacatatatatgaatgattttatatatatatatatatatatatatatgaatgatatatatatatatatatgaatgaatgaatgagatggagtctcactctgtcacccaggcaggagtgcagtggtgccattttggcttatggcagcctccgcctccggggttcaagtgattcttgtacctcagcctcccgagttgctgggattacaggcactcgccaccatgcccggattttttgtcttaattcatgaaggatgaattaagtctgcagttgttctttttccctttttctttccagtttttttttttgtttgtttgtttgtttttgagacacagtctcactcggttgtccaggctggagtgcggtggcagtatcttggctccctgtaacccatctccctggttcaagcgattccggtgcctcagcttcccaagtagctaggattacaggtgtgtgacaccacacctggttaatttttgtatttttagtagagacgaggtttcaccgcattggttaggttggtctcaaaactcctgacctcaggtgaaccgcccacctaagccttccaaagtgctgagattacatgcatgagccaccaagtctggcctaagtctgaatttttttttttttttttttgagacggagtttcgctcttgttgcccaggctggagtgcaatggtgcgatcttggctaaccgcaacctccgcctcccacgttcaagcaattctgcctcagcctcccgagtagctgggattgcaggcatataccaccacgcctggctaattttgtatttttgttagagatggggtttctccgtgttgagactggtctcgaactcctgacctcaggtgatccgcctgcctcggcctcccaaagtgctgggattacaggtgtgaaccactgcacccggccgaatatatttttttttttttaaatggagtctcgctctgtggcccaggctggaatgcagcggtgtgatcttagctcactgcaacctctgcctccctggctcaagcgattctcctgcttcagcctcctgagtacctgggaccacaggtgtgcaccaccatgcctgaataatttttttgtgtttttgtagagatggagtttcaccatgttggccaggctgatcttgaactactgacctcaggtgatgtgcctgcctccgccttcccaagtgctgggattacaggcatgagctactgtacccggctaagtgtacagtgttcttgtgatgtctttgtctggtgttggtatcagggtaatactgtcttcaagattacccttgaatgagctttacttcattttttaatgtgtttttttttcttttcttttgttttttgtttttgagacagagtttcactctgtcgcacaggctggaatccacactctaggctcgctgcagcctccacctcccaggttcaagagattctcctgtgtcagcctcttgagtagctggggttacaggcacgtgccacgacgcccggctgatttttttgtatttttagtagtgacgggctttcaccatgttggccaggctggtctcgaactcctgacatcaagtgacctgccttcctcagcctcccaaagtgttgggattacaggagtgagccactgtgccccgcctgcaattacttcttaagttctcaattaaaagagagtttatcaaggactttttttggtaattttgcattttgaaaattgctaacattaactgggacagcccttttatttatttatttgtcactcagttgtttttttgagttgcctactatgtcccaggcactggtaagataggagtatcattgtacctgaggcagggcaacatgtgcttgcttgagaggagcatgatctaggattataaggactgcaacctccccttcccaggttgaagcagttctcatgcctcagcctcccaagtagctgggactacagccatgagccaccacgcccagctaatttttgtgtttttagtagagatgaggtttccccatgttggccaggctagtctcaacttctggacctcaggtgatctgcccacttcagcctcccaaagtgctgaaattacaggagtaattttattctcccaaagctgctgctttgggagaataaaaagttgagtatgggccaggcatgggggctgatgcctgtgatcgcagcactttaggagactgaggtgggagtctagcttgagcccagtagtttgagacaagcctggggaacatagggagatccggcctctacaaaaaaaataaattagctgggtggagtggcatgtgcctgtggtcccagctacttgggtggttgaggtgggaagatatctgagctcaggagttccaggctgcagtgagctctgattatgcactccagcctgggtgacagagtgagatgctgtctcaaaaaaaaaaattcagtgtggcgtgattaggctgggagggtggggcaggaagggatgacattggaggggtaggcaaggtgtagatagacctttccctatattctcctatttttaaaaaatttttttctaaatagagatagggtcttactattttgcccaggctgggtctcaaactcctgggctcaagtaatccttccatctaggcctctattttttgtgcaaacgattgaaattatattttttttacctgaatttttcctgtgaacattgggttatttataaacctgttttctgtttctttctttctttttttttttttttgtttttgttttttgagatagagtccagcctggagtgctgtggcatgatcttggcacacttgcaacctctgcctcctgggttcaggtgattctcctcctctagcctcctccacgcctggctaatatttgtatttttagtagagatggggtttcaccatgttggccgggctgttcttgaactcctggtttcaacagatccacctgcctcagcctgccaaagtgctgagattacaggtgtgagccactgttctaggcacttgtttctgtttcttaattttggctgctactcagtgggaaaaagcacagattgaatctaattgaggccgggcgctgtggctcactcctgtaatttcagcactttgggaggctgaggtgggcagatcacctgagatccagagttcgagactagcctggccaacatggggaaacctcatctctactaaaaacacaaaaattagttgggcgtggtggctcatggctgtagtcccagctactcgggaggctgaggcatgagaattgcttcaacccgggaggtggaggttgcagtgagctgagatcaggacactgccctccaggttgggcaagagagtgagactcggtcttaaaaaaaaaaaaaaatctagttgaaaaatgtcatcgggtctttccaaatttttactaggaatttgttaaaattaaccaggctggaagtcattatagtttgtttgtttgtttgtttgagatgggggtctcactctgtcacgcaggctggagttcagtggtaggatctcggctcactgcaacctctgcatcccagattcaagcgatcctctcacctctgcctcatgagtagttggaaccacaggcatgtgtcaccatgcttttgtagagacagggtttctttcgccctattggctaggctggtctcaaacttgtgagctcaagcgatccgcccaccttggcctcccaaagtgctgggattacaggcatgagttaccttgccttgcccattatagcttttttgaggctgggtcttactctctgtcatgcaggctggactgcagtggtgtgatctaagctcactgcctcctgggctcaagcagtcctcccacctcagcctcctgagtagctggcacaggcgctacctcacccatctaattttttattttttttagagatggggttttgccatgtttgcccaggctggtctagaattcatgagctcaagtgatctacctgcctcggcctcccaatgtgctgggattacagacatgagccactatgttcagccatacctggctaatttttaaaaaatgttttcaagagacagggtctccctgtgttgcccaggttggtctcaagttcctgggattactgctggccttcaaaagtaaatgtgaaataattagttaatttctccctcagttgacaaataatgccaaaagtgataaagattaatgaaatgtctcttttttttttttttttttgagacggagtctcgttctgttgccaagtctggaatgcagtggcacgatctcggctcactgcaacgtccacctactgggttcaagtgattctcctgcctcagcctcccgagtagctgggactacaggcacgcatcaccatgcccggctaatttttgtatttttagtagagacggggtttcactatgttggccaggctggtcttgaactcctgacctcatgatccacccaccttggcctcccaaagtgctgggattacaggcatgagccaccgcgcccagccatgaaatttcttacgtagaaaggcagcttgggattgtagaaagaatgtaggctttggagttggacaggcctccatttgagaccatacttgagtcccgtgcttgccttagacaaagaacctctcaaccttagtttttaatctataaggtgttttgaaaattaattcctagttcagtacatggcacatggtaggtacctgctgctatccataattctcttagttaatatattcggtgccacatgccaggcagccaggatctgtactaagcacctaataagtattatctcatttaatcctcaaaagaaccccacctgagttgctagacagccattatttcagggttacacattaggaaattgaagcttagagagatttaagtggttagccaagtgatggtgctggtattccaactaaggtcatctgctttcagagcatttactttctgttaggctgcctctcctgttgcaaagtactaagaacacaactacataatgtatttttagtggattcttgtctttttgtaaatagaaggttaaaatgagaggaattttttttttgtttgggagacgtggtctcgctctgatgagagctagaaatttgattacttgtatttctggtctgcataaaaatttggcctaaaaacatcaatagaaaggcaagtgtcatctgcaaatctgtcccatcctgttcttcacaggaaaatgtaaccttttttttttttttttctttttttgagatggagtctagctctgttgcccaagctggagtgcaatggcatggtttcccgctcactgcaacctctgccttctgggttctagcagttctcctgcctcagcctcctgagtagctgggattacaggcgcctgccaccatgcctggctaatttttgtatttttagtagagacagggtttcaccatgttggccaggctggtctttaactcctgacctcaggtgatccgcctgcctcggcctcccaaagtgctgggatcacaggtgtgagccactgcgcccgggctcaaaatgtaacgtctgtctagtatgaggatttatttccttgtctgacttctgagttgtaatcgtttattaacaatcacattgtaagtttatctatgaagtaataaaatgttctttctgtatattatactggaaatgaatgcttcattcaaaaaatagttttatcttgggaaggtagccactttttaaaaattgaggtaaaacggccaggcacggtggctcacgcccataattccagcactttgggaggccaaggtgggtggagatcacctgaggtcagaagttcaagaccagcctggccaatatggtgaaactccatctctactaaaatacaaaaattagaccggcatggtggcaggtgcctgtaatcccagctactcaggaagctgaggcaggagaatcgcttgaacccaggaggtggaggttacagtgagccgagatcctgccgctgcattgaagcctgggtgagaagagcgaaactctgtctcattaaaaaaaaaaaaaaagaggtaaaatttaaataacttaaggctgattgtattggcttacacttgtaattccagcattttgggagaccaaggcaggaggatcacttgaactcagaagtttgagaccagcctggtcaacatagggaaacctcatctccacaaaaaataaaaaataaaatataaaaacttcaaaattaaataagttacagttcaccattgtaaccattttattttatcctatttattttgagacagtcttgttttgtcacccaggctggagtacagtggtgggatcacagctcactacagcctccaccttccaggttcaagtgattcttctgcctcagcctctgtaactgggattacaggtgcttgccaccacaccctgctaatttttgtattttgattagagacagggtttcaccatgttggcccgattggtctcgaactcctgagctcaagtgatctgcctgtcttggcctcccaaaatgagccaccgtgcctgtccccttagtctactttaaaattcaatttgccttttttttaaattgtaagaattccttatatattttggatattaaatccttaactagggatatgattcgcaaatttttttcccccattctgtttctgtaggctctttgacattctttttctttctctttttgagacaaggtcttactctgttgcccaggctagagtacagtggtgtgatcatagcttactacagcctcgacttccctgggctgaagcaatccttacctcccacctcagcctcccaggtaaccaggactacaggtgtacaccaccatgcctggcaaatcactgttgttgttgttgttgttgttatagccataggctcccactgtgttgcccaggctgggctcaagcaatcttctagccttctagccttggcctcccgaagtggtgggattatgcgcatgatcgctgctcccagcccacaatctttttttttttttttttgagatggagtctcgctctgtcacccaggctggagtgcggtggcgcaatctcggctcattgcaacctccgcctcccgggttcaagcgattctcctgcctcagcctcccgagtggctgggattacaggcacgtgctgccacgcccagctaatttttgtattttttttttagaagagatggggtttcaccatattggccaggatggtctcgaactcctgacctcatgatatgcccaccttggcctcccaaagtgccgggattacaggcatgagccaccgcgcctggcctcccagcccacattcttgataattttctttgcttctaaaagttttgcttttagggttgggcaaggtggcttatgcctataatcctagcactttgggaggctgaggtgggcggatctcttgagctcaggagttcaagaacaccctgagcaacatggaaaaaccgtgtctctacaaaaaatgcaaaaattagccaagtgtggtggcatgcacctgtagtctgagctactggggaggctgtgacaggaggatcacttgaattggactggaggctgcagtgagtgaaaatggtaccactgcactccagcctgggtaatagagtgagatgctgtctgaaaaaaaaaaaaagttttagtttttttgggtggggggattttaacttcacctattttttttgttgttgctcagttttgttgttcaatctatgaatcctttgccagatctgaaattatgaacccttatccctaaattttcttataaaagttttgtagttttagctcttatatttaggcccttgataacattttgagttactttttttttttttttttccctgagatggagtctcgttctgtcgcccaggctgtagtggcgcgatctcggctcactgacatggctgcttcctgggttcaagcaattctcttgcctcagcctcctgagtagctggggttacagtcacgtgccaccatgcccagctaattgttttgtgtaattttagtagagatggggtttcagcattttggccagggtggtcttgaacacctgacctcaagtgatctgcccacctcggcctcccaaagtgctgggattacaggtgtgagctactgggcaaggctgtgccagaccttgagttactttttatatattgaatgaggcataagccaaagtttattaggtgatccagttttctcagtaccatgtgttgaagagactattattctttttccattgaattcaaaagagactaattttttaacattcctttgaaatgctattctttttccattgactattgttttctccgtgtcaaaaatttattgaatatggccgggtgtggtggctcacacctgtaatcccagcactttgggaggccgaggtgggtggatcacctgaggtcaggagtttgagaccagtctgtccaacatggtgaaacccatttctactaaaaatacaaaattagccaggcttggtggcgcatgcctgtaatcccagctacttgggaggctgaggcaggagaatcgcttgaacctgggaggcagaggttgcggtgagccgagatcgcgccattgcactccagcctgggcaacaagagcaaaactctatctcaaaaaaaaaaaaatatatttgtgaggctttatttctgaagttttaattttattccattggtctatatttctactcgtaggctactagtacacactgtttttgattactgtagctgaattctgcttctgcgagttcttcagtcttattttattttccagtacagatggtctcagatatacgatggttttacttagagtttttgaacttcatggtgggcttatctggacgtaagcacatagtaagtcgagcatctgcagttaacaatggttcaacttaacgatattttcgacttatgatgggttaatcaggatgtaaccccattgtgagttgaggagcatctgtattgttttggctgtttaggcttcctacagttgcatatgatttttactttttggcggaggtgtccggtattgaatgaacctagggcctcatgcatagagttccatatgaatttgaggttagctttttcatttctctaaataggccattggaattttcatcgggattccactgaatctgtaaatgattttagggagtattgccattttaacaacacagtattaaaaattccaagtaatgaacttgggatgtcttcccatttctttaggtctttaatttcctttcaataatgttttgtaattttcactgtataagacttttcacagcctaggttaaatttattcataggtacaaacagttgttaattcccacagttttacttaatgattttttaactttatgatagggtttactggaggattgaatgcattttcaacttatgatatttttgacttatgatgggtttgttgggacttagccctgttgtaatttgagaagcatctatctgtgtgtctttcttttggatcctgttaagtgggattttttgctcagtttcctttttggattgttcattgctttttttttttttttttcttttttccggagacagagtctcactttgtcgcccaggctggagtgcaatggcgtgatcttggctcactgcagcctctgcctcccgggttcaagtgatttctcctgccccaccctcccaagtagctgggattacaggtgcccaccaccacgcccagctcatttttgtatttttagtagagatggagcttcaccatgttggtcaggctggtctcgaactcctgatctcaggtgatccacctgccttggcctcccaaagtgctgggattgctggcatgagccaccatgcccgaccagtgtgtttatacctgtagcgtaaaaatccatgcttcaggatttgatgagtcttggaaagcattttctgcatcctgctggttgtggaagcgtttttcctgcaaaaaagtagttgagatgcttgaagaagtggtagtcagttgcagagaggtcaggtcaatatggaggatgaggcaaaacttcgtagcctaatttgttcaacttttgaagcattgtttgtgcaacgtgtagttgggcattgtcatgaataattgggcccttttagttgaccaatgccggctgcaggcactgcagttttccttgcatctcattgatttgctgagaatacttctcagctgcagtggtattcagaaagctgtagtggatcaaccagcagcagaccaccaagcagtgaccatgacctttttttggtgcaagtttggtttgggaagtgctttggagctgctgcttaagtctatccactgagctggtcattgctggttgtcagataaaatccacttttcattgcatgccacagtccgattgagaaatggtaaacgacgactttttttttagtttttgctcagctgatgaggcacccacttattgagctttttcacttttccaatttgcttcaaatgctgaacgaccgtagaatggtcgacgttgagctcttcgacaacttcttgggtaagttgtaataggatcagcttcgatgattgctctcaattggtcgttgtcaacttcccatggccggctactactcctcatcttcaagggtctcgcctgcttcgcaaaacttcttgaaccaccactgcactgtacgtttgtttgaagttcctggggcaaacgtgttgttgatgttgtgaattgtctccactgctttatgacccattttgaacctgagtaagaaaattgctcaaatttgctttttgtctagcatcatttccatagtgtgaaataaacataaaataaacaagtaataagtctttagcaaaaataacataaagcaagaaagtgcccattaaaatgatatataacataaccacatttatttaagaatgtattccaatatcaaattgcaaattccaacagtgcaaaaactgcaattacttctgtaccaacctaatagtttgcttagtgtttttatcatgaaaaggtattagatttttaaaatgttttttctgtctgttgaggttatcatgtgttattttgctttgttgtattattgtggtgtataattttttttgagacggggtcttgctctgtcgcccaggctggagtgcagtggcgcgatctctgctcactgcaagctccacatctcgggttcacgccattctcctgcctcagcctcccgagtagctgggactacaggcgcccgccaccacgcccggctaatttttttttgtatttttagtagagatggggtttcaccgtgttagccaggatggtcttgatctcctgacctcgtgatctgcccgcctccgcctcccaaagtgctgggattacaggtgtgagccaccgcgcccagctgtggtgtataatttatttttttttctttttttggtgggagtcagtaccctttttgtttttgtaaagtatgcatgattttatttaatttttttttttagagacggagtctcgctctgtcgcccaggctggagtgcagtggcgtgatctcggctcactgcaacctccgcctcccgggttcaagcaattctcctgcctcagcctcctgagtagctgggactacaggcgcatgccaccatgcccggctaattttttttgtattttagtagagacggggtttcaccatgttgcccaggctggtctccaactcctgagctcaggcaatccgcctgcctcagcttcctgaagtgctaggattacaggcgtgagccactgcgcctggccaacttcattttttatttttttggaaagtgtacgtgacttcctattcatccatttggaagtgtacaattcagtgcattacatgtattcacagtgttatataatcattttctataccaaagtttttcaatatccccaacataaactatccattaaatagtaattcctaatagttccctattcctactccttggtaacctaaattctttctctccctttgaatttgcctgttttattttagataatataagtagtatcatataatatttatctgtttatatctggcttattaacataaagtggagccaattttagcacatttttgtcacttcaaaatgaaaccttcttgcttgataatttaccatgttaaaaaaaaaaaaaaaggaaaccgggcggggcgtggtggctcaggcctgtaatcccaggactttgggaggccgaggtggacagatcacaaggtcaagagattgagaccgtcctggccaacgtggtgaaaccgtctctaataaaaatacaaaaattagtagtgcgcctgtagtcccagctactcaggaggctgaggaaggagaatcgcttgaaccaggggggcagagattgcagtgagccaagatcacgccgctgcactccagcctggcgacagagcgagactccgtctccaaaaaaaaaaaaggaaaccttgtacgctttagttaccatcctcctacaccttaacttccctgcccctaagtaaccattatactattgcctgtctctacatccctctatttgagactcatatgaatgaaattatataatatgtagacttttgttactgtttttttctattagcatgatgttttgcaggtttatccttatttagcatgtatcagcggccacataatacttcattgtatggatatttcacattttgttatccattcatcagttgatggtcatcatcccaaacaagaactctgtacttattgaatgattctcctttcctccctttgtctattttggccattttgtagtaactctatttgcctatcctaggtattttatttaagtggagtcatacagtatttgtctatttgtgtctggtgtatttcacttagcataatgctgtcaaggtttttgcatgttgtagtgtgtatcaggacttctttttcatggttgaatgatcttccatcttgtaaataataacacattgtattatccatttgtgatggacatttgagttgatttcaccttttcgacaatgtaaataatgtcgctatgaacatgggtgtgcaaatatctgtttgagtctctgccttcagttctttttggtatatgcttagcagcagaatagctgggtcacatggtaattccatacttaactcttagaggaagtccgccccttcctttcttaagtctttgctgtatacctttgaagggtttccctagtttatataattgcttgtgatagtttttcccctatttattgactgttttgggggagatactggcccttgaagttcatgacgactccatttcctctgatgtcactataaacacttttgactgtggcagcctttgctaaaaatatttttggatcctggatgtggtagttcatgcctattataatcctagcactttgggaggccaaggtgggagaatttcttgagttgggagttagagacacttttggagtttgtttttttataattgtcttttttttttccatctcagtcttaaagttatttcttcaaagacataattgtgcttaggctttgatgctttcatcaggtaaaatgaaataaagactgaatctgatgaataaataaaactagtagataacagcttctaagtgtgactttgaagtaacatgaatggtttttatcatatgatacatagaaatgacttcttagtggtaatatatggcaggatttggcaaactagcctgcagtccaaatatggctaaaagctgtttttgtacaaccagtgagccaacaatagtttttacatttgtgaatcgctgaggcaaaatccaaaggaaaatattttgaggccgggtatggtggttcacgtatataatcccagcattttgagaggttgaggtgggaggatggcttgggcccaggacttggagaccagcctaggcaacatagtgagatcctgtctctaaaaattttttttaaaaactagctgggcatggtggtacataccttgtagtccctgctagttgggaggctgaggtgggaggatcacttgagtctggtatgttgaggctgtagtgagctgagatcctgccactgtactctagcctgggtaacagagcgagaccctgtctcaaaaaaaaaaaaaaaaaaaaagaatattttgtatcatgttagaattaaattaagccgggcgcggtggctcacgtgtaatcccatcactttgggaggcctaggtgggcagatcacgaggtcaggagatcgaaaccatcctggctaacacagtaaaacctgtctctactaaaaatacaaaaaattagccgggcgtggtggcaggtgcctgtagtcccagctactcgggaggctgaggcaggagaatggcgtgaacccgggaggcggagcttacagtgagccgagatagcgccactgcactccagccttggcgaaagagctagactctgtctcaaaaaaaaaaaaaaaaaaaagaattatatgaaattaaaacttcagtaactacaagaagtctattggaatgttgccactaatatgttgtctggctgcttttgtgctgtgatgggaggattgagtaatttcgagtgtatgtcttacattgcagaatctaaaatatttactatctggcttttttttttttttttttttttttgcgacggagtttcactcttgttgccgaggctggagtgcaatggcacgatctcggctcaccgcaacctctgccttctgggttcaagcaattctcctgcctcagcctcctgagtagctggggttacaggcacgtgccaccacacccagctaattttgtatttttagtagagacgggatttccccatgttggtcaggctggtctcgaacttttgacctaacatatctgcccgcctgggcctcccaaagtgccgggattacaggcatgagccactgcacctggcctactatctggctcttatacagaaaaaagtttatcgacgtgtgtgattgtcacaggttattattgattggtcttctgagaacaatagtcattcatatgtgttctaatgcgactgccaaaatattatttcataagcacatttaatatgttaacttttaatggatgaagcagtaatttggtagttaaatgaacattaattcaacttgctttggttagtgggaaggatattttagtgttattttcatattcacattatcctgctggtcagcattcctttttattctcctccttggtcgtcagaaaagaggttaaaaaggccgggcgcggtggctcacgcctgtaatcccagcactttgggagtccgaggcgggtggatcacgaggtcaagagatcgagaccatcctggccaacatggtgaaaccccgtctttattaaaaatacaaaaattagcagggcgtggtggtgccccagctacttgggatgctgaggcaagagaatcacttaaacgcgggaggcggaggttgcagtgagccgagatcgcgccactgcactctggcctgggcaacaagagcgagacagattacaggcgcacgccaccttgccaagctaatttttgtggttttagtagagacagggcttcgccatgttggccaggctggtctcgaactcccaacctcagatgatcgcctcccaccttggcctccccaagtgctgggattacaagcgtgagccactgcacccggccagaagttattatataatcaatgcaccattgcccaaaatacttatctgaattttttttttttgacacggagtcttgctcttgtcacccaggctggagtgcaatggcgtgatcttggctcactgcaacccctgcctcctgggttcaagcaattcttctgcctcagcctcctgagtagctgggattacaggtgcccactacaacgcccggctaatttttctttgtatttttggtagagatggagtttcaccatgttggccaggctggtatgaaactcctgagctcaggtgatctgcccacctcggcctcccaaagtgctgggattacaggtatgagccaccgtgcctggccttatctgacttttttttttttttttttttgggacagtctcgctctgtcacccaggctggagtgcagtggcgctatcttggcccactgcaagctctgcctcctgggttcacgccattctcctgcctcagcctcccgagtagctaggactacaggcacccgccaccacgcccggctaattttttgtatttttagtagagacggggtttcaccgtgttagtcaagatggtctcgatctcctgacctcgtgatccactcgcctcagcctcccaaagtgctgggattataggcgtgagccactacacccggcctgacttttaagccattgtatttattatatcattgatttagttttgggcaaatgtggtcacagaagatttggacaaatgttgtcacaaaaggttatgcttaattttccgtaatttatttcggcagtgagtaggaagaaaatttgaatgcgtatatgttacagacagtctttttgaggctggggacgtggctcacacctgtaatctcagcactctgtgaggccagtgcaggaggatcgcttgaacccttgagtttgaaaccagcctcggcaacatggcaaaacctcatctctaaaaaaaaaaattttaaatttagccaggctggtggcatgtgtcattagtcccagcgacttggtggggctgaggtgggaggatcacttgagctcaataggtataattttcagtgagctgtgattaggccacagcacattagcctgagtgacagagtgagaatctgccttaaaaaaaataaagtatttgaaagccttcttcagaggttattcttggaaaagcaaataatattatagccttgagtataatagtgtcatatcatttaagccatatggaaaataatactttgtatgaaaatagtaacatctagagtagttttattaataaaatactctccagatggcaagtgatagatacatcctgtttcgattttacaacaaagcatgtttgtgatataaacattattcgattgcaaaaattcttttttttttttttgaaatggagtcttgccctgtcacccatgttggagtgcagtggcgccatctcggctcactgcaacctctgcctcctgggttcaagtgattctcctgcctcagtttcctgagtagctgggattataggcacatgccaacatgcccagctaatttttgtagttttagtagagacagggttttaccatgttgaccaggctggtctcgaactcctgacctgaagtgatctacctgcctcggcctcccaaagtgctgggattgcaggccttagccactgcgcccggcccgattgcaaaaatcgtaacatttcagtgacttcagtgttttgaaattgagggattaaaatctaagatctaaatattcgattcttcttccttttttttttttgagatggagtttcacgctttttgcctaggctggagtgcaatggcacgatctcggctcactgcaacatccacctcccaggttcaagcaatttttgaatcccatagtgctgtgttgggattacaggtgtgatccaccatgcctggctattcttttttttttttttcttctttttaaagagacagtatcttgctctgtggcccaggctagagtgccgtggcagtcatggcttactgcagtcctgaactcctgtgcttaagcaatcctctcacttcagccttctgagtagctagtaccacaggcacacaccaccacacccgaccccattattgttctattgatgtttataactgtataattagtatataatctgcatttaccagaaatctgtaaaatctggttatgtcattacttttcctgattattggtacagttaaaacctagaaaggctcattcatataagggatacattgtgttggaagagcttataacaactttgttttatattttgccaaaaagcctttggattctttagctcgagggtgtagtccagattccaggtccaacttctagagttctggaggagtggcagatatccatttcttggggatcagtcagaagtgagctcattaattaattggaaactttttgttttggatgtttcagtggtaaatgaaaacaataccccctactagaattattgtgaggattctgttacattatgtgtgaaagaactgattacaggtgtcacaaattactttcttactcattaatttattaattatgtgctatgcactgttttgttttgtttttgagacagggtctctgttgtccaggctggagtatagctgtgcagtgtttttaagtgctgggaatactgtgatgagcagaatagacattgtgtctgccctcatggatccttcagtaaagtgagaaaggcaaacatcaaacaaggattgggcctggcacagtggctaatgcctgtaatcccagcactttgggaggctgaggtgggtgggtcacttgaggtcaggagttcaagaccagccttgccaacctggtgaaaccccctctctactaaaaatacaaaaattagccaggtgtggtggtgcatgtctcccagctgctcgggaggctgaggcaggagaatcgcttgaacccaggaggcagaggttgcagtgagccgagattgtgccactccactccagtctgggtgacagagcaagactctttctcccaaaaacaacaaaaaacaaaacaaaacaaaaaaacagcaacaacaacaaggattgcttgagcctgggaggttgaggctggagtgagcgatgaccatgccactgcactccagcctgggtgacagattcattcataccctgtctttcaaagaaaaaaatatcagtattagattgtatgttcacaattatatgtgtgagaacctatatgtatgggaactctttgtgccaaccagtgcccagagttttctctctgctctgattactctctcaactctctcaaattgccttttaaagaaatctttatttctgttaagattttagagctatttgtttttggtttttgcttaattttttgcatattctgttaatgcaaaaaattgcattaaattattattattatttttgagatagaatcttgctctgtcgcccaggctggtgtgcagtggagcagttttggctcactgcaacctccaccttccgggttcaagtgattctcatactacaacctcctgagtagctggaactacaggcatgcgctgccacgcctggctaatttttttgtatttttagtagagacagtttcatcatgttggccaggctggcctcaaactcttgggcctcaagtgatctgcccaccttggcctgctaaagtgcttgaattatagatgtgagccccactcctggctgcattaaaatattttaatagacatttgattgattgattgattgatttatgagatggagttttgctgttgttgcctaggctggagtgcaatggcgggatctcggctcaccacaacctccgcctcccgggttcaagtgattctcctgcctcagcctcctgagtagctgggattacaggcatgcaccaccaagcctggctaattttgtatttttagtagagatggggtttctccatgttggtcgggctggtcttgaactcccgaccttaggtgatccacctgcctcggcctgccaaagtgttgggattacaggcgtaagccaccgcacccggcctttaatagacatgttttaaatttataaggattaagaaaaacccctaaaaataaaaaacaaatttataatgattttatagttaaaaggttttgttgttgagacagggtcttaccctgtcactgaagctagagtgcagtggagtgatcacagctcactgcatcctcgacctcctcggcttaagtgatccttgtttaatgtttgtttttaagaacattaaaaagtgctttgttgaaagtgtttggtttagcacatttttattgattactgagtaggtgctggagtttaaaacatgaataagacaaaaaaaatgaatagaaaataagattattgcctctgctgttgagactcttagagtgtggtattaatatcaatgtaatgtgtcaagtgcagtaaaaagaggtatgcacaaggggatccagagccttaagtaggggtaaagtagacccaagagatgtttctttgagctgagttatgaagtataagtagctattagccagataggaaaatgaagcgtgccttagattgtaaagtatgatcaagtgcatggaggtgtgatagcataagatttatgtgaactacaaagtgtaaatcgtgtgatggaacttggtcatagtttttcctagggtaggagtcagattaggaagggctttatttttcatcctaggaccttggatttaagtgttttttttgtttgttttgttttttttgagacagagtttcactcttattgcccaggctgaagtacaatggcaggatctcagctcaccataacctccgcctcctgggttcaagcaattctcctgcctcagcctccctagtagcagggattataggcatgcgccaccacgcccagctgattttgtgtttttagtagaaacaagggttctccatgttggtcagactggtctcgaactcctgacctctggtgatccgcccacttcagcctcccaaagtgctgggattataggcgtgagccactgtgcccagctagttttgttttttaaatttttatgtttccaaataaatcatacacagagcacaagtataaaacatagaaaaaaagatggagctgctttgacttggaatgtggagcagccagctttcttatcaccctcttgggtagcctacaaggggctctcatgagcactatctcagaggaacacaatttgaaaactacctctgtgatggaatttcaacagaaggattttgagaagtccagaggaattgattaactaatgattaattgtaaaatgcattcttagagttggaaataagttggtgtgatatgtgggagatggggaagggggccaatcaggtatgtctgggctattaagaaaattgttacttctattctttagtctattaagatataattaatatttttattttttatttttttgagacttgccctgtcgctcaggctggggtgcagtggtgtggtctgggctgactgcaatctccacctccaggtttcaagcgattctcctgccttagcctcctgggtagctgggattacaggcacctgccaacacgcctggctaatttttgtttttttattttttattttatttatttatttttttttttgagacagagtctcgctgtgttgcccaggctggagtgcagtggcacgatcttggctcactgcaacctccgcctcctggattcaagtgattctcctgcctcagcctcccaagtagctgcgattacaggcacatgccaccacgcctagctaatttttttgtatttttagtaaagacagggtttcagcatgttcatcatgtttgccaggctggtctcaaactcctgacctcaagtgagccgcccaccttggcctcccaaagtgctgggattacaggcatgagccactgcacctggcctactcaccgtttcaatgaatgtcataccttggtatctcgagggtcttgctatgttagtcaggctggtcttgaattccttggctcaagtgatccacctgcctcggcctcccagagttttgggattacaggcatgagccactgcctgtaaacttgtagtgactttgccctttgcttagtctgttaattactgagagaggtttttcccaccctgtgattataattttgttatgtgtcctggtatctcttgtttttctttttattatttatttatttattttatttatttgtttattttgagatggagtctcgctctgttgcccaggctagagtgcagtgacatgatctcagctcactgcatcctccgcctcccgggttcaagcgattctcctgcctcagcctcccaagtagctgggattacaggcgcatgccaccatgcctggctaatttttgcatttttagtacagacagggttttgccttgttatccaggctggtcttgaactcctgacctcatgatccacccgcctcggcctcccaaagtgctgggattacaggcgtgagccaccgtgcccggctgatgatgatattttaacagatgaagagttgcattttgtagatgagcaaaaaaatgtggtttcttttttttttttttgagatggagtctccctttgtagctcaggctggagtgcagtggtgtgatctcagctcactgcaaactccgcctcccaggttctcctgcctcagcctccctaatagctgggactacaggcacctgccaccaaagtacgagaatcacttgaattcgggaaggaagtttgcagtgagccgagattgtgccactgcactccatcctcggtgacagtgacagagcaagactgtctccagaaaacacccaaaaagagagaaagaagctctactgtgcataaaatactatcaaatggcattgaatgctacagagaaatcaggaaaggaagagtcaatcgtcaatccatgtgggaaacttcattatgggtttttttttggttttttttttttttttttggcaggttctcaccttgtcacccaggctggagcgcattggcacaatctcatctcactgcaacctccaactcgcgggttcaagtgattctcctgcctcagcctcctgaatagctgggattacaggtgcctgccagtatgcctggctaattttttgtagtttttgtagagatgaggttttgccatgttgtctaagctgttttgaactcctgacctcaagtgatctgccctccttggcctcccaaagtgctgggattacaggtgtgagccactgtgcttggctgcattgtggtcttactttaagaaattgctgtggtgggttctgtgctatttcctgtaatcccagcaccttgagaggccaaggcaggtggatcacttgagcccaggagtttgaggccatccggggaaacataaaaatttaaaaaattagccaggcgcagtggctcacgcctgtaatcccagcactttgggaggcccaggtgggcggatcacgaggtcaggagatcgagaccatcctggctaacacggtgaaaccctgtctctactaaaaatacaaaaaattagccaggcatggtggcgggcgtctgtagtcctagctactcgggaggccgaggtaggagaatggtgtgaacccgggaggtggagcttgcagtgagtggagatcgcgccaccgcactccagcctgggtgacagagtgagactccgtctcaaaaaaaaaaaaaaaattagctggtcatagtggtatgcacttttagtcccagttacttgggaggccaatgctagaggaccgctggaacccaggaggcagaggctacagtgagttgtttttgtcccactgcattccagcttgggcaacagttgagtgagactctgtctcagcaaaaacaaacaaacaaaaaacagaaattgccacagccattctgaccttcagcaagcagccatgaacactgaggcaagaccctccatcagcataaagcttgcagctcagatgatcattttttagagacagggttttgctctctttcccaggctcaagtacagtgataaaaccgtagcttgctgtaacctgaaaatcctggactcaagtgattgttttgcctagaactacaaggttgtgccagcacccccaactaagtctggctttgttttttcctcccctcccttcccctcccctccccgctttttaaaatttttattttatttttattttttcaaatgggatctcgctctgtcacctaggctggagtgcaatggcgcaatctcagctcactgtaaccttccatctcccgggttcgagtgattctcctgcctcagcctactgagtaactgggattacaggcgcctgccattacgcctggctaatttttgtatttttagtagagacagggtttcaccacgttagtcaggctggtctcgaactcctgacctcaggtgatccgcccacctcggcctcccaaagtgctggcattacaggcgtgagccaccgtgcctggcctctttttttgtttttttaagtaaagatgaggtctcacttatattgccaagtatggtcctgaagtcctaggcccgagcagtcttcctgccttggcttccgaaagtgctgggattacaggtgtgaacccccacaaccagcctcagttaaggggtaaaatttttttgtttgtttttttagtgatgagttcttgttatattgcccaggctggatattcttttcttttagcactatatattttttcccccaaatttatacattgaatacaacaaagcattcttaatttgttatttttaatatataatgctattgtacacagactattgtgtagtgtaaatctaacttttatatatgtattgtgaaattgaagcattctcgtgactcactttatcgcaatatttgcattgttgtggtagtcttgaaaccgaacctgtagtatctccaaggtatgcttttgcaagtttttgtatggacatgtgttttcattattcttgggtattgtatacctaggagtagagttactgcatcatatggtcattctgtgtttaagaaaaaattttattttcaatgtttgtgtatatatatttatgatatacatgagatattttggtacagacatgcaatatgtaataattacattagggtaaatggagttaccatcccctcaaggatttatcctttgtgttacaatctaattataccctttttcttattttaaaatatacagttaaattattatcaacctgttgtgctatcaaattctagttcttattcattatttctaacttttttttggacttactgaatcatctgttcttttgttttctttaaccgtcctcacttccatctttctacttcccttcctagcttctagtaaccatttttctgttgtctatcagcatgagttctattgttttaatttttagttcccactaataagtgagaacacatgaagttggtctttctgtgcctgacttatttcatctaacataatgatctccagttccatctatgttgttgcaaatgataggatctcattctttttcatggctgaataacactccattatgtatatgtaccacatttgctttatttattcatctgttgaacacttaggttatttccaaatcttggctattgtgaacagtgctgcaataaacatgggagggcaaatgtctatttgaaatactgatttccttttctgtatatagctagtcgtgggattgctggatcaaatggtagctctatttttagttttttgaggaacctccaaactgttgtctagatttgtactaatttacattcctaccaacaacgtatgagggttcccttttctccacatccttttattcttttcttttggataaaagccattttatctgtttgagatggtatctcattgtagttttgatttgcatttctctgatgatcagtgatactgagcaccttgtcatattcttgtttgccattcgtatgtctttttgagtaatttctattcagattttttgtccatttttaggaaaactttaatttgattgttatatttttcttttagatttgtttgatatcctcacatagtctagttacttgttttgggtttttttttctcttggagacagggtctcactctgtcacttaggctggtgtgcagtggggcagtcatggctcagtgcagccttgacctcccaagctcacgcatccctcccagtttaccctcccaagttgctgaaactacaggtgtgtgctaccatgtctgcctggtgtgggtgtgtgtgggtgtgtgtgtgcacgcaaggatgggatctcgccaaagttgatcttgaaatcctggcctcgagcgatcacccaccttggcctcccaaagtgctaggattgtgcaggcctgagccaccacgcctggccttttcttgtttataaatgagattatgtatttatacttgggttgatttgatgacgttattcttaaatatgggtagtttaagctgtggaaaagttttagtaggctttggatatcatataaatcaagcatctaaacggatgtgtttttgtcttatatattgctgtcgtctctttataacaacttaatattatgggagtttttggtaactaaaacaataactgagtccttagagttgcgataatttctatgataattgttatgtaaagcattagtacttcccccacttcccctcgtctttacctcaagttgtgtatcactatagattctcagcaagtttttctaaaaaactgtggctgggtgcagtggctcatgcctgtaatcccagtactttaggagggcgatttgggtggattgattgagctcaggagtttgggaccagcctgggcatcatggtgaaaccctgtctctacaaaaaatataaatgccaggtgctgtggctcacgtctgtaatcccagcacttgggaggcggaggctggtggatcacctgaggtcaggagttcgagaccagcctggccaacatggtgaaaccctgtctctcctaaaaatacaaaaattagccgggcatggtggcaggcgcctgtaatcccagctactcgggaggctgaggcaggagaatcgcttgaacccaggaggcggaggttgcattgagttgagattgtgccattgcactccagcctgggggatgagagcgagactgtctcaaaaaaacaaaaccaaatatatatttgcttttttgtttgtttttttgagacagagaccaaatatatattatatatatatataatatatatttgttttttattataatatatatacattatatattatatattatatatattttatatattatatataatatattttatatatttatatattatatatgtatattatatatatatatatataaatttatatatataatatataagttttatatatttaaatatatattatatattatatatttatataattaatatatataatatatttatatattttatataattatatatatttatatatataaataaatatatataatatagttatatatttatatataactatattatatattatatattttatattatataatttatattatatattatatattatatattttttatatatataatatataatataacatataatatatgttatatataatatattatatataacatatattatattatatgtatatttatatataatatatatatgtaaatcagcccagtgtggtggtgtgcgtttgtagtcccaactacctgggagcctgagggggaaggattgcttgagcccaggaggtggaagctgcaatgggctgtgatcacaccattgcactctagcctgcattacatagggagaccctgtctcagaaacgaaaaagaaaaaattgttgcactatggctattttttaatatttagctcaactgtaatttttggatatgtctgggaagagattgatagccaatgactatattcaatttacattaaaatagcatatcccatatgaccaggaacatagttgaaccggtttaggtttttttaaaaaatcctcagaagtgcaacataggtttgatttttaactgttgctagaaaaattcattagtgaaagtaaagatctcgtccaaaattcctttaaacagaacttttggctcaagagccacttcttagttagagttgtagagatgtcttaagcctttagtgattttcgaagatggtagtgacgagcttttctgggttagtttaatataaagtgatacgtcactgtcagtgaaataaggaatataaggtggccgtggtggctcaggcctataatgccagcactttgggaagacaaggtaggaggattgcttgagaccaagagttcgaaagcagcctggggaacacagggagacctgtgttctgggtgtggtggtgtgtgcctttagtcccagctattcgagtggctgaaatcaacgcgccactgcaccccagcctgggtgacagactgaggctgtgtctcaaaaaacaaaccaacaatcaaaaagaaaatgggaggttttaaatctagttagcttttaggttggatttaaacactttgcaaacaaattctagccatatttatttctaatgcaaaaaacatggtctttagagttattcagatatggatttaaattctaatcgttacaattgtgacttaacttttttttttttttttttttttgagctggaatctcactccgttgcccaggctggaatgcagtggtaagatcttggctcactgcaacctccgcctcccaggttcaagcgattcttctgcctcaacctcccaagtagctgggattacaggcacacaccaccatgctcggctaatctttgtatttttagtagagatggggtttcaccatgtttgccaggctggtcttgaactcctgacctccagtgattctcccaccttggcctcccaaagtgctgggattacaggcatgagccaccgcacccagcctgtgacttaacctttttgagcctcagtttctttatctgcaaaatcgagataatgctgtcttgtaaggttgtgaggggtaagcaaaataatgtatgtgtattagttttggggggctgttgtaatgcaataccacaaactagctggcttaaacagcagaaattctctctcagttcgggaagctagaagtacaaactcaagttgtcagcacattgttttgaggactgtgagtgtgtatctgtccctgtccctctcctaatgtctgacctcaggctttccttggttaatagattgtgttctgtctgtgttttcacgttgtcttccctctatttgtgcctgtctttgtttccaaatttctccattttattaggaaacagttgcactgaattaaggcccacccttgtgacttcatctggatcaactgcaaagaccctactttcaaataagatcacattcacagctactgggttagggaggagtatatcttgtgtgtgtgtagagtggcagtgtacacagaattcggcccaataccatatataaaaaaggcttagtaccagtatattatttccaactggacctatagacattagaaaaagccattctgaaatctgccagtcctgccagtctaagcctggaagatgccacttctttacttacattttctctgatctcttttcccaagtgtcttgggatctggaattgtgacttattcgtctttgtgtgtcttgttgagctttgtacataggtgtttactaagtttgtgtgtagttgaattatgggcttaaatggatttattttagtgtctgtctctgcaagataaaatttttaagctggtcttaaagtcgtcttgcttttttacacccttgttcttattttcatgtttagaagcttttctgtggtctggaattcttgcctgtttctaagtttatttattaagatcagttggatttggtccttattgtctatgaacgaaagtattaatgtgtatttatatagatttatttttccagtgggtttgcatatgttattttatttggtcatgtaaatttttcaagatagaagaaagtaaataggggtttgttaaagtctttactcattgtaccatcaattaatgaaactttaaaatttgtgtttctcaatggccttgttatttaaaagtttttttaaggtcatcattattgcttcagcctagtttataatggatcatacagtgtatgtatagctctgttatctttaagatatgacatcttagcatatttcatagagttgtaatagcataattttttttggttatatagatgagaggtttctgtgttggccaggctggccttgaacgcccagcctcgcctccttatgcaccaggacaacaggcctgagccaccacggctcctagcataatttttttaaacagatctcttggtggatattaacttttgtcattttaaaaaaaaaatgctttaacagcttgggcaacgtggttatattccatctctacaaaaaatacagaaattttccaggcatgttggtgagcattggaacactgagatgggaggatgggttgagctcaggaggcgaagattgcagtgagtgaagattgcaccattgcactccagcctgggaggcagagtgagaacctgtctcaaaaaaaacacacaaaaaaccaaccaaacaaaaacctgctttaaatatcttaccctagaattaggaattataggaaattactttgaattatttttggggcttaaaatactgggagctgaattactagttactcattttgatggtgtattatagagtaggtgttactttcccaattttgtggcttaggaaactgagaccaaattaacagactttttgaaggtgacacagtttgtgatggagtcagaagagaggatttattactactttctctggttctgtggttctggctattgtctttacctgataccactgacattctttctcctctgtctattgaatgcatgtattttatgattatacttccaaaaatacaatgtaatctttttgtagtagttctctgaggagaagacagaaccaacaacatgtgctagattggttatagttaaatttgtcataaagcatataataataatgaggttttgttgttattggataacaggagagtggtttaagaatttaggctctggagttgtatctccccaggtttgaatccttggttctgtcacttaataactatgtaaccacaggcatgtagtaaaataatgggtaataatgtgtttacttgaagaacagtgccttgcatgtagcaaacatcatgttacttaatgtatttgaagtcatttaggacttgaataaataagcaagttccatatttagcagtgccaaataaatcatatttaaataatcaaaaatcaaattatataataaatttattggaacctactcagattgcagttttcagtacagataaaatatttgtctttcccatcgattcttggtatctcttaaagtttcaaagtcaattaactttgaagtcgtattctttttgagaatttacttgataaccatcaatatggtcccttagatttttttaaagacagatctcactctgtagcacaggctggagtgcagtgggcatgaacatggtccactgtagcctcgaattcttgggctcaagcagtcctcctacctgtctcccaagcagctgggagtacaggcatgcaccaccatgcccagctaattttttaaattttttgtagagactgggtctgacatgttgtccaggctgatctcagactcctaggctggagtgatcctgtcacctcagcctcccaaagtgctggaatttataggcaagagccacagcatctggcccccttagggctttttattttattttattctttttacttttgaggcagagtctaactctgttgcccaggccggcgtgcagtggcgcaatcttggctcactgcaacctctgcctccctggttcaagcaattctcttgcctcagcctcccgagtagctgggattaccggcatgcgccgccatgccctgccaatttttgtatttttttctctttttagcagagacagggtttcgctgtgttggccaggctgatctcaaactcctggcctcaagttatctgcctacctcggcctcccagagtactgggattacagatgtgagccactgtgcctggccccttagagctttttaaaagaaagtaagatgtagttcttgtttcattttctagtagctctatatacaggaggaactaatcccaggttttttttttttccgagacggagtcttgctctgtctcccaggctggagtgcagtggcgccatctcggctcactgcaagctccgcctcctgggttcacgccattctcctgcctcagcctcccgagtagctgggactacaggcgcccgccaccatgcccagctaattttttatttttagtagagacggggtttcaccgtgttagccaggatggtctcgatttcctgacctcgtgatctgcccgcctcggcctcccaaagtgctgggattacaggcatgagccactgcacccagccttttttttttttttcttttttttttttgaagagtctctctgtcgccgaggctaaagtacggtggctcttggctcgctgcaacctccgcctccagggttcaagcgattctcctgtctcagcctcccaagtaactgggtaggattacaggtgcccgctaacacccccggctaatttttgtatttttagtagaacaaggtttcaccatgttggccaggccggtcacgaactcctgacctcaggtgatccacctgcctcggcctcccaaagtgctgggattacaggcatgagccactgtgcccagccaatcccagtatttttaatgagatttaacttctgtgagtatttagaagaattctttgctgttttctctggggcttatgtctgaaagtaaagtgttagctgggactacaggcatgtgccaccactcctggctattactattgttaatacgctaatagaaatattggtttgaaaagcatgtagaatatcacatgcagaagggtctgaagtctcttgatattattaaaaattcttcctataattttttctccattttttttttccctttgtgttttgatccaaggactagatcaagggtgtcttttccttcggatgattttctttattgtgtgtgtttttagttctttaaaaataaagccagcttaattttattttcaaaatacggatagattcattatataaaacaattataagttgagaactatgtataaagggctatgttatgaacaattaagatggaataatttagttgtacttattttgtaattctttttaggctagagtgttttcattctcaatttttcatacattgctttttcagaaggctaataggaatgacaataatgtttcaaaatattttgattcttattgatgccccatgttttgtctgtctaaagtgtcaacctaagaaaaagtctacgccactgaagtatgaagttggagatctcatctgggcaaaattcaagagacgcccatggtggccctgcaggatttgttctgatccgttgattaacacacattcaaaaatgaaaggtaatacttgcagtgattatacatgttaaaggcagttgcctttagaataactcaatttttgttatcttaataataatatatttttttccttggaacattttgtgaatgaattggtgttacatattttatcttttggggcttttaaaagttcgttttactctatgatttaaaccttctctcagttttttttttttgtttgtttgtttttgagacggagtctcgctcttgttgcccaggctggactgtagtggtgcaatctcagctcactgcaacctctgacttgtgagttcaagcgattctcctgccttagcctcccgagtagctgggattacaggcatccgccaccacgcttggctaatttttgttttttgtttttttttttaattttttatttgagatggagttttgctcttgttgcccaggctggagtgcagtggcgtgatctcagcttaccgcaacctctgcctcccgggttcaagcaattcttctggctcagcctcctcagtagctgggattgcaggcatgtgccactacgcccagctaattttgtatttttagtagaaacggggtttctccatgttggtcagactggtctcgagctcccgacctcaggcgatctgcctgccttggcctcccaaagtgctgagattacaggcatgagccctgcaccaggcctaatttttgtatttttagtagagacggggtttcaccatgttggccaggctggtcttgaactcctgagatgaggtgatccgcccgccttagactcccaaagtatggggattacaggcgtgagccactgtgcccggctgatttaaacattctcaattattctgttgatgccaggaaggtgttaggccatttttctaatgtttacattgtccggaatcaccttttagtatatttacgtatttctactttaatcaggtttgtatcattttttataatataaaagctgaaacaattgtaaatgtttattaataattttgaagtttaaaattttaatttggagtatttcctttaaatgctattgtttgtttttcagttgattgttgtgtttgaatcttaggtaccttagttttaaattactctaaaggatggggctgaaacttgatttatttttattttattttattttagagaagaatttctgctctgtctcccaggctggagtgcagtggcgtgatctcggctcactgcaagctctgcctgctgggttcatgccattctcctgcctcagcctcccgagtagctgggactacaggcgtccgccaccatgcctggctaatttttttggtatttttagtagagacgggatttcaccgtgttaaccaggatggtcttgatctcttgacctcgtgatctgcctgcctcggccttacaaaatgctgggattacaagcgtgagccaccgtgccgggccaatttttgtatttttagtagagatggggtttcaccatgttggccaggctggtcttgaactcctgacctcaggtgatcctccttcctcagcctcccaaagtgttgggattacaggtgtgagccactgcacctggcctgaaacttgatttgagctgtccttttttctgttaggatggtagtgattttattttagttttaatatatgtattttagtttctgaaagtcagatgttggtgagattcagaaaaatcagcttactctctgctttgctgtgatccgccacattcttcactcctttcaacaggcaaccaattgatattaatttttgttgttgttgttgttgttttgttttgagacggaatcttgctctgtcacgtacgttggagtgcagtggcgcaatttcggctcactgcaacctctgcctcccgggttcaagcaattctcctcctgcctcagcctccagagtagctgggattacaggtgcgtgccaccatgcccagctaatttttgtattttagtagagacggggtttcaccatgttggccaggctggtctcaaactcctgacctcaagtgaaccacaggtcttggcctcccaaagtgtttggattacaggcgtgagccaccacacctggctgatattaatatatttttatatacataatgttttttcatataaattatatttttatttacatgagtaaatacatacttcttagtcatcttccacgtctttcctttatcacaaacagaacattgtatattttgcagcttgccttttccactttgtggagatttttttcatatttttattatttatgtatttgtttatttttctgagacaggatctcattctgttgcctaggctggagtgtaatggcataacaacgcctcactgaagccttgatctccagggctcaaacagtcatccaacctcagcatcctgaatagctggaatagctggaatagctgggagcacagacgtgtgccaccacacatggctttttttttttttttttgggtggagatagtgtctccatatattacccaggctggtcttgaaatcctgagcttaataagggatcctcccaccttggccttccggagtgctggaattacatgtgtgagtcaccatgcctctttttttttttttttttttttttaaaaaggatgatttctccaaagtagaattcctggatttgattttatattttgaataatgaggtgcccaaaaacctttataaattttagtgtctttttttttttttttttttttttttgaggcagagccttgctctgtctcccaggttggagtgcagtggcacaatctcggctcactgcaagctccacctcctgggttcacaccattctcctgcctcagcctcccgagtacctgggactacaggtgccagaacctagcacagtactaggttttgtgtctgggcgcagtggctcacacctgtaattccagcactttgggaggctaaggcgggcagatcacctgaggtcaggagttcgagaccagtctggctgacatggtgaaaccctgtgtttactaaaaatacaaaaattagccaggtgtgttggcatgctcctacaatcccagctactggggaggctgaggcagaagaattgcttgagcccgggatgtggaggttgccgtgatccaagatcacactactgcactacagcctgggtgacagagcgagactctgtctcaaaagaagaaaataacttagtgtgttaaaaatttaataccttgaccagacacggtagctcatgcctataatcccagcactttgggagtccgaggtgggaggatcacttgagcctaggagtttgagaccagccttggcaatacaatgagacactttctctttaattcaaaaaaaatgttgataccttatcctttgtgacctgtctggatatttaaattctactactagaaaactctgagtccttcttttctaacctccctgtccctatgactgctggtttcttactcattagggtgtctctctctctctctctcctcgtctctcttttgattgagggtctcgttctattgcccaggctagaatgcagtggcgtgatcatgactcattgcagccatagcttcccagggtcaagcgatcttccctcctgtgccttccaagcagctggggctacaggcattcgccactatgcctggcttagtttttaatttttttgtagagacagggttttgccttgttgcccaggctggtctgaaactcctgggctcaagcgatctgcccgcctcggcctcccaaagtacttgggattactgacaggagctaccgcactcagcctatttatagtgtttcttatgcatactagttgagtccatgctatttatttgacaaatagtaaataccttgtatagattgagtactgtgctaggttttgggattcattattgggccatacatctatactgcttgctctcatgagaaattagaatctagtataagggacaagacaccagaaaataatcaaatgcattattacttaactgagaagtctgtccaaggaacaattttgatgcctattcagtgatataacagggataactgacctggactcttcatcagtggtgtttgctaataaagttatctctgatctgttacttgagaggatgagttgggagttaactagggaagagagaagaagatggttccaggaatctgcagctcacagagtaagggagggtggcacagtatgaggctgggaagtagatatgggacaaagtgttcagtgccttgttgactttgttaaaaaattttgttatttttatctcagaaacaatgtatataattaaaaagtgtttagcaggagccgccatgctctgatctgttcattttaaaagttcactgtggctggattgttgaacatgtgttagaaggggaccacaaataagtaaaaagagacagttaagtcattattagtgattatggtgtgatgaaaattgcgaatagaaaataaaaacagatgaggaggtaaaatgcatctgatgtagtaatgcattggataatgttgactgagggagaatgaagtcctgaggctttcagttctcaggtttccatatcataggatggctcccacgtttttagcttcatcactggatggctgaatagatcgtcatttactgagagaacaccagagcatctataactcagaaaggacatattcttgttcatattagttggagccatgggcaaggcatgggtgagattttttgggacaaaagatactatgagacaaaaggtacattgaggaagacatcatttgacatctgtatgaaagagactgagcttgctgaaaaagaatgatgaaaaagaatcagatgaaacaggtggaagaggaaaagtaggagaatgtggctagagtacagtagtatgtactggggatatgttctaagattctcagtggatgcctgaaactggatagtactgaatcccatatatataatgtttttcctgtacatacatacctattataaagtatcatttataaattgggcattgtggctggttgtggtggctcacgcctgcaatccagcactttgggaatccgaggcgggcggatcacttgaggtcaggagttgaaagccagcctggccaacatggtgaaaccctgtttcttctaaaaacacacaaaaaattagctgggcgtggtggtggatgcctgtaatcccagctactggggaggctgaggcaggaggattgcttaaacttgggaggtggaagttgcaatgagccgagatcataccactgctctccagcctgggcaatggagcaagactccatctaaaaaaaaaaaaatagtaaataaaaaataaattgggtattgtaagagatcagtaacaactaataataaaacagggcgggtgcagtggctcacgcctataatcccagcacttcgggaggccgaggcaggcggatcacaaggtcaggcgatggagaccatcctggctaacaaggtgaaaccctgtctctactaaaaatacaaaacattagctgggcagggtggcgggcgcctgtagtcccagctacttggcaggctgaggcaggagaatggtgtgaacccgggaggcggagcttgcagtgagccaagatgacgccactgcactccagcctgggcgagagtgcgagactccatctcaaaaaataaataaaacagaacaattacactgtaataaaagttatgggaatctgtcccctaccttcgaccccaatagcttattttactgtatcacaggtaactgaaaccatcgaaagtgaagtctcacgtgagctgggaccactgtagtttaaggacgatgtggtcaattttgctgagtgttgcctagagagcaaataaaatgtccattagggataagaaggtggagatcacgagtaccttttttgttgttgttggtttcattgaggtagaagttagattggactgatttgaggcaatggagacagagacagagaagggaggatgctgcaggcagataggtatataggattcagaaggatttttattttttgttgttattttttattttaatattagtcttatttttgagaaagagtcttgctctgtcactcaggctggagtgcagtggcacaattacagctcactgcaacttccatctcccaggctccagtgctccagggctccagcactccttccacctcagcctcctcagtagctgggactacaggtgtgcaccacaacacttggctaatttttatattttttgtagagacaagatctccctatgttgcatgaactggtcttgaactcctggccttaagtgatcctcccgccttggcctcccaacgtgctgagattacaggtgtgagccactgtgcctggccaatttatttttgactctagagacagggaagtttcaagatgaaggtgctagccaattcggatcccaagtgagggctgtcttcctgacttgtagataaccaccttgttgctgtgtcgtcatttggcagagagcgaaagtactcactgtggcatcttcttttaaggagactagttgcatcatgaggtcacctccatcatgagggacctattactaatctagtaatagtatttagtattcttagtatatttagtgtataaaattagtaaatctacttactccaaaggcctcacctgtaaacaccaacatatgggggggtcaaggcttcagaataatgcatttcaggaggacacaaacatttagtctgtaatagccctttttcatccttcttgaatgacagtcttactaactctgagttttaaattgtcgtcagtaagctgaattcatatccttagtgatagtctttatccaggctttagatttgtatactcaactccatacttgaagttttcaccaagatgtcaatttgaaaatatattcatcaccctaacatggaaccccatactctttagcttcctctgtctccatctttccacacccatacgtgtttgccttaagcaaccactaatgtactttctgtttctgtggatttgcatattctagacatttcatatgtagtaggtccccaatttgagttagaatttttcgaccttacaatggtgcgaaagcgatacacattaaatagaaatggtacttcaagttacctgtagaaccattctgtttttcactttcaatgtagtattcagtaaattacaggagatattcagcagttaattttaaaataggctttgtgtcagaaatattgcacaactgtagaccaatgtaagtgttctgagcatgtttagcgtaggctaggtgtattaaatgcattttctaattattattttttttttagaggcagggtcttgctttgttgctcaggctggagtgtagtgacgcgatgtcagctcactgcaacctctgcctcttggactcatgtgattctcctgcctcagccccccaagtagctggaactacaggcaagggccaccatgcccagctaatttttaaatttttttatagacagggtctccctgtattgcccatgcttgtcttgaactactgggctcaaacagtcttcttgccttggcctcaaaaagtgtttggattataggcgtgaagcctctgcgtctggccagccttcatattcaacttaatattttcttttcttttcttttcttttcttttctttttttttgagatggagtctctctctgtcaccagactagagtgcagtggcacgatctcagctcactgcaacctctgacatcctggttcaagcaattctcctgcctcaacctcctgagtagctgggattacaggcacctgccaccacgcccggctaatttaatttttagtagagacggggtttcaccatgttggtcaggatgttctccatctcctgacctcgtgatctgccaacctcggcctcccaaagtgctgggattacaggagcgagccaccacgcccggcctcaacttaatattttcagcttataatgggtatgtcatggagcatctgtgatttgtttataatttttccacaaatctgttgtgctcctcaacttacaatggggatacgtttccactaggaatgcattggttctgatttttcccatatccccatcattggttatttgacttttaaaaaatagacaaaacataaatttaatgttttttttttgttttgttttgttgagatagagtcctgctctgttgcccaggctgtggcaggatctcagctcactgcaacctctgcctcctgggttcaagcagttcttctgcctcagcctcctgagtagctgggactatacgagtaactgggactacaggcatgtgccagcacgcctggctcatttttgtatttttagtagagacaggatttcaccatgttggccaggccgttcttgaactcctgaccttaagtgatcctcccgcctcggcctcccaaggtgctgtcctgcctcagcctcccaaggtgctgggactacaggcctgagtcacctttcctcgcctaatgttttcattgtttcaagtaggcagttcagtagcattaagtatattaacattgttgtgtagccattaccactattcatctccagactctttcatctcccaaactgaaactctgtacccatttaccaacatcaccatagcccttggtaaccactgttctgtgttttttttccttataaatttgactattttagataccacatataactagaatcagacatttgtcctattgaccccttacttcatttatcataatgtcttctaagttcatcaatgctatagtatgtttctgaatttctttctctctctctcaatttttttaaaggctacataatacgtcattgtattgtaagtaccacattttgtttttccattcatccatcagagaacatttgggttgttttccttttggccattctgaacagtgtttctataaacattgtatagtatctggtgtttttgtatttttttttttttggatggagtttcactcttgttgctcaggctggagtgcaatgaggcgtgatcttggctcactgcaacttctgtctcctgggttcaagtgattctcttgcctcagttgggattacaggtgcataccaccacacctggcattaatttttgtatttttagtagagactgggtttcgccatgttggccaggctggtctcaaactcctgacctctggtgatctgcctgcctccacctcccaaagtgctgggattataggtgtgagccactgtgtccaacctaagcatctgtgtcttttttgttgttttttatttgttttttgagacagagtcttgctctgtctcccaggctggagtgcagtagcgggatcttggctcactgcaacctctgcctcctgggttcaagcgattcttctgcctcagtctcccgagtagctgggactaaaagtcagctaaaagtcaaagctgtaatggctaagatcttaacatgccatgcaaactcttacaagtctggttgctgcccaacctttattagtttcccttttcttctagtttatgatagtgtttagaactacttgtagttttgtttagttttattcattcatgcctttgagggttctgtgccctcatactataattctatctttaactgtttacttttttttttttttttgagatggtgtctcactcttgtccaggctagagtgcagtggtgggatctcagctcactgcaacccccgcctcctgagttcaagcgattctcatgcctcagcctctcaagtagcttggattacaggcaagttgcaccacgcccggctactttttgtatttttagtagagacagggctttaccatgttggccaggttggtcttgaactcctgacctcaggtgatccgcctgcctcagcctcccaaagggctgggattacaggcatgagccatcccacctggccaaactgtttaactttaaaagttgttcagcctggcgcggtggctcacgcctgtaatcccagcactttgggaggccgaggcgggcggatcacctgaggtcggcagtttgagatcagcctgaccaacatgaggaaatctcgtctttactaaaaatacaaaaaattagttgggcgtggtggcgcatgcctgtagttccagctacttgggaggctgaggcgggagaatcgcttgaacctgggaggcagaggttgcagtgagccaagatcatgccatagcactccagactgagcaacaagagtgaaactccgtctcagaaaaaaaaaaaaaagttgttcaagtacttcatttgtctcctcccacttataattgagtggttttttttaagaaataagtgtttatttttgcagttgtcatgccttttgtactgtaatcatttatatatgacttatctgtcagacagtgagttcttttttctcctcacgttgctggcacatcagaagttcttgatctgttaatgaaatttatttatttatttatttctaagacaggggcttgctgtactgccagggtggagtgcagtggcgtgataatggctcactgtattcttgacctttgaggatgaagtgatcctcccttctcagcctcccaaatagatgggactacaggcacatgccaccatcctcagccagtatttttatttttagtagagatagggtcttgctatgtttcccaggctggtctcgaactcctgggctcaagcagtcctcccacttctgcctcccaaagtattgggattacaggtgtgagcccctacacctggccagttcaatgtattgactcatgggagagtgatttaattctcaaattgactttaagaacctctgtataggtacacacatgtgtatattaaccagttccagttcctgtaggtgatttttattgaaggatttaattcagtaggtgggaaataaggagttcattttttttttcagtttgtttttaaaatgaaccagacaacacaaaatttaactaagttttagtttcattattaagctatgttttttaatagaaaaactaccatgtgtacacttttgaaaccagcatttacagagaagttaccgttgacagttcagtttataaatcccttctctcctttgtctttcttttttcatttttcattttgcattctgagggaagtaggcattccataattcttccaaaggttatttggattcttttctgtgttttgaaataagacatggttgttacaagggaactagatgtgagttaaaatgaattttcgtataaaatgatttttatttccttttattaaaagtgacaaattgttaaacatgtgttgtcctgactttcttttgtgacactttttagtgtaataaaagttgctaataaaattgtaaatgtgtggaagataacatatactagatgaattataatcttttctagatgggatttgtattttcatatttttaattgtatgtatagaactttagataaccaagaaattataggctaaactggatttatttttggttttattactggtaggctttcctttttcttttaaaatttccctaatttgaaatattgcatttcactttctttgcaaaaccagtgtttgaccatgcgcttgttctctctgaagttattgaacttactatatctaaaataccaaaaccatacattattttgggggtgtggttgtggggaggaatccatgcaaagcaccttgtgtggtgctcgtctatgagtagctacactataaatgttaacagatcatacatgttgctttgctgaaacatttcttcttctttatattagcctagtgtttttcacgttttcttgggtttttttttgtatatatatttttgttgctgtgggcttactatatacatcttctgtatttttggaacaatgaaattatagactgatagtgaaggaaacttacctgtctactatcttaatttcttctttgtagttaatctacatttagctggttttgaagctataccacgtcatcagactagactactgattctttcataacctcctgtgtattttcttgccacacatatataatacttaaaattttccttgtgtatgatctattctaggttgtctagttcagtgggcatgttagttgtttccagacagtcttctttggcggcaatgatgtggctgttctcttaatgatgagaagtaatttctttgatctaatgattctggttctcttacccttacctagtttccaaccggaggccctatcggcagtactacgtggaggcttttggagatccttctgagagagcctgggtggctggaaaagcaatcgtcatgtttgaaggcagacatcaattcgaagagctacctgtccttaggagaagagggaaacagaaagaaaaaggatataggcataaggtaggaaacgaaaaaggctttttattgagtgacagaagcaagtaagaaaaagaaagaaaatggcctcttatttattttcgagacagaactttgctctgtttcccagattggagtacagtggtgcaatctttgttcactgcaacctccgcgtcccaggttcaagtgattctcgtgcttcagcctcttgagtagctggtattataagcgagcaccaccacgcctggctaacttttgtatttagtagagacaggatttcgccatgttggccaggttggtcttgaactcctgagctcaagcagcttcccaaaatgctgggattacaggtgtgagccactgtgcctggcccggccttttaaaaatcattatctacttgggagttagcagagaggaggcagggaagaagcattatatttttgaaatgtaagttatttcctttggtagtagaatatctgtgagaaaagagctagggagcagatgcaggtgggttttttttgtttgtttgtttgtttgtttttcctccccagtgggctggggctagcttgtgacatatttatactaaattttttgataaattattttagtcaactttactgtgtcactcagtagtgaaaattatgacatagcgtgaccattcttttgttatcttttatgcatgatgaaagtatcattaaaatgaaatattctgcttcttgccacttggactaattatttctgttaatgagaataatgtggtttttttgtttgtttgtttctttgtttttggagacagagtctcactctgtcacccaggctgaagtgcagtggcacactcttggctcactgcaacttccgcctcccaggtttgagccattcttgtgccttagcctcccaagtagctgggattataggtgcccgccaccacacctggctaatttttgtatttttagtagagacaggttttgccatattggccaggctggtcttgaactcctgatgtcaggtgatcaactcgcctcagcctcccaaagtgctgggattacaggcgtgagccactgcgcccactgagaaccataaagtttttaataattttcttttttatgtttgtcagtgcttaagtctaaagtttctactctagttatatttcaaccatcagtattgtggctttttttcttttgcttgatgttttatgttaaatttggctgagaaaaataccagcttattttaatactcttttttcctccagttttttttattgtgttaaaatatatataatataaaaattactatcttaaacacttttaagtgtacagttaatggttttaaatacatttataatggtgtgcaaacatctcataattattttcatcttgcaaatctgatactcttttacctgttaaacagtaattccccatttgtccttctcccatcactgtcaccaccattctactgtttgtctctatgatttaatattctcttatattcaattctagaaggagaaataataattcttagtttggtgttttatactcccctgggtctaaatacttttatttattattattattctttgatacgggggtctctctatgttgttcatgctagagtgctgttgcacagtcatcttttactgcagctatgacctcccaggctcgagccattctcctgactcagtctcccgagtagctgggactacagatatgtatgactacagtggctaatttttatttattattattattatttttttaaacagagtcttgctctgtcacccaggccggagtacaatggtacaatcttggctcactgcaacctctgcctcctgggttcaggcgattctcatgccttagcctcccaaatagttgggattacaagtgtatgccaccacacctggctaatttttgtatttttagtagagacagggtttcaccatgttggccaggctggtctcaaactcctgtcctcaagtgatccatctgccttggtttcccaaagtgctgggattacaggcatgagccactgtgcccagccccaatttttatttttatttttttgtagaacgacaaggtcttgccatgttgcccaggctggtcttgaactcctggacttaatcttctcatgtcggtttcccaaagtgatgggattacaggcatgagataccatgctggcaatacttgtagactatttttaaaaatcataattaggataatttagagttcatatgcagggtctgccacttaacacttgagttctcaaagacttggtgtcttcatctctaaagctagtacaataacttacaccctatagaactgttgtaaacattagaaataagtataaaatacttaatatgacatacaattgatgctttagaaacaattagtatgtgttgttaggatgaaagaggttaacggcttcctttcagatatttcagctggttgctgatagggatgtgtcggttattttgttaagtctttaggtacgtagagttaccaatctttttagaggtgtttattggggctttcagattctggaaaattgatttactctggtcacagtcatgagcattagtggatatgtgtttctgtgcttaaaaaaaaaaaaatacacactaccagattgtccgtttgatcctttctttaagaggaggctactcctctagttaccctaattttttttttttctttttgagatggagtctcactctgtcgccccagctggaatgcagtggcatgatctcggctcaccgcaacctctgcctcctgggttcaagcaattctcctgcttcagcctcccaagtagctgagattacaggcttgcgccaccacgccctgctaatttttgtatttttagtagagacagggtttcactatgttggccaggctggtctcgacctcctaacctaaggtgaccccccgccatccccccgaccttggcctctcaaaatgctaggattacaggcgtgagccactgtgcccggcctcgttaccgtaattatttattttttaatttatttatttttatttatttattttgagacagagtctcgctctgttgtgcaggctggagtgcagtggtgcgatgtcagctcactacaacctccgcctcccgggttcacgccattctcctgcctcagcctcccgagtagctgggactacaggtgtccgccaccaggcctggctaattttttatatttttagtatagacggggtttcaccatgttagccaggatggtctcgatctcctgaccttgtgatctgcccacctcagcctcccaaagcactgggattgcaggcgtgagccaccgtgcctggcctatttatttaaatttttttttttttttttttttttttttttagagaaggggtgggtctccctgtgtttcccaggctgggctaaaggcatcctcctgcctcagcctcgcaaagtgctgggattaaaggtgtgagccactccacgcagccttttattcatttattttattttttaaaatttgagacaggatcgtgctctgtcatccaggctggagtgcagtggcacggtttcggcacactgcaactttcacctcctgggcacaaatgatcctcctacctcagcctactgagtagctgggaccatatgcatgcagcatgtccagctagtgtgtgtgtgtgtgtgcgtgtgtgtgtgtgtgtttttagtagagacagggtctggttgtgttacccaggttggtcttgaactccagagctcatgtaatccacctgcctcagcctctcaaagtcctgggagtacagccatgagccaccatccccagcaatgatctgaatgtttacttgctctgcagaacatccccttcacaaatattaaactatttgtgaacactatgtggtagttagaatcttgactaatacctattgtatggaggtaaggaagaaaataagagtctgaaaaattagctgtatttcagagtctcaatgttttcatgctgtgaggtatccagaaaagataatgtaatacccatggtgtcatcagtataatagctctggattacatgatgaagcctaggagatggcttggttataatccaggttatatttaacatttatagtcgattcttgattagccaggtggctagtgataactagaatttcaaatttcaagttccctagggaggtagatcaaacctgctgattcctcttatcctgttttttctatattcatcatctttaacctttttttctttttcttttttttttcttggtttttctttttctttttttcttttcttttttctttttgagaaagagtcttgctctgtcacccaggctggagtacagtggcgtgatctcagctcactggagcctccacttactgggtacaaatgattctcgtgtcttagcctccctactttcttttttatgcaactgaacatgtgtttggccttcatattccttaattaattaattaattaattaattttttgagatggagtcttgctctgtcccccatgctggagtgcaatggcgtgatctccaactcccgggtgctagtgattctcctgcctcagcctccacagtagctgggagtataggtgtctgccaccacacctggctaatttttttatttttagtagagatggggtttggcgatgttggccagggttgtcttgaactcctgacctgaggtgattcgtcctcctcagcctctgaaagtgctgggattacaggcgtgagccacacacccggccaagtattctttaatttagaaatgtaatgttaccagttttagtctatattctgctttgtgcttataaatgcagggagggtggagtgtttgtgagatcagtccttactctaatgacataatcttattagcagaagtatttttgaggaagctccattagggtgattcagatgctgcttgagctcaggtgctaactacctggctggttccataaaagcaggaggcctgacaggtttgtaaaagcttctgatttcaggccgggtgcggtggctcatagctgtaatcccagcactttgggaggctgaggtgagcggatcacttcaggtcaggagtttgagaccagcctggccaatatggtgaaacccctattctactgaaaatacaaaaaattagctgggtgtggtggcgggtgcctgtaatcccagctactcgggaggctgaggaaggagaatcacttgaacccgggaggcagaggttgtggtgagcgaagattgtgccactgcactccagcctgggcgacagagcaagactctgtctcaaaaaaaaaaaaaaaaggaataaaaaaaaaagcttctgatttcatctcccttttcccccacccatttctttgataagtgataattctttttctcctttaaatttaaggttcctcagaaaattttgagtaaatgggaagccagtgttggacttgcagaacagtatgatgttcccaaggggtcaaagaaccgaaaatgtattcctggttcaatcaagttggacagtgaagaagatatgccatttgaagactgcacaaatgatcctgagtcagaacatgacctgttgcttaatggctgtttgaaatcactggcttttgattctgaacattctgcagatgagaaggaaaagccttgcgctaaatctcgagccagaaagagctctgataatccaaaaaggactagtgtgaaaaagggccacatacaatttgaagcacataaagatgaacggaggggaaagattccagagaaccttggcctaaactttatctctggggatatatctgatacgcaggcctctaatgaactttccaggatagcaaatagcctcacagggtccaacactgccccaggaagttttctgttttcttcctgtggaaaaaacactgcaaagaaagaatttgagacttcaaatggtgactctttattgggcttgcctgagggtgctttgatctcaaagtgttctcgagagaagaataaaccccaacgaagcctggtgtgtggttcaaaagtgaagctctgctatattggagcaggtgatgaggaaaagcgaagtgattccattagtatctgtaccacttctgatgatggaagcagtgacctggatcccatagaacacagctcagagtctgataacagtgtccttgaaattccagatgctttcgatagaacagagaacatgttatctatgcagaaaaatgaaaagataaagtattctaggtttgctgccacaaacactagggtaaaagcaaaacagaagcctctcattagtaactcacatacagaccacttaatgggttgtactaagagtgcagagcctggaaccgagacgtctcaggttaatctctctgatctgaaggcatctactcttgttcacaaaccccagtcagattttacaaatgatgctctctctccaaaattcaacctgtcatcaagcatatccagtgagaactcgttaataaagggtggggcagcaaatcaagctctattacattcgaaaagcaaacagcccaagttccgaagtataaagtgcaaacacaaagaaaatccagttatggcagaacccccagttataaatgaggagtgcagtttgaaatgctgctcttctgataccaaaggctctcctttggccagcatttctaaaagtgggaaagtggatggtctaaaactactgaacaatatgcatgagaaaaccagggattcaagtgacatagaaacagcagtggtgaaacatgttttatccgagttgaaggaactctcttacagatccttaggtgaggatgtcagtgactctggaacatcaaagccatcaaaaccattacttttctcttctgcttctagtcagaatcacatacctattgaaccagactacaaattcagtacattgctaatgatgttgaaagatatgcatgatagtaagacgaaggagcagcggttgatgactgctcaaaacctggtctcttaccggagtcctggtcgtggggactgttctactaatagtcctgtaggagtctctaaggttttggtttcaggaggctccacacacaattcagagaaaaagggagatggcactcagaactccgccaatcctagccctagtgggggtgactctgcattatctggcgagttgtctgcttccctacctggcttactgtccgacaagagagacctccctgcttctggtaaaagtcgttcagactgtgttactaggcgcaactgtggacgatcaaagccttcatccaaattgcgagatgctttttcagcccaaatggtaaagaacacagtgaaccgtaaagccttaaagaccgagcgcaaaagaaaactgaatcagcttccaagtgtgactcttgatgctgtactgcagggagaccgagaacgtggaggttcattgagaggtggggcagaagatcctagtaaagaggatccccttcagataatgggccacttaacaagtgaagatggtgaccatttttctgatgtgcatttcgatagcaaggttaagcaatctgatcctggtaaaatttctgaaaaaggactctcttttgaaaacggaaaaggcccagagctggactctgtaatgaacagtgagaatgatgaactcaatggtgtaaatcaagtggtgcctaaaaagcggtggcagcgtttaaaccaaaggcgcactaaacctcgtaagcgcatgaacagatttaaagagaaagaaaactctgagtgtgcctttagggtcttacttcctagtgaccctgtgcaggaggggcgggatgagtttccagagcatagaactccttcagcaagcatacttgaggaaccactgacagagcaaaatcatgctgactgcttagattcagctgggccacggttaaatgtttgtgataaatccagtgccagcattggtgacatggaaaaggagccaggaattcccagtttgacaccacaggctgagctccctgaaccaggtaaggacatctaaatgtgataaaaaaaaaaaaattggagaaagtgctgataaacattgtccttctgaaattggtctgttgtaatggtaaagtgaagtataaactagcggggaagaatcatcacttcaatgaagaaggagttttatgtagaaaggtctgaattttgaagatgagatttccatatatattcaaaagttaaactttaccagaagcccttttccccaaccttttcaagtaaatctctataacatctttctttctcactttctctctctctctttctctctctctcttttttttttttttctaattttttttttcttttgagacagggtctcactgtgttgcccaggctggtctcaaactcctgagttcacgccatctgccagcctttgcctcctaaagtgctgggattactcttgcctgacctgttccccgtttcttaccttttaaaatccccaagctttttgggactcaatatgtaactgcaagtaattgagaggctccgatcctaggatttaaatccagttgttaggttatagaaagcaaatagattctattggatggtagtttcttttttttttcttaaggcacccgccaccatacctggtaatttttgtatttttagtagagatgagggttcaccacgttggccaggctggtcttgaactgaactcaagtgatccgcccaccaaaagtgctgggatacaggcgtgagccactgcatctggctggatgttaggttttctttgaccattacttaagataggtccttctgttttgtggacaatttgatgaaccacatgcgcttttgaaaaaactgcaagtattctgtagtacttatttgaaggtcttaggtgtcttaaattcctactggaatgaggattatgaacaaataaaaataccagaagtacccaagtgttgtacctagcagcagatggaaaacagaaatctttcaagatactaacattacacagtatacagttgaggataaagcagtgtgtgtatacatgtatatacatatttttttcttttttacagcaatatccattaacataagattctcaaaactgtgtatcatagtagatttttctctaacagctttattgaaaatgcagttatcatatcataaaattcagcttttaacgtttttaattgagtggtttgtagtatagtcacagagttgtgcaacaatcagtgcgatcaattgtggaatatttgcatcatcccagacagaaacacagaactcttgtcaatctgccttcaggtttttttttctttttttttcttgagacggagtctcgctctgttacccaggctggagtgccgtggcgtgatctcggctcactgcaggctccgcctcccgggttcacgccattctcctgcctcagcctcctgagtagctgggactacaggcgcccgccaccacacccagctaatttttttttgtatttttagtagagacggggtttcactgtgttagccaggatggtctctgatctcctgaccttgtgatccgcccgcctccacctcccaaagtgctgggattacaggcgtgagccactgtgcccagccctgccttcagtttttaccaatctgtagatttgtctattgtgtacatttcatagaaatggaatcatacaatatatggtccttttgggtctggtttcccttacttagtttaatgttttctggttcatgcctcttgtagtatgtatcagttcttctgtcttcttctaaaattatggttaaaaagcatgtaacctaaatgtaccttttttggttttttttttgagatagggtctggctctgttgcccaggctagagtgagatttactctttaacggtatttacggccaggtgcggtggctcacgcctgtaattccagcactctgggaggccaaggctgatggatcacctgaggtcaggagttcaagaccagcctggccaacatggcaaaaccccatctctactaaaaatacaaaaattagctgggcatggtggcgcgctcctgtaataccagccactcgggaggctgaggtaggagaatcacttgaacccgggaggtggaggttgcagtgagtggaggttgcagtgagctgagattgcgccactgcactccagcctgggagacagagcgaaaccccatttcaaaataaacaaacaaaaaaacagtatttaagtgtgtattatagtgtcatgaatcatgtacatgtacaacagcagatctccaggacattttcgttttgcttgactgagactctatacccattgaacaacaactcctgattttctcctttgttcaatccatgacaactaacattctttctgcttctgtgaatttgattactttagacatctcatgtaagtggaatcatgcagtatttgttgttttgtgattgggttatttcacatttcacttagcataatgttttcaaggttcatccatgttgtagcatatgacaggatcacctttttttttttttttttgagacagagtcttactgtgtcacccaggctggagtgcagtggcgtgatctcagctcactgcatcctctgcctcgtgggttctcggctcactgcagcctctgcctcgtgggttcaagcaattctcctgcctcagcctcctaagtagcttggactacaggcacatgccaccatgcctggctaatttgttttgtatttttagtagagacagggtgtcaccatgttccccagaatggtctcgatctcctgacctcgtgatccacccgccttggcctcccaaagtgctgggattaaaagcatgagccaccacgccctgccgataacctttttttatggctgaataatattccaacatactttttcttttccatactaaagcatcttttctttatcagttcattggttgatggacatttagattgcttccacatcttgactattgtgagtaatgctacagtgaacatggatatgcagatatctctgagatctggttttcaattttttttttttttttgagatggagtttcgctcttgttgcccaggccggagtgcaatggcacaatctcagttcactgtaacctctgcctcctgggctcaagcaattctgcctcagcctttcaagtagctgggattacaggcatataccaccacgcctagctaactttgtatttttagtagagatggggtttcaccatgttggccaggctggtgtcgaactcctgacctcaggtggtctgcctgcttcggcctcccaaagtgctgggattacaggcatgagcaactgcacccagtgatgttcatttcttttggataaatacctagaatggcattggtggaacatagggtaattctacttttatttttatttttttttgagacaagggtctccctctgtcacccaggctggagtataatgatgcgatctcaagtcactgcaacctctgcctcctgggctcaagcaattcttgtgccccagcctcccaagtagctgggattacagtggttttgccatgttagccaggctggtctcaaattcctgaccttaagtgatcctcctgcttcggcctcccaaagtgttgggattataggtgtgagccaccgcacccggcctacttttaatttgatgaacctctatagtgttttgcataattgctgcatcattttataagtcctttgtccatatacatatgtttttaatgatactgggcctctttgtcacctagggtggaatacagtggtgcagttatagctcactgcagcctcaaactcctgggctcaagtgatcctcctatctcagcatcctgagtagctgggagtacaggtgcatgccaccacacttggctaatttttgtgtttttttgtagagacaggtttctggctatgctgcccaggctggtcttcaactactgggctcaaatgatgttcccactttggcctcccaaaatgctgggattccagacatgagctactgtgcatatccctttgcatatttttaaatcttgttatttttaaaaaatgaggtataagagttattcatatatcctggatattaaccaattatctgatgtatgatttgcaagtattttctcccattttgtacctgccttttcactctgttgactgttttctttgctgtgtagaagttaatgtgattttttttttccatttttgctttttaaaaaatttttacttgtgctttgggtctcatagccaggaaattcttgttccttccaatatcatgaagttttttcgtctgttttcttctaggagtttcatagttggaggtcttatgtttaggtctttgatctattttatgataatttttatgtaaggtgtaaaatgagagttcatcttcgttcttcagcatgtgcatatccagttttcacaataccatctgttaaagagactatcttttccccattgtgtagtcttggcactgttgtcgaaggtcatttgaccatgtatgtgatttatttcagggatctctgtttttttttttttttttttaatttttagtaaaattgagacggggtccaaccatgttgcccaggctgttcttgaattcctgggctcaagtgatcctcctgcctcagactcccaaaaagcggggattacaggtgtgagccaccaccctggccagggatctctgtggatctctattctgttccattgacttacatgtctatatttttatgccagtacaatattgttttgattaccatagcctcatgatatgttttgaaatcaagaaatgtaaggccttcagttttttttttttttcttctcaagattgttttgtttatttgggggttctttgaaattacacactaatttaggatagtttttttatttctgcaaaaaaaaatggcttttgagatgttgatagggatggcattgactttagtttcctttgggtagtagggatatcttaacaatattaagttttccaatccatgaaaacaggctatctttccatttatttatatcttccgtaatttcatccaacagtgttttggagtgtacaaccatttctcctccttggttaagtttattcttaagtattctattcttttttatgctattgcaaatgtgattgttttaatttccttttatattgttcattatgagtatatagaaatgttcaggtttaattttgtatcttggaactttgccgaatttgcttctttgttctaatagcgtgtggaatctttagggtttcctacataaaggttcatgtcatctgcaaagagataatttggctccttgcttccctatttattgcctaattactctgctaggacttcaaataatgtgttgaataggttgctacagtggtatatttcccttgctctttatcttagaggaaaagctttcagtgtttcactgtcaagcatattagctgtggtctttttatatatagtctttattatatttatgtaattacttttttgtttgtgtttttgtttttggacagcgtcacattcttttttttttttttttttgagacagagtttcattcttggtgtccatgatggagtgcagtggcgcgatctcggctcactgcaacctccacctccctcgttcaagccattctcctgcctcaggctcctgagtagatgggattacaggcgcctgacaccacgcccggctaatttttttgtatttttagtggagacggggtttcaccatgttggtcaggctagtctcgaactcttgaccttgtgatctgcccacctcggcctcccaaagtgtagacagggtcacattctgtcacttaggttggagtgcagtggtgatatggctcactgcagcctcaaccacccaggctcaagcaatactcccaccttgacctcccaagtagctgtgactacagccatgcaccaccatactccgctgatttttaacctttttgtacaggtcaggttttactatgttgcctaggtgggtctaaaacttctgagctcaagtgatcctcccacctcagcatcccaagtagctgggactgcaggtgtgcaccatgacacctgactaattttgtaattttttgttgaaacaagattttactatgttgcctagggtggtctcagactcctgggctcaagcagtcttcccaccttggccccccaaaagtgctgggattacaggtgtgagccaccatacctggcatgtaatttctttttattcctagtttgttgagtgctttcttttcagtcatgaaaggtagttgaattttgtcagatgttttttctacctcaagtgtgaaggtcatgtagtttttttggggtcctttattctgttaatgtgctgtattctgttgattttttttttctatttttgaaccatcgttgcattccaagattaaattccacttggtcatgatgtatatttcttttttttttttttgagacggagtctcgctctgttgcccaggctggcgtgccgtggcgcaatctcgggtcactgcaagctccacctcccggattgacgccattctcctgcctcggcttcctgagtagctgggactacaggcgccccccaccacgcccggctaaattttttttgtattttttagtagacagggtttcaccatgttagccaggatggtctccatctcctgaccttgtgatccgccctcctcggcctctcaaagtgctgggattacatgcatgagccaccgcgcccggcccccccttttttttttctccagctggccctaacgggagccgtatgtttcttttaatgtgctatttaatttgatatactagtattttgttgaggatttttgcatcagtatttataaaagatgttgctctgtagtttatcttttcatttctatatgctctagtctttgtttctttccttctaccaactttgggcttagatttatttttctgtcttctcgaggtgtaaatttaggttgttgagttgaaaactttgtttttcaatgttggcatttactgatacagacttctctcttagtagtgtttttgctgcatcccataagttttgtgtttttttttttgagagggagtctcgctctgtcgccaggctggagtgagctggcacgatctcagctcactgcaagctccacctcccgggttcaagcgattgtcctgcctcagcctcccaagtagctgggattacaggtgcctgccaccacgcccggctaattttttgtatttttagtagagacggggtttcactgtgttagccaggatggtctcgatttcctgaccttgttatcctcctgtctccgcctcccaaagtgctgggattacaggcgtgagccaccgcgcccggccctgtcaaaagatattttcaaatttcccttgtgatttcttctttcttccattgattgttcaagagtttgttgtttaatttccacctattggtggatttttcagtttttgtactgatactgatttctagtttcacttgattgtgactggaacagatacttggtatgatttcagtcttcataaatttgttaagacttgtgtggctgggcatggcagcttacgcctgtaatctcagcactttgggaggccaaggcgagatcacctgaggtcaggagttcaagaccagcatggccaacatggcaaaaccccatctccactaaaaatacaaaaactagctgggcatggttgctcatgcctgtagtcccagctactcaggaggctgaggcacgagaactgcttgaacccaggaggtagatgttgcagcgagctgagatcacgccactgcactccagcctgggcgacagagtaagatcctgtgtcaaaaaaaaaagactctgtgtgaccatattggagaatattctatgtgcttttgacaagaatgtgtattctgctgctgtttggtattggtgttttatatatgtttgttatatgcaattgttcaagtcctctgtttctttattgatcttcattgtggttctctccattattttaacgtggagtattaaaatctccttgtgttactctatttctcctttcaattctgtcattatttgctttttatatttgggtggtctgatgttaggtgaattacgtatttgcaagtgttatagcttcctgatgaattgactgttttattatcatatcatgtgttcctttgtctcttgtgacagtgttttacctaaagtgtattttgttttatataagtatggccaaaacctctgctttcttttgtttaccactggcatagaatatctttttgcagccattcacgttcagcctctgtgaagtgagatttaaggctcacttaaatcttaggtgagccttttatagatagtacctaattgtataatggttttcattcactcaaccactctatctttagattggggagtttaatccattttttttcttatagtaattgcttttttttttttttttttttttttgaaacagaggcttgctctgtcgcctaggctggagtgcagtggcatgatcttagctcactgcaaactccgcctcccgggttcaagtaattctagtgtctcagttttcctgagtagctgggattacaagcgtgcaccaacacgcttggctaatttttgtctttttagtagagacagggttttgcagtgttggccacgccagtctcaagtgatcttcctcaagtgatccacctgccttagcttctcaaagtgctgggattatggttatgagccactgtggtcggcctctttttttatggagacaggctctccctctgtcatccaggctgtagtgcagtggggcaatctcagctcactgcaacctccacctctgggttcaagcgattcttgtgcctcagcctcctgagtagctggggctacaggtgccttccaccacccccggttaattttgtgtggtttttcatttttaatagatacggggtttcaccatgttggccaggctggtcttgaactcctagcctgaaatgatccacccactttggcctcccacagtgcagggattacaggtgtgagccactgtggcctgtatttggcctcattttttgttaaagtaattacagacaaagatttgttattaccattttgctaattgtttctcgtctggtttgtagctgttttgtcccccttttgctgtctttctgccttccttgttttttgtttttttttttaattgacatactttgttttctttatcatttcattttatgtatcttcaataggcattttccatgttgttaccatggggcttaaataaaacatcttacaggtacagtaatctattttaagctgttaacaacttaagttgaatgtatataaaactctttttttccccccaattttttttcaaggcggagtcttgctctgttgcccaggctggagtgcagtggtacaatctcagctcactgcaaactcccgggttcaagcaattctcctgcttcagcctcccaagtagctgggattagattacaggcatgcgccaccatgcctggctaatttttgcatttttagtagagatggggtttcaccttgtcggccaggctggactcgaactcctgaccttatgatccgtccatgttagcttcccaaagtgctgggattacaagcattagccactgcgcctgccctgtaaaactcatatttccccttccccactttgttgttgtttttgttttttctttttttgagacagagtttcattctcatcgcccaggctggagtgcagtggtgtgatctcagctcacagcaacctttgcctcctgggtttgagtgtttcttctgcctcagcctcctaagtagctgggactacagggttgtgccactatgccgagctgagttttttgtatttttgtggagacagggtttcaccattttggccaggctagtctcgaactcctgatctcaggtgatctgcccaccttggcctcccaaaatgctgggattacaggcgtgagccatcgcacccggcccccactttgttttattttttattattattactttttgagatgttgtctcactctgtcacccaggctggagtgcagtggcacgatcttggctcatttcaagtttcacctcccaggtacaagcgattctcatgtctcagcctcccaagtagcttggactacaggcgcgcaccaccacgcccagctaatttttgtgttcttagtagaggcagagtttcaccatgttgaccagtttttatttcttttggttatatccctaggagtagaattcctgggtcatttggttattctatattcaaccctttgagtaactgccaggatgttttgcaaggctgctttaccataatatatccctcctagcaatgtatgagggttccacttcctccatatgcttgctgacactttatttggttatagccgtccttttgggtgtggagcagtggtatctcattatgattttcatttgcattcctctgctggctaatgatgttcaatatattttcatatacttttgggtcatttatgtattttatttggacaattacatatctagagtctttgactatattttaattggggcttttttgccttttggttattaagtaataagaggtctttatatattttacatataagtccattattatatatgatgcaagtattttctcctattctttgggtttatttgatacacacatattttctcctcttatttgggttgtctttttattagtttgatcatataccttgaattacaagaatttaaatcctgatacattctgtttgtttgctattgttggtgtatgttagaaccattgtgtaattcttggttatgaggatttaccctatgttttcttctaaaacctttgatgcattttgaattattttttgtatatggtgtgagtgaggggtccaattttattttgctgcatgtgggtgtccacttgttgaaaagaatattctttttctttttcttttttttttttttcagacagagtctcgctctgtcacccaggctgcaatgcaacccagagccggatcttggctcactgcaacgtctgcctcctgggttcaaggagttctcatgtctcagcctcccaagtagctgggattacaggcatgcgccagcacgtctggctaattttaatttttttaagagagccagtctaggcacggtggctaggccgggcacggtggctcacagctttaatcccagcacttttgggaggctgatgcgggcagatcacttgaggtcagaagttcgagaccagcctggccaacgtggtgaaaccccatctctactaaaaatacaaaaattagccggatgtggtagcagatgcctgtaatcccagctacttgggaggctgaggcaggagaatcacttgaacccaggaagcggaagttgcagtgagctgatattgtgccatagcactctaccctgggcgacagagcaagattctgtctccaaaaaacaaaacaagagacagccaccacgcccagcctgaaaagaatattctttacctatttaatggtctttgcatccttattgatagtcagttggtcataactacgtaagaggttggttctgtgctctcaatgaggtggtggctcacacctgtaattccagaattttgggaggccaaggtgggtggatcacctgagatcaggagttctagaccatcgtgtccaacatgagggtcaaacctcatctctactaaaaatacaaaaagtagtcaggtgtagtgacacatgcctgtaatcccagctactcaagaggctgaggcaggagaatcgcctgaacctgggaggtggaggttacaatgagctgagatcatgccactgcactccagcctgcctgggtggcagagcaagactcttgtctcaacaaaaaataaataaaaattgtaagtgttagttacagtatttttgtagtaattaattacagtatttttgtagtaattaattttactgtgtttctgaaattggaaagtataagttttttaactttaccctttttcaagatcattttggctcttttgcatctttggtgtttcatattaatgttagaacaaggttgtaagtttctgcaaaaaagccagttatgattttgatagggattgtgctgaatctgtggggtagtttgcatagtgttgccatcttagcaatattaagtcttccaatccatgaataatagatgacttttcatccaattagattcgtctttcacttctttccatgatactttgtaattttcagtgtataaattctgcacttaaaaaaatttattcctaagtattttagtctttctttgtccttttataaatgaatttgtttttgatttcattctcaaattatctcatgtttatgaaaattttgtatattattttaatatttaatattaatacaaacattttgtatattattttatcgtgcaactttgctgaactcatctctgttaattaatagaattgattactgtttgttagtaatagtatttttttatgaattattttggattttctgtgtacatgaccatgcaatctgcatgttttctaatctagttgcccttttccccctttgcttacttaccctggctagagcctccagtgtgatgcggaatactagtggaaaaagcagacatccttgtcttgtttttgatgttaggaggaaataattgagtctttttcattaactatgatgtcagctgtggttttgttatattacctttcatatttagaatgttctcttttatacctattttgtcacatttgtaagatcttttttgtgtctattgagaagacaattttgcgtttccccctttattctatccatatgatgtattatattgattgatttttgtaatttgaaccaactttgaagtcctggggtaaatcctacttggtcatgttgtgtaatgttgttggatgtgttttgcttgtattttgctgaagatttaaaaatctatactcaaaggatattggtctacagttttcctatttgtgtgataccttttgtctagttctttttgttgttgatgttttttgtttttatatttttgagacggagtttcgccctcatcgcccaggcttcagtggtgtgatctcggctcactgcatcctctgcctcccgggttcaagtgattctcctgcctcagcctcccaagtagctggggttacaggcacgtgccaccacacccagctaatttttgtatttttagtagagacggggtttcaccatattggccaggctggtcttgaactcctgatctcaagtaatctgcctgtctgagcctcccaaagtgctgggattacaggtgtgagccgccgtgcccagccgtcttagtctagttctgctttcagagtatactggcctcatagaatgaacgtgacaggtagtttcttaagtagtgctttgttataacccaattgtggcctttcttatttattttctcccctttttcctgacatcctttactttcaccgcctttatatagatctacctttgctagtaaatagggtcatatgggtgctggaaataatccattcctgtgaattattattaatgtacatgtgaatattactgttaaagcagatgatgtcttttccttaagaatagttcacaattttcgttcattatatttcaaatattttcatataattttatttttacttcagttttgaattttttggttttgagtatgtattgaaaagatgagagaagctattcagtaaaaattttcctcccaaccctgtacctcagtggcttagatctgctctccagagatactcagtgtatgaattaccaagaaaaaggtagatgtgtgtttgttacacaaattcaacagtatatatacgttgtttgtaccttgatttttttgtttcactctcatatccatgcataatgagtttctcattttttaagcagcagagtgtgccatagtttttcgtttttgtttttgagacagggtctcactttgttgcttaggctggagtgtggtggcacaatcttggctcactgcaacctttgcctccggggctcaagcaatcctcccacatcagcttcccaggtagctgggactacaggcacgtgccaccacacccggttaatttttgtatttttggtagaggtgaggtttcaggttggtcttgaactcctgagctcaagtgttccacctgctttagcctcccaaagtgctgggattacatgcgtgagccaccgggcccggccagtagtgtgccataatttgttaaacctgttctcaattaatggacatttagtttgttttccagttttaagtaatttaaaatttagcatagttaaaaatcttaagtcatttggtatgtgtgagagaacctgaaagataaattgctatcgaggtttatttatttatttttgaaatggggttcttgctgttttgcccaagcctggtctcaaactctttccttcacttgagagatcctcctgcctcagccaaatagctgggaccacagccgtgtactaccatgcccagcttaggtcatttggtttgtctttggcgatatctcatagtattccaatttgaaatttcacttcatagttgttatactgatatgttcctactaacagtacagaaaagtacagattggcattctgttaattttttttaacatccagtctaaccacccccttttccaagtctgtattcccactcacaatctagtaattaaaaaaaaattttgagtaaagtatgaaattttgttaaggggctgcatgtatagttttgatatgaatgaagctatgtttcagatggttaatttactttggttgtttggaatttccaatggttttttattttacagagtcctgccaaatttataacaactgtagggcagggtgtggatagggatatttttactgagtaaatactattacatgtactagaggtattctgttatgttaaaatatcccgttagagatacatgatgaaacacatatggatgaaatattatggagtatgagatattgcaaaataacatggaaagatggggatacagataaaaatagattggccatgaatttgtaatcagtgagtctaggtgtttactatactggttttgtagatgtttgcaattttctgtgatacatcctttttcagtaggaattcagaataaagaaagtgctaaatatttgagtaaatcagttgactatgaaaataataatgccttatggtcttaaatacatatggcattaaaatataccacaacaataaaatataagttgataaggaggcagatggaagttagtttcctttactttctggcaggatgataacaatattcattaactttggatttttatgagttaaatattattattattatttttagacagagcctagcacccaggctggagtgcagtgatgcgatcttggcttactgcaacctccgcctcccgggttcaagcaattctcctgcctcagcctccggagtagctataggtgtgcgccaccacatcgggctaatgtttgtatttttagtagggacagggtttcgcctgttggccaggctggtctcaaactcctgacctcaggtgatcccgctcgccttggcctcccaaagtgctggcattacagatgtgagccatacacccggcctaaatattcatatttaaatttttaaaataacctaaaacatggaacagaaagcagaaagtttggcctagcacagtggctcacacctgtaattccagctattcgggacagttaggcaggagaattgcttgaacccaggaggcagaggttgcagtgagccgagattgtgccattgtactctaccctggaccacaagagagaaactctctcaaaaaaaaaaaaaagcagaatttttttttgtaatttatttttttttggaagattcatcctgtagattttctcaggctgcattgcgctgtatgcagctctgttatatggttttacatatttctcttactctgtacagtagtctccctttatctagaaactcatttttcacagtgtcaattacctgtagtcaactgaggtccaaaaataggtgagtatagtgcaatgcagttattttggggcagagagggagagagagcacattcacgtaagttttattatagtatattgataacattggcctttttttctttttcttttcttttttttttttttgagttagagtcttactctgtcacccaggatggagggcagtggcatgatcttgacttatgagctattagctgcaactacagacatgcaccaccacgctaagcagatttttgtatttttagtagggacgggattttgccatgttggctaggctggtcttgaactcctgacctcaagtgatccacctgcctcgacctcccaaagtgctgggattacaggcgcgagtcaccagccccggcctaggctgaatgatctagattgccactattaggaatggttttggggtttttgcctttttttttgtttctttaaacttttttctctgaggctccagaactaggaaagtcgaggtataaatagggtctaataatctgtattggaagagtgatgttgctactagtattctagtcctttggaaaaattcaccattttaatgaaaaggagaaaactgtatgtagttcagtcttgatgaaagagattttactttttaaaattaactttatccaaggtataatttacatactgtgaaattcgtacattttatgtatacaatcgaatactatttgcaaatttaatgtgttatgcaaccatctctgtaaatccatttcggagcatttctaccatcccagtaaagatccttctaatctgtatatagttaatccctcttcctaccactagtcctagagaaccaatagttgactgtctctgtagatttgccttttccctggacatttaatattaatggaatcatgcaatatgtgatcttttgtgtcttgttcttctcatttggtatatttttctgatttaaaaaaaaaaacttaccatctgtaatttgtccccttttttgctaaatagtattccaccatagatgtatgcctaattttatttattcattcattcattgattaacatttgggctgtttcaactttttggctgttttatcattttagttggtagtgtatactctgaggtctacggctattgctatactcatccagtatttgtcatttatctctttcttcacaatacagtgacattttgtagttgtatagtaggcatgacgtactggttgtgtggtaggaattagggcatatttgctgagaaccttaggggtagtgtgatttggctcttgctttgtttgatatttgctacatatcctgtattaaggtttgcataattactcctctttccattgacttgtgcagttttatggattttgatattttcttccagtatccaaaaggtcatattcctcctttgttcctgatatattctttatcttagcttggcaaatcacttacttttttgcctcactttgctcctctgtagtaagagtaggtgaattctccatgcttttctaactgaaaagtgctgtaactgggagagaacataggtagggagttggggtagttgaggcaaggaagaaagaggggaagcctagcaacagccaggaagcatctttttatgtatttttttatttttttgaggtggagtcttgctctgtcacccaggctggagtgcagtggcacgatctaggctcactgcaacctccgcctcccaggttcaagtgattctcctgtctcaccctcctgagtagctgcaactacaggtatgcaccaccacacctggctagtttttgtatttttagtagagacggagcttcaccatgttggccaggctggtctcaaactcccgacttcaagtgatctgctggcttcagcctcccaaagtgctgagattataggcatgagccactgcatcccacccaggaaacatctttttaaaaatcattcagttgtcaccatgctgtttcacttacaatatgttactctatttgtgttttatttttattttttattttttagacgaagtctcactcggtcgccctggctggagtgcagtggtgctgtcttggctcactgcaacctctgcctcctgggttcaagtgattctcgtgcttcagcctcagtatgttactttattttttatttagggaaagagttggtagacgtttctaccaaagtagaaaagtgccagatagtaaatattttaggttttatgagccataagttctctgtcacctaatagatgtatccagtacagaatttctcactttaatttccagtcttttgtgctatctgctggtttcattgtgagctgcaaggaaatagagagctggagtattgaagcctagtctgagaagttactctatgagagaagcaaaccccaaaggtagagtggaaacagcaattataagaggaaacgtggccaggcgtggtggctcaagcctataatcccagcactttggaaggctgaggtgagcagatcacctgaggacaggagtttgagaccagctgggccaacatgatgaaacactgtctctactaaaaatccgaaaaatgagccagatgtggtggcttgtgcctgtagtcccagctactcgggagactgaggcacaagaatcacttgaacccatgaggtgaaggttgctgtgagccgagatcacaccactgcacttcagcctgggcgacaaagcgagactccgactcaaaaaaaaaaaagaggaaatgcaacaagacttagcctatggaacctgccaagaagaagacaaaggaaggagactgtctaggattgagatccaatttgtgtgagggggttagtgatggatggggataaaggggcatgatgtgatagcatagggatctgttttaatgaaaaatgttcatggggagttttgagagactttgggatggaattatgaccttgccacctcaataattaactaataagatgggtttgtgtaagtcaccaccctgcccccactttgagacagggttttgttctgttgtccaggctggagtgcagttgcacaatcctagctcattgcagcctcaaactcctgggctcaagtgatcctcccgccttagcctcccaaatagctgggactacaggcgcgtgccaccacacctggctaatttttaactttttgtagggacgaggtctcgccatgttccccaggcttgtgttgaactcctgggctcaagtaatcctcttgcttgtgcctccaaaagtacttggattacaggcgtgggccactttgcctagctgttttcaccattactttgaagaaaaatgtatactttaatattttgatcataaaacatgacaaggttattattattttttgagatggaggctaaagttcagtggcacgatctcgactcactacaacctccaccttccaggttcaagcaattttccttcctcaccctcctgagtagctgggactacaggcatacgccactacacaattttttatttttagtagagacggggtttttccatgttcacaggctagtctcgaactcctggcctcaggtgatccgcccaccttggcctcccaaagtgctgggattacaagcatgagtcactgcgcccaaaccgtgacaagatttttttaaaggacgtacccaaaattccatttttaatctttcaattttttcttttcttttgatccataaagcaattgcatatatattaaatcttattctcctgccttttgcatacatgacatacacttttatgttattgggataatgacatataatcagttatatatattattattattttatttttacagatagggttttgctgtgtcattcaggcttgagtgtggtggcactgtcttggctcactgcagcccctatctcctgggctgaagccatcctcctgcttcagtctcacatgtagctgggaccgcaggtgtgtgccaccacaggcagctatatttttatgtttagtagaggcatggtctcactttgttgcccagcctgttcttgaactcctgggctcaaaccatctgctcaccttggcctcccatgccttttatgttttttgataattctgtttagatgtatagttctctgttttttagcatgagacagtaatacaaccatatgatactaaatcgatgaagtgtttgtaaagtggttttgaaattcatgtggtagtgccgattatataatattctgttgaaatgtcattcctgatattctacaaaatccatagagatgttgtttaaaatgcaggttgagcattcctaatcagaaatccaaaatgctccaaaatcgaaatctttttgaatattgacataataccacaagtggaaaattccacagttgacatcatgcaatgtgtcagtcagaacacaggaacacagcagagtttattcaacgtcccccagggaaaaactatccttccatcacccttcagcttagatgtatcttttgcatgcacagccggattttcccatgcaattatacccataaaaggtgataaaatggcacacgtgcaggctggatgcaccaacagaaagttttccaaaataacccacatggggcaaaagcctccttgcattattcattgtgtttttaaattaaaaagaattttttcctgctttgtggtataaagattttgttgaacttctcagaaagcctgaagatatccccatagattagagtaataagaaaggaggaagaatttaggtatagtgcagaaagtaagtcaggctcttggagaaactagacagtggtgtaagtgtgaaacatctttcagaagagtatggtattagactgaccaccatgtatgatgagacaggccctacaggaattcaggatgactaggacagagtaactgtgctgggatgtgctaattaagcaggcatgtgtaagtgtaaacttgctatgataggcaaaagcttgtgttctcactgttagtgatttcaaggcatgaatttcttttcttttctttttttggagatagtctcgccctgttgtccaggcttgagtgcagtggcacaattatggctcacagtagccttgatcttccagactcaagcattcttccctggtagctgggactacagctgtgtgctactatgcttggctatttttttttatttttatttttagtagagatggggtctcactatgttaactgggctggtattgaattcctgggctcaagtgatcttcctgcattggcttccctaagtgctaggattacaggcgtgagctgctgcacccagccccaaggcataaatttttttttttaaagtttggctctgtcacccagcctggagtgcagtggctagatcttggctcactgcaacctctgcctcctgggtttaagtgattctcatgcttcggcatctggtgtagctcgcattatagacatgagccaccatgcctggctagtattttttttttttttttttttaagtagagacaggctttcaccatattggccaggctggtctcgaactcctgagccaccgcacctgccccaaaggcatgaatttcttaccagttcgttattatgctaacagaaaggcatggatatctagggacatcttttctgattggtttcacaaacattttatagcagtagttggtgcttatttcagggaagctggacaggatgatgactgttcctccttgaaaactcttcggctcatcctgcagctgcaattttatcaaaaataatgtttatgccatgtgctttccctgaagtgtgacttcactgccatatgaccagggaatccctagattgatgaagagtaaatataaaaatgctttcttgaatatgctggcagctgtgaatagatgtatgggtgtgaaagggtttcaaaaggagtgaaggatgccatatatgctgttgtcagtgtctggaacacagtgactaaaggtacagctgtgcatgcctggcaccacttgtgaccttcagctgtgttcactgatgataatgaacaaggtggtgattttgatggcttcttcagtaaagtgagaaaaatgtgtaacatccttacatatgcaaaaagtataccttccatttgtcagtaagctggaagaagtggataacaagaaagcttttaatatcgacaaagaggctcccgtttctttgttcaacatggtgatagagctgacatcgatctgaatcagagtgattgtgataatgaagatgacattaacactgcagaaaaagtacctatagatgacatggttaatgtatgtgatgggcttattgaaggaccagagcagtgttcattcataacagaaaaagaaatcatgtcagtttataaaatgagagccttgggctgggcgcagtgtctcgagagcctgtaatcccagcactttgggaggccaaggcgggcagatcacttgaggtcaggagttcgagaacagcctggccaacccggtgaaatgctgtctgtactaaaaatacaaaattagctgggtgtggtggcaggcgcctgtaatcccagctactcaggaggctgaggcagtagaatcgcttgatcctggaaggtgaaggttgcagtgagctgagatcatgctgctgcacgccagcctgggtgacagagtgagcccccgtctcaaaaaataaagaaatgaataaaatgagatccttctagacaatactcgttgttaatgagacagatgactttagaggaaacattttaaaaagctatcccacagaatgcctcttcattcctagaggacttcctggttcctaattgcttctgatgatgtttcttcttaccttataaaataaaacagtatacagtaaccttttaatcaaaacacagcatcatagatggagacacaaagcccgacattgttattactgtttttttatcagctgatacatgtattctcgtgatactactgtgctgcttagctaccctgaacacacattactttttcactgtattaatggtatgtcatatttttactgttaagtacttatgtgtgaataagtataagaaaatgtttgcctgtcagtagcacataaattcagagacaggaatgatggtaatgccaaacaaccacagatattccacatggtggctgagataatgacacttttgctttcttatggttcactgtacacaaactttgtataatgtagaaaataaatattttgtaaaattaccttcaggctatgtgtatagaagatgtgtgtaatacataaatgagtttggtatttcaatttgggtcccatccccaagataacttattatatatatatgcaaatattacaaaatatgaaaaattctaaatcacttctgatcccaagcgtttcagataaggcatacttagcctgtaactcaagatgtattttacctatttacctgatctagatgctacatttttgttaggtatatattagctttatatgtacaggtgtcagtgactataagacctggctttaaatttaaccttttccttaattttggatgggccacatatattctattatttgtgtatataaggtaacacaagtccttttgtctccccccagctccttttgcatatgagaaaacataagccattttgtgcctcttgcatcttaagccatagtctattttactatgtggtttcccatctggttacttttgggagtatcagatggtctcataaaaacagtgggttttcctgaagctttttgattaatgttgaatttgtttatcatcttttagctgtgcggtcagagaagaaacgccttaggaagccaagcaagtggcttttggaatatacagaagaatatgatcagatatttgctcctaagaaaaaacaaaagaaggtacaggagcaggtgcacaaggtatgttgcaaaatttcagcaaactttcactggtccttaggaaactgcaattttatcttcaatgtcatactttatcttcatgaaacaataatttccttaactgagatcttgttttttattctcagcttctagcacagtacttaggatttagtggttattcaggaaatatataaatgaatctacatattgtatttatttatgtatatatttttccctctttgccttcaaagagtaatgacttaggaatattgttatgatttaatcttaagtaaaaatataggctataaagtgaaatatatatagtctgaccctaatttcaaaagtaaatatatcttatttgtcttatttttcaactcagttttttaaaatgaaatagagacatcttgacattctacccctacatagtttaatatgtagttaaaaaatggaacattttcctttataatcaatttaacatatttacatcttatataagatctgtttatctgacatcaactgtctttcaaatttcatcaattatcccctaacctttacctttggattattcataccaggactcaatctaggactgctcattgtaactggttgttatggttctcaaatcactttgaattcagaacaatcccttttttcatgatcatgatcatgtctataagagagtgacatataaagtcatctactttctgtatttgtgtaattgcttcctcataggtgtcacttagattgttttctctatctcctgttctctgtcaaatggaagatagaacctatcagtttgatagattgaaagttgaacatttttagctagactatatcagagatgataatgtggaatatattgtacattagagggttaaaaaatgttttattcccatcagccattccctgacagtttgttctttcttttttaaaattgagacagtgtcttgcccaagctggagtgcagagatgcacgaacacggttcactgcagccttgacctcctgggtttaagcaatgtttccgtctcagcctcctgagtagttgggaccaaaggtgcacactaccacacctggctaatttttgacaacattttttttgtagaggcggtgtcccactatgttgccctggctggtctcgaattcctgggctccagtgatctttctgcctcagcctcccagagtgttgggattacaggtgtgggccaccatgcccagcttccctgatggttttttgaaaaccccagttgaagatctttacctatatcaataattttattagaggttacaaaatgaagactttcagattttattattttctctatttttattaactgatagtctctttcattaattggactctgttattgtcctgaaatacttgaaaggcagaataagtgcttctttctttcccattaattaccaattgtaacattaaggagttcattagtagttgttttaattggagacattagagcagtctctttcccctgcttttgaattattgttgtggacttatcaatattatagcttcagtgtatctcagtcaacttcatttaattttggttaaaaaaatatatatatataatgtaaattttattattttatctttttttttttttttttttgagatggagtctcactctgttgcccaggctggagtgcagtggtgtgatctcagctcactgcaagctctgcctctcctgttcacaccattctcctgcctcagcctcccgagtagctgggactacaggtgcccgccaccacacctggctaattttttgcatttttaggtagagacagggtttcaccatggtagccaggatggtcttgatctcctgacctcgtgatctgcctgccttggcctcccaaagttctggaattacaggcgtgagccaccacgcccagcctattttatccatttttaagtgtacagttcagtagcatgaagcacagttagattgttgtgcaaccatctccaccatccatctcgataatttttttcatctttccaaattaaaaatcaatacccattaaccaataactcccttttctgctcagcccctggcaattgccattctattttctgtctcaagaattttcttattctagatacctcatatacttgaaatcatacgatatttgttctttgtgtcttaagtaatttcccttagcatacataatgtcttcaaggttcatccactttttgtagcctttgtcagaatttcattccttttaaagtgtgttattctttttgacacttaaattacaacaattttggcctgtggactctatttttattttttgttcttaggtaagttcccgctgtgaagaggaaagccttctagcccgaggtcgatctagtgctcagaacaagcaggtggacgagaattctttgatttcaaccaaagaagagcctccagttcttgaaagggaggctccgtttttggagggccccttggctcagtcagaacttggaggtggacatgctgagttgccgcagctgaccttgtctgtgcctgtggctccggaagtctctccacggcctgcccttgagtctgaggaattgctagttaaaacgccaggtaaggtggggttggggtctcagtatttgagcagatatgattagaggaagcaggagattttagtatgttttgatgtaaagccaacattgtatctatatacaataaactacccccttttgtcctgggaaatacttaaaatgatggttaattagatatagttactaaccatgaactgtggcacactatcaagaagatgtatttttaataactatgctccttgctccagtgttgctcttcatgattgttgatcagccactgtgtaaattaacaaccaggataacagggcttcaagaggagtactgcacattagtggaataagcactatgcttcaagtgctggctccaccaatccttgtgttacttgggaagttgtttaatctctgaacttgtttcctcatctataaatggagatcataatgtattaatgtgtaatgttatatacctgacaacatagtaattaccagttcattagaagttaattaccagttacttctcacttgatcattctttatatatcacctggggagagttggatctaaacatattgtctctaattcaccttgtaactattgaatattatagtcagtcaaggaatggcaagaatcctcttttctgtacccctttaaattttggatataacttttttacattatcaacagtagcttttgatgttattccttaaagaaacgattccaattgtgcttaaactagttgggtataataaaaaagatttttgaaagaacagtaaagatagttattatttcagtacctactatgtgccaaaactctattaagtcagctcttttatattattcttgagtgatcctatgaattatcttttacctattgaattttatttacttaggggcagagcagaaactataatctttgtccatttatgaccatgatccaagttctatttcactccacttctccttattttatcctcaccaacaatcagttgttataaaggcagttccgtccttctgacttctcccttagtgattttgtgagttaaagtcaccacacacacatccctcacattagttggtgcttgcattgaaaactgtttacttgttttgtttactaatattttataataagcaaattaccatcctgcctcttcccataagatgacggggaaaacatcaaaaacattgagattcattttgtgtggtatacagattttttaaaaattaacttgtgcccagtttctaaatcatctaatgtaaagatacatgcatttcaggaaattatgaaagtaaacgtcaaagaaaaccaactaagaaacttcttgaatccaatgatttagaccctggatttatgcccaagaagggggaccttggcctttctaaaaaggtatgttatttttgtaagttctaaaagaaataaactcaggaaatgagaaattttaaaaatgacattttgagtagcagttataacattgatgtacatacatatagaaattagtgtgtgtgtcagcagtcatacatgatctgagatttcctacatgaaaggctgttttgcagttgtgtgaccatgtatgtgtataaactggtttcaggtttcctttccaagtgaaaaaaatttttaaatgctttgaagattaagtttgtgtttgttataatttcttttctgggttcaaatcctcttacctgttttctactaaactactatctcaaatatcactagtctactctcctattgccgtgtcgtcgtagcccttttgttttgtttttttgagacagggtctgattctgtcacccaggctggagtgcagtggcataattttggctcactgtaatctctgcctcccaggctcaccagttaattttttgtctttttttggtagagactgggtatcaattttttttttatgtgataaatactttttgtgttttattcaagaaatctagtgtgatggtggccgggcgcagtggctcatgcctgtaatcccagcattttgggaggctgaggcgggcggatcacaaggtcaggatatcgagaccatcctggctaacatggagaaaccccctctctactaaaaatacaaaaaattagctgggcgtggtggcaggcgcctgtagtcccagctactcgggaggctgaggcaggagaatggtgtgaacccaggaggcggagcttgcagtgagccgagatggcgccactgcactccagcctgggtgacagggcgagactccgtctcaaaaaaataaaaaatctattgtgatggctcaagcctataatcccaggacttagggaacccgaggcagtaggattgcttaagctcaggagcttgagaccagcctgggcaataaaggagaccttgtctctacaaaacaaaaaactgtcccaaaaaaaccccagaaaatggtgtggtgttgcatgtctggtcccagctactcagaaggctgaagtggtaggatgtcttgagccccagaggtcgaggctgcagtgagctatgattgcgctattgcactccaccctgggtgacagagcaagaccctgtctcagtcaatcaatcaataaatgaaatttttgtgtgccccatggacacaaagatgttctccctgtgttttaggagttttttggttctggtttcacatatagatctttgttccatcttgaatttttgagatggagttttgttctcccccatattgatgtccagttgtttcagcaccatttaccaaaaaattgctgatattggctgggtgcggtggctcacacctgtaatcccagcactttgggaggcccaggtgggcagatcacttgcggtcaggagttggagaccagcctggccaacatggtgaaaccccgtctctactaataatacaaaaaaaaaaaaaatggctgggcgtcgtggtacctgcgcataatcccagctactcaggaggctgagacaggagaattgctggaacctgggaggcagaggttgcagtgagtcgaggtcatgccattgcactccagcctaggcgacagagcgagactctctctctctcaaaaaaaaaaagaaaaaatactccctgatatttatcctcaccctctcttagattcccagtatcttttaagtattaattatacttaataactcttcgtcacggttgaatttttacttttggggagagggggttgccgttaaatttgggatcagagcaagagaaaatcagaattattggttatggctagcaccaaactctggagaaaagtgtcctcttgtctgtttgggagtctgtcctgccatctgacctggcctacttcattgttgaagtcctggttactctgaggtatattttgtcataaggctaaagccatgattcagttccattttagtttaccaggcacaccaccaccctgtctgcaggtggattaatcagtatgtcaaacagaatgagagattgatctgttctggtagtgctttaagggtactctggcttaatgtatatccacactagactatatatacaaagtaagttactggcatcttagtcacatcctctaagaagttctttggtctttttcattctaaacagaatagtttgatttttattcatatggtatgattgttgtgtgtgtgcatgtgtgtgtgtgtgtgctgttaatttttattttaagttataaaattgatcataatagaaatgagactatttcctgcattattctctgactgtagtttggggagcattgtaattattttgttccacagcttttgggtaactgttaaacaatgaactaatttgttatctaaataaaatgattgctattttaaaaaaaattacagaaatgtattttgtggatttgtctaggagtctcgttttgttgaattggatacctgacatttgcccattcattttacttgaaatagacttctgatatatagtgaacgtgaggagaattgcagtcttatgatttattaatatgataaaatgagcattcagaaattcacagctgtattttatcttgttttacttccaaacattaggaactctacaacaaaaatggcctttattatttatttatttatttatttatttatttgagacagagttttgcttttgttgtctaggctggaatgcaatggcacaatctcggctcaccacaacctccaccttccaggttcatgcgattctcctaccccagcctccgaagtagctgggattacagggatgtgccaccatgcctggctaattttttgtatttttagtagaggcagggtttctcaatggtagtcgggctggtctcgaactcccgacctcaggtgatccgcctgcctcggccccccaaaatgctgggaatacaggtgtgaaccaccgtgcccagccagaatggcctttactatgctaactttttgtgaccactaaatgttgttttacagttatgatgaagaatatcatcattcttgtaggaaaagacatttgcttggggtggaactaattcatagaagtatattagtagtgggtgaggtgaataaaatgtgtggctcttgattagactcctgatgttgagtatttgttttgagttttaatgttgctttaatttggattaatctgaagtcattttaagttggaatgtcattcagtatttcagaactgtttaatttacagttcaccaggtaaacaggtctctgtcaaatctaatagctgtgaatacaattgtaggaagatgggttatttttctttctttctttctttctttttttgagacttgctctgtctcccaggctgttgtagtgcagtggcgcgatcttggctcagtgcaacctccgcctcctgggttcaaacagttctcctgcttcagcctcccgagtagctgggattacaggcatgtgccactgcacctagctaatttttgtataatttttagtagaaacggggtttcaccatattggccatggttggccaggctggattcaaattcctgacctcaggtgatctgcccccctcggcctcccaaagtgctgagattacaggcatgggccactgcacccagccatgaagatggattttaagtacagggtggagtgcaataaaattgagcctgtggatctctgggtacataccccttctctttctccatccatttcagtcacagaaagcattgtgtatctagtctatatgttggaaatctctggcaagtctttattttttcttaaggagtaggtggtgttcacaggtctgttggagcattgtttttgttttgttttaagatggagtctcgcttttgttgcctagactggagtgcagtggtgcgatcttggctcactgcaacctctgcctctccaagttcaagcaattctcctgcctcagcctcctgagtagctgggattacaggcatgtgccaccacacctgactaattttgtatttttagtagtgatggggtttctccatgttggtcaggctggtctttaactctcaacctcaggtgatccacccgcctcagcctcctaacgtgctaggattacaggtgtgagccatcatgccctgtctgttggagcattttaaaatctgattcctttccccctgaagtttccgttcaaccctttactgtggtcaggttgatttctttaattgctaaaacaagtcaaaattcaatatccatggcagctgacaattcagactttggcatataaagtaaagggtttattttttcattcctctgtaaatggtgttgttttcacttatttatagtgctatgaagctggtcacctggagaatggcataactgaatcttgtgccacatcttattcaaaagattttggtggaggtgagtatttttgagatttaaaaaacgtaatgcagtagtaagtttgaagtgctttgtctgttaaccacaaaaattgttacatgtgtaagcccgaccagtgaggtacaagttttaaaactggtttgcccaaaatctgcttcctgaaaaagaaaaaatattgataaattgaatatctactctaccaggacttttagtaggaatgctacctgtaatctctctaaagcgttacagagagttaggttattatctatagtattcctgttttatagaagaaatgtgaagatgaacaaggtagcaaggtcagggaactaaatccacacctgaccaatttcatggtcatactcctgtcttcttatccaccccaggttttctccatgccacttctttcttccactcttcatttgtctgccaatgccatttattgattagtgtcatttttgaaatattattccagatttgagcacactgcaacagatgtggtctgctagcaaagagtatcatgggaagattatatttcatgtggcctacgattattaaattttctaacaagtaaatctagcaacatgttagcttattttagctatgtgacaattgtaatcccataggttggtcaatttgcttgtaagatttaaaaataagctgctttcaaaataatatcaggccgttcatggtggcccacaactgcaatttcagtgctttggaggccaagataagaggatgacttgaggccaggtgttccatccagaccaggctcggcacttagtgagaccctgtctctatctacagtttaaaaaaatgagctaggcatggtggtgtatttctgtagtcacagctacttgttaagctgacatgtagcttaacatgttcaaggaacgatcccttgaacccgagaggttgaggctacagagagctgttgctcacaccaggcactgtagcctgggcaacaatgcgagaccatgtctcttaaaataatagtagtaataataataacaacagctcttttcctgtatttttatatttcgtttttaaaataaaacctacaacatgaactttatccattataaattttgtgttaagtgttccagctcatgagaatttcaaatctttctattgtgctcatattaactcttcttttagtgttaggctgcgagcagttttgatggcagagcttctccaactcaatcaggcagtcaaaaaagagctcactgaggcagtcttcaaaactccagctttcatactgttaactagcacagatatcctaaatgttttatgaaatacctcttagattcctctttatgtttctataacacagttgaaatgtgtttaacagaaagtgcaggagggactagaagaatttctttcttttttttttttttttggtttgagatggagtctggctctgttgcccaggctggagtacagtggcacaatctcggttcactgcagcctccacctcccaggttcaagcgattctcctgcctcagcctcctgagtagctgggactacagatgtactccctcacgcctggctaatttgttttgtatttttagtagagatagggtttcaccatgttggccaggatggtcttgatctcctgacctcgtgatctgtccaccttggcctcccaaagtgctgggattacaggcatgagccaccctgcccagcctcaaccctccatcttaatccttttattttttttatttatttttttttttttgagatggagtttcgctcttgttacccaggctggagtgcggtggcatgatctcggctcactgcaacctctacctcctggtttcaagtgattctcctgcctcaacctcctgagtagctgggattacaggcatgcaccaccatgcctggctaattttgtatttttagtagagacaggatttcactatgttggtcaggctggtatcaaattcctgacctcatgtgatctgccggcctcagcctctcaaagtgctgggattacaggcttgagccacggtgcccagtccttaatctttaaatcatatagtgatttgtattattgtctccagtcttgaagtctagggagtggtatcttttgatgactagtaaaatgcatttccccttcatctataggatttaattcctttgaagaactacaagatttgtcatttcaatcatataaattaaaatttctgtaataacctatacacttactatttaatctatatgagggagcagttacatatatgtagccatttcccttcttgttatgtcatcatgagttagtctcaattattatttcccccgttttcctaatccacaaagctggagaattaaatgagttttaaggttggtttttattctaataataggataagagattttggacatgtgtgttagtagccagcagttaacacctattttcctgtcataggcactaccaagatatttgacaagccaaggaagcgaaaacgacagaggcatgctgcagccaagatgcagtgtaaaaaagtgaaaaatgatgactcgtcaaaagagattccaggctcagaggtattactcagttcctgatcttttcaccttctaaagagaagctacttttcacgccagaggccacatccctctttcccttgagttttcttaagaatactattctactgaaatggctgatggccataaggaatcttggaggaaaagtagagccttatcctaataataaggcaaggcatgtattgcagctgtcaatatggtctttttaaaagatcatcacatcctatgctgtaggtgtccaatcaggtatataagtgtttcatcgttaagtaaacttgtaaaaccggagagtacaatatcaagtcaacatatgatctgaaggaacatagatactgtcctataaaagttgagactggccaggtgctgtggctcacgcctgtaatcccaacactttgggaggccgaggcgggaagataacttgaggttgagagttcgagaccagcctcgccaacatggtgaaacctcatctctactaacaatacagaaattacctgagtgtggtggcatgcgcctataattccagctaatcgggcagaggcacaagaatcacttgaacccttgaggcagaggttgtagtgagccgaaatcatgccactgccctccagcctgggtgacagaatgagactctgttgcaaaagaaaaaaattgagactgctggctgggcgttgtggctcatgccactcagctctttgggaggctgaggtgggaggatcatatgagaacaggatttcgagaccaacctgtgaaatacagtgagaccttgtctctacttaaaaaaaaaaaaaaaaaaatcgagactgctgtggttagcgggaagatttacttgcttatttcttgagaccatcagctacttaatcttaggacaatttttatgaatatcggccttcaggaaacaaaagatttaaaaccatttacttgcaaagcatcagtgcaatcattgatattatcttcgggtttccaactcaggttaaaagagagaagtcaggtcagcatcacacattatgatgcagaatgtttctttccaggacaatttgaatagaatgcccaagaggggcattatttaggaaacactgatcttggaaggacaaataagtaatcaaataaacttaagaatgttttctctcccttagtgaaaccttaaaatggaacagctcagaaagttccagtggaacaaacagcctcagagcagttagtggcagggcatgaggcgcccactacccgcccaatcacagcagggttagaactaacattgcatgcagtccgcccgagtgattggctgaacatctgtaagtgcttaatggctagacaaatagcagcccagagggagggggtcaaatggaagagacatcaataatacagatgtgggacattattttttctttgcaagggagaactaatgcctcacaggacggccacaagccccaaggagactgttgaggaaggtgtagaacacgatcccgggatgcctgcctctaaaaaaatgcagggtgaacgcggtggaggagctgcactcaaggagaatgtctgtcaggtagagaaatgtttgcccacttgtgttttcattgcatgttcatctttaaagggaaacccactccatctctttatgatggtttcttggtagaataacaatgcttttggatgattccagtggagtcactttctttaaggatttgacccctttttttctccccacaaagaaagatacttggagaaatagtttagtgttggtgaaccacgtgcccttaaggcccatgaaggaatatatgccgcgaaacaagtctgagatggaatatgtgaatctctggttgcttattcaaatataattctccagtacttctcatggtgtcacaatctttgggtttgtaagaaacttttcaagggtaattttagctttgagatgtttttcctttaatgtggtgactttagaaagcctaccacctatattgttttatttatttaataaatatttgtagagtatttactatgtatgaagtattgttccaagcactttataaatattacattatttagtcatcctaataatctcataagtagagttctatgattattcccattttgcagatgaggaaactaaattacagagaggataaatagcttgtttatattcatgagagaagcctggatttaaacttcggcagtctggatttagagtctccctctccgtttttctaacctttaagctccgttggacttggttggtttagagtcttaaccattttgttggattgcctctctgtgagataggggattccactttattgttagagacttgaagtctttgtgagtagagtcaatgaccatttgaatatatatatttttaatggtcttgatttacctatgtaattcttaaaatttagtatatacaaacttgaagttaggcaatgcgcagtggctcatacctacaatcacagtgcttctggaagctgaggcagcaggattgcttgaggccaggagttctagaccagtctgggcagcacagcgagacccctgtctctatttttaaaaaatttgtcttttttttaaattagccagctgtagtggctcatacctgtagcccaacaggtcaagattacagacttgtcttttaaataaacaaaaaacttgaggatgttagtttttcttttttcttttttattaattaattatttatttatttatttatttatttttgagacgaagtctcgctctgtcggccaggctgcagtgcagtggcgcgatctctgctcactgcaagctccgcctcctgggttcacgccattctcctgcctcagcctcccattctcctgcctcagcctcctgagtaccgggactataggcacccgccaccatgtccagctaattttttgtattttttggtagagatggggtttcaccgtgttggcgaggatggtctcgatctcctgacctcgtgatctgcccgcctcggcctcccaaagtgctgggattacaggcgtgagccaccacgcccggccagttcttcttttttaaattgaaaccataggccaagcacagcactaatctcagcactttgtgaggctgaggtgggtggatcatttgagcccaggaatttgagaccagccaggcaacatggtaaaaccctgtctctgccaaaaatacaaaaattagccaggcatgacagttcgtgcctgtaattcccctgctggggaggctgaggtcattggatcacctgaagctggggaggtagaggctttagtgagccatggtcatgccactgcactcccacctgggtgactgagaccctatctcacaaataataaatagtaatagataaataagttgagatctctaaaaaagtaaactcagaccagaaaatgttattgtggccaatataatttcaatccagtttctttgcctattatcttcactattacattcttggaccagatcccaaacaacagtcttaatcctcaaaaacagttatgcccattatttacttagtgagacaagtcagagtgtaaatacattttacaaagatcatttaatgaaaaggttaaaggtaaggtgaccctgtggtcctggcttgtctggatcagtctttgtgtaggtcccttgtgctgtcacaatttattaatagcacttcttttcactctcaggtgtcccggtttgaaagataaattacgtggttatcccagttgaataattagtctataacatttagttaatgcaaaaactttatttctaattcacgttgtaattaacgttttcctatttaagtgctgaaggtcagtttttttttttttttaccatatatagaaacgttattggcactctgaatatgcaaagtacaatatatagtgctatttttcagtttttatatgtgaatagtagataatggggagtcagacatttgaggatatctcagactataggttgataaagtccctgagttcccctatcaattccaggctacctctctaacctttctccctaaagctgtcctgttttttatttaagctttgattcttaagtgatcaagacctattctgtttctatgagttcttgaagctaaaacttacttagtcacctttccccttgtttgcttttcatagtagtacaaggctttaaaaatatttgggctgggtgcggtggctcacacctgtaatcccagcactttgggaggccaaggtgggtggatcatgaggtgaggagtttgagaccagcctggccaacgtggtgaaaccccatctctactagaaatacaaaaattagctgggcatggtggcgcatgcctgtaatcccagctactcgggaggctgaggcaggagaatcacttgaacccgggtggcagaggtggcagtgagccaagattgcgccattgtactccatcctgggcgacagagcaagacttcctctcaaaaaaaaaaaaaaattgataaatcttacaatgttttatagtgacagatgcccattgttatttcctaagcgcctgtcttaagtgaggccctatcttagctgagattatttcagaaaagtgatctctctctgggatggttgtaggtatgtcccaaaagggctgtttagaccttggtgggagctcttttggaactttatgatccaactctagctagccagtgtctgttgcttgaaccattcagtagctttctggtttatctctatgctcttttctgacctttctactcttgaactcgttttccatgtagcagtcagaacagtctttttaaaaatgaatacctgattttagctttcctttgttaaagctctccaatggtacacctttgtaactagactaaaatctacaactacgggcccttgcctctttctcacctccttttctgccacttttaacctttgtttactttaacccactgacactggttttactcttgattctcaaacatggaaaaacagatagatgttttctttctcttaacagaattgtgaaaaattgggtgagctgctgttatgtgaggctcagtgctgtggggctttccacctggagtgccttggattgactgagatgccaagaggaaaatttatctgcaatgaatgtcgcacaggtaaagtagatatcgaacggtcttcctccaaagaaagtttgaattttaagtttttcaggaaagacatttattggagacactattttgtggcaacactgggctagttgttacagatatagaaatggtgctgtggggtcactgctttcagaaaagctaccaagtgaataataaatgggtagcataatacagtgcaaaaagcattgtgttggtgatacatttagaatgtaatgtaagcaaagatgagctgatgccatagaggaagatatctgtgtttagctttaagagagaaagagaaattgatgtcgggaggggaagtgcagaaggtctagtaatgaaagcgtgtaaaacatttggggaatatggaatacaggccaatgtgtttatagagtttaggatattttaggtaaaaggcataggcagtaactaagagggcttcttggttactggtaatattttatatttcttaatctgcgtagtgattacatgagcatgtttacttcatcaactatactcttaggatgcgtgtactttatggtgtgtacattatacatcgataaaaatatttaccaaaaaagtaaaaagattatttgcgggttataatgcttagattgggttagaaaataggaatagtcagctgagaccagctggtaaagcacttcataaagctgcgctaaagtaaagtgttcttttttttttttttttttttttttttttttaataagagatgaggtcttgttgtccaggtttgagtacagtggcgtgatcatagctcattgtagtcttgagctcctgggctcaagcaatcctcccaactcagcttcccaagtagctgggactgcaaccacttgccaccatgcgtgggcaattttttttattttttgttgagaaagggggtcttactatgttgcccaggctggaaagtgttctctcgctctctctctcccttttttttttttttttcttagcatgatgtgtagatgttacagcatgtaaacagtgaagaaatcagggctgaggtatagatcttatgcctgtaagtcattgaagctgcacatctggatgatacttcccaaagaaaaagtgtcattagggtaggataatggtcagtgacactacctgggcgtatatgctcttataacgagttactggaaggagaggaggagctagtcaatatctctgaagccacaggagtcaggtgttatctgtaggggcagatgcagcaaagatactaaggaggttctggagtgaagagaggcttttgtatgtggcagtgagaaaatgcttcaatttttgccagaggatgtctcattacactagattgaagggtgagtggatagccgtatacataacttcttgaagaaacttgacttcagcagaaaggaagacagtacctaaagggaggatattatagggtcaagagaaaaatcattttgagtgtgtaaaacagctctattaaggtaaaattgaagtgcaaacaattgcacatatttcaggcctatgagttgataaattttggtatgtgtatatgtatgcatctgtgaaatcatcactcagcattattattttgagattcagtcaggttgttgtgtgtattgatagttcatttctttttattgctgagtagtagtttgttgtatggatttacttggttgttgatccattcatctgttgatagacatttgggttgtttcccgttttggttattataaataaagctgctgagaacattcaagtttttggacactttgtaccctccctgccccttccctccccctcccatttttcttttttttccttgagacagggtctctctctgtcgcctagtctggagtacagtgatatgattctggctcacttcagcctcaacctcccaggctcaagctatccttctggctcagcctccttagtagctgggactacaggtgcttgccacatgcctggctaattttttaaaatatttttgtagagacaggattttattacattattaccaggctggttttgaagtcctgggatcaagcagtcctcctcgttcagcctctgaaagtgttgggattataggtgtaacacacaattcctggccacattttcttttttcggtttttgtttttgtttttgtttttcagagtcttgcactgtcacccgggctcgagtgcaatggcgcagtctcggcaacctccgcctcctgggttcaagcaagtctcctgcctcagcctcccaagtagctgggattacaggcatgtgccaccactcctggctaatttttggatttttagtggagacggggtttctcctgttggtcaggctggtctcggactcctgacctcaggtggtccactctccttggcctcccaaagtgctgggattacaggcatgagccactgcacctggccaactttttcatattcttagtgatgtatttgtaagactaatagttcttaattttttgaaatccagtttatcaatttgttctttttatggactgtgatttgctgtcatagctaagaagttttgcttaacccagtgtcacaaagtttcgttgttgttttttttctttttaatctgcgacagagtctcactctgtcacccaggccggagtgcagtggcgtgatctcagctaactgcaacctccacctcctgggttcaagcgattcttgtgcctcagtctcccgagtagcaaggataccaggcgtgcaccaccatgcccagctaatttttgcatttttagtagagacgaggtttcaccatgttggccaggctgttctcaaactcctggcctcagatgatccacctgctttggcctcccaaactcccaaagggctgggattacaggtgtgagtcaccacgtccaaccagtgtcacaaagatttttagttctgtgttttcttcatagaattttttagtttcacatttcactattaggtctgtgatgtgttttgtattaaagttttgcatatgacatgaggtatagagaagatagaatttttttatttttggttttttaaatttgtgggtttttttctctttttcctaggaaagctattatctttgagagtaggacattttaccagttttggtacagtgtaagaaatgggagtcacttattagtgctcttggctcaccctattttcctgcaatagggtggtcacatcattgtttagattgcttaggtttaataatagctaccacgcctgtaatcccagcactttgggaggctaaggtgggcggattttttaaggtcagaagtttgagaccagcctggccaatgtggtgaaaccttgtctctactgaaaatataaaaattagccaggcatggcggtgggtgcctgtaatcccacatacttgggaggctaagtcacgagaattgcttgatcccaggaggtggaggttgcagtgagctgacaacatgccactgcactccatcctgggcgagagagggagattgagtctcaaaaaaaaaaaaaagttaccagttattcagcatcaggtagtgttttccctgtttacaaatacatattcaaatattgttcttaaaatatttatttgctggatgttctcagtgtttatagataaaatggatgatttgaatgagccgtttccagcaattacctgtaggaggattcatgttgaggtctgtttacctgtcaagcttaggctctttttcttatgttgtactgcatctcacagagagatagaggtctgtggtttttgttttgttttgtttttttgtttttttgttttgtttttctgagacagtctccttctgtggcccaggctggagttcggtggtgtgatctcagctcactgcaacctccacctcccaggttcaagagattctcgtgcctcagcctctgtattagttgggattataggcgcctgccaccacacccagctaattgttttgtatttctagtagagacggtgtctcactatgttccccaggctaggcttaaattcctggcctccagtgatccaattgccttagcctcccaagtgctgagtacattgcttctgggtggtttttgactttttattacaaaaatcttaagacatacaccagggtagaacaatgtaaagaatctccatgtattcagttaatttcagtagttatcaacttctctctcattttctccctatatttcaaaaggtttctaacacaacatctaatgtatagcgagaatatgtaataacttctttgtgtcatctaccagccagttcattttcaaattttctcatttgtctcagggatgtctttttattatgttttgaatcaagatctagatccagagagaggccaaaaacgtctctgtaggttttgttagggagattaccagcattgtatgtcgggtgatttcctgtagtgtaaacttttttatacatctcttaagtttctacttatctttaacaatactgcccccacactttttttttttttttttttttttttgaggcagggtctcactcttatcacccaggctggagtgcactggtgtgatctcagctcagtaaacctccaccttccaggctcaagcaatcctcctgcctcagcctcttgagtagctgggaccacaggcatgcatcaccacgcccagctaatttttgtatgtttagtagagatggagttttgccacgttgcctgggctggcctcgacttcctggactcaagccagccactcacctcagcctcctgaagtgctgggattgtaggcgtgagcctcctctcccagcccaacttaaatttcgttggttgcctcctggaggtatccccttaacttgttcctctgtcatccatatttcctgtaaacttgtagttagtccaggggcttgattaggtttaatttcagttttttctttttttggcgggggtgccagcggcaagcattttctgtagacaatatgtactttctgttgtatcacgtcagggagtatctattaccagattgttcatttataataatactaagattgttacagtgggttcagacgatgtcaaaccgatcagtccattataaaatttcttatgaacttttcacctaatggtttagcatttggtagattcttgaattcttactaatttatcttcttttggcttctcaggaatccatacctgttttgtatgtaagcagagtggggaagatgttaaaaggtgccttctacccttgtgtggaaagttttaccatgaagagtgtgtccagaagtacccacccactgttatgcagaacaagggcttccggtgctccctccacatctgtataacctgtcatgctgctaatccagccaatgtttctgcatctaaaggtatggatttcttatgtggaccagtctaattgtaaaacctcagtttaattggcaacagatattttcttttttctttctttttttttttttttttttggagacagagtctcgctgtgttgccgaggctggagtgcagtggcgtgatcttggcccactgcaagctccgcctcctgggttcacgccattctcctgcttcagcctcctgagtagctgggactacaggcgcctgccaccatgcctggctaatttttttgtatttttagtagagacggggtttcaccgtgttagccaggatggtctcgatctcctgacctcgtgatccacctgcctcggcctcccaaagtgctgggattacaggcgtgagccgctgcgcccggccggcaacagatattttcaaatgcaatcaatccaccatgtcactttatggcctctctctagcttttatcagagagattaccaacattgtatttgggagagaagaggggcataacgaactagttcagcagccaggcaatgccagggctccatagaacacaatgtggtcgtgtggtagggtattaaatatttggatttcatgtgagatgtagtttgagaaagtgttctgctgcatgtcctcttccccctattgattagaaaaccagagtgtagtcttcccctgggctttttttttattttattttattttattttatttttttttgagacggagtcttgctctgtcacccagtctcctcgatctcctgacctcgtgagccactcacctcagcctcccaaagtgctggcattacaggcgtgagccaccacgcgtggcccccctgggccttttttttttttttttttttttttgagatggagtttcgcttttgttgcctgggctagagtgcaatggtgcaatctcagctcaccgcaacctctgcctcccgggttcaagcgattctcctgtctcagcctcccgagtagctgggattacaggcatgagccaccatgcctcgctaattttgtatttttagtagagacagagtttctccatgttggtcaggctggtcttgaactcccgacctcaggtgatctgcctgcctcggcctcccaaagtgctgggattacaggtgtgagccactgcgcccggccggccatttttatatctctggtttcagtgtgatatcattcagaaatgcatgccaaggcaggattgggggtttcgtgttgatttgttttttgtttgtttgtttttttaatgaaaactcttgtcctagaaattttcttctgcttcatagttaagctgagacctgagttttccaaaactgtctgtgcatataggtaaacttaagttttgaaatgtgttctctttggtaaaacaagttgtttttgttgttgttgttgtttgttgttgtttttttttttgagatggagtttcacttttgttgcccaggctggagtgcaatggctcgatcttggctcactgcaacctccaccacctgggttcaaatgattctactgtctcagcctcctgactagctgggattacaggcacatgccaccatgcccagctaatttttgtatttttagtagagacagggtttcatcatatcggtcaggctggtctcgaactcctgacgtcaggtgatctgcctgcctcagcctcccaaagtgctgggattataggcatgagccactgcacccagcatgtgtttttttgtttgttttgttttgttttaaaacaggaggtctcgctctgttgcccagtgtgatctcaactcactgcaatgtccacctcccaggttcaagagattctcttgcctcagcccctggagtagcttggattacaggtgcttgccaccactcccgactactttttatatttttagtatagacggggtttcgccatgttggccagactgttctggaacccctgacctcaggtgatctgcctgccttggcctcccaaagtcctgggattacaggcttgagccaccgcgcctggaaaaacccaatactgtatctctgctggtgaattcatgtgtgccaaaagaaccttgactttttccatagaggattgaggaggtaaaatttagcagtgttgatgtttgttttaatcagactgtcagtaccttttttaggattatttcctggcctcatgggtctcataagtaatttcacttgttggatcaaaattgcagtttcgatgagtgtgatggtgtacacctgtatttccagcttcttgggaaggtaaagcaggaagtgggaagactgtttgagcacacagactttgaggtcacgtccagccttggcaacacagggaaaccccatgtctttattaatacaaagaaaaatgaaaagagttgcagttggctaccttctcgtttttaattgttattacagattgcattagagggtttggtggtggtttcgtgatggtttataatagatgaagtatttgaggggatgtgtttcctctggagagggtagagaggttcgttcacttgaaaggctttaaaagaatcacagagttccaggcaagcattattgttgtctcccctctccctatttattctggggctgatttcctagttgtcaggacagtggtttgagttgggctttcccttgttgaagcaggctcactgacagttacgggatttgattccttttggagacttatcacatagctcccatctgagttttcttgatggatcgagtgtttaagatccatcatcttagtggtcattccttctatttgtgacattttttcagtgctaacaaatagacttgaataactcacattctttttatatttaatatttttgtttttcttttgcttgtccctgattttcctgctttaggtcggttgatgcgctgtgtccgctgtcctgtggcataccacgccaatgacttttgcctggctgctgggtcaaagatccttgcatctaatagtatcatctgccctaatcactttacccctaggcggggctgccgaaatcatgagcatgttaatgttagctggtgctttgtgtgctcagaaggtaagaaatcatttcttcctctatttgtagtctaaaaagggattaaatcaatgttttaattggaacaaaaatacttttcatcatattgccactggaaaaaatattagaaatgatactattcatctgccattcaggaaatgatgtcccgaattaatgattacatagcagaactttttttttttttttttttttttttgagacaacgtttcactctgttgcccaggctggagtgctatggcacaatctcagctaactgcagcctccacctcccaggttcaagcagttctcctgcctcagcctcccaagtagctgggattacaggtgcccgccaccatgcccgactaattgtttgtatttttagtagagacagggttttaccatgttggccaggctggtctcaaactcctgccctctagtgatttgcccgcctcggcctcccaaagtgctgggattacaggggtgagccactgtgcctgtccagcagaactttttaaaacttggctttgttgcccaatagggagaggttttatttttcttattttgaataatgacttgaattttgttaaaatgataaacaattgaagcagtaaagacaaaaattcacttaatctcaccatcagaaaaaaaaaatcattgcttaatattaagtggcattattccagacattcatgcatgtcagcagatagaaagtctgatacctagatagaaacaattcttgaaaatagcattaccatgtaattgtgttttgttaacaagcaattttatacaaattaatagaaaaagagtgaacgtgatggaaaaagcgaagggatttgtgaactttagttatatattttctcattgtaagaatattagttcttaagagatcacgtagaggaaagataaattttctatatattttattcttagcactttcacccaggctggagtgaagtggtacaatctcggctcactgcaacctctgctgccacgccactccccatccctcccccaccggttcaagcgattctactgcctcagcctcctgagtagctgggattacaggcgttcaacatcatgccccactaattttttttttttttttttttttttgtagagatggggtttcaccatgttggccaggctggtctcttaacttctgacctcagttgatctactctcctcagcttcccaaagtgctaggattacagacgtgagccagtgtgcccggccattttattcatttttaaaatacttgttttttagagcagagttagtataaccttttacgtattttcttttctatccttatcatccctgacaacttgatttttgctagttaaatggaagattttagcactcatcaccagtatgttaattgtagtacctaaagttctgaattcgttatttcagtttttctcttggttgtctgaacttttgtgatcccacaggtgctcatttctctgctttgaggcatcatttgcctttgtactagaaggatatctagtacaaaggtaaatgatacttttctaagttcatggtaatggtattggtattttgtaatggtatttttctaagttcattgtggactttgctccactattttctagtgatgagagtggcaccagttcttcagttttctcatttattttcagattttattttgttgatttagtagttacttggcaataatttttttattatctacttattgattatgcagtttcctgaaaacctggctggctctgaacattctgagggactaattttaaaaagagtcaatatatgtaatagaatgagcattgtactttgaatctcaaagtccaagtttgaattctggcttgtctcttcaggcaaattgctttaccaaggcttggtttgcttgtttataaaatataggctctattccctatcacacagtcatattataatagcatcaattaaatgaaaagatatgattaaagcccttgcacagtgagaaaataagtttaaatggtctctggtctcatttttaatcctctgtagggctgactttttctgcagcctgcctcattttgtttgattttcttctaaaaattatctttgttattacccactttccctgcaagatgacttccttcaagaaaacaataccttctttttctttcctctttcttaagatatcactaaagaagccgaacacggtggtgcatgcctgtagtcccagctattcaggtggccaaggtggggaggattgcttgagcccaggaattcaagaccagcctgggcaatatagcgagactgacctcataaacaaaacaaaacaaaaaacaaccaaaaaaatagataccactgtgaaaggaaaataaatcccaggaggcccaaatcactaagccaagggaaaagtcaagcttggaactacatcaggcaaacctgcctcccattttattcctcaataatacagctacaaggctgggcgccatggctcatgcctctaatcccagcactttgggaggctgaggcaggcggatcacctgaggtcaggagttcgagaccagcctggccaacatggcgaaaccccatctctgctaaaaatacaaaacttagccaggcgtgatggcagacacctgtaatcccagctacttgggaagctgaggcaggagaattgctctgttctgttgaatttcaccctggcaatggaaaccgatagcttatcttcacaggtgtgggacagaaagtcatccctatgctcatctgagacaaatgcgtacctcattgcttcctctgccctatttatgtaaaaatgcagtttcactgagccagattaaattgtgtattcagtgaaaggctgatgaaggattcaaaagaatgcaaccttttgtcttttacctacttatgacctggaaccccaaccccctatcagaaccaatgacaatgttacacatactgatgtctcttatctccctaaaatatataaaagcaagctgtacccccaccaccttaggcacatgttgccaggatctcctgaggttgtgtcatggacgtgatcgtcaccttggcaaaataaactttctaaattggttgagacttgtctgacatattttgaattcacatcactaaggagatttgtattatcaggtgtatgtatatgccaataattctgtaaaagaagaattttccttacttgagatatattgtttctgtagccaaagactggagtttagttaattctggaagctttttttacttagttgaaatctgacagctagtacacagtcaatggattggtaaaactgctgccaccttagtataaaccaaggcactacctccaaaccaatacaagtaagcagtcatcgtgttctgtatcatcacctactcgcagtaaaagcatggcagtttcaccttagaagtttcttgaagtaaaacaccttagttttattatatcttgtccatgaagtcaacattgtttttctattctctgtgatgaagtgggaagtacacgtaaagcagtttctttgcatactgatggttatcttgagttaaagcactcatgcaactgagtttcaagctgaactatccacattgttcatggaacaccgtttttaattgtaagagttactgataaactatggttattcatgcttggatatttggcagacatttacttgaaaatgaacaactgtgagcctatcaattcaagaaaaagaactgcaaaataatggcgaatgataaaatttgagcttttaagtgaaaattaaaattttcgtaaactattgtctgctaccttcagtttgacaatttcttagtacttactgattggatcatggtagtattaataaatgtgattttaaaagtataatgaaataggccatttagaagatgcatatgactcaatgaaccaattttttttttttttttttttttttttgagatggagtctggctgtgtcgtcaggctggagtgcagtggcgctatcttggctcactgcaacccccacctcccgggttcaagcgatcctcctgccttagcctcctgagtagctgggactacaggcatgtgccactatgcccagctaattttttgtatttttagtagagatgaggcaatatttttaatatagctaatgcatgatgttaaaaactttgcatatgtaaaagatgcattcaaaatagaagacagatcaatgaattttagtgtagtcattttaagtttagtgacatagtttcagtttccacattgcaactatacactgtggagttttagcatagtatctaagaatgaatatccacagttctgaacaggttattttagcactcttttccagcaatatatctctgagaggccatactttcttcacgtatgtcaaacaaataacatattgcaacataattgttcttcagacttgttttttagcagcagacacatttccaaatgtaatcttactctgaatctgagcttcactatacaatacagacaaaagtgagcttttccagttgaagtaggagtctgatctgaaacacacccctggccccaacaaaaacaaataaaactcccactcttattttaagagcttgttgaagagaattattaagtaaaggcccttttggccgaaactgccatcttcctgtaattcgccaaaatgacaaacacaaagggaaagaggagaggcacccagtacatgttctgtaggccttttagaaaacatggagttgttcctttggccgcatatatgcgaatctataagaaaggtgatattgtagacatcaaaggaatgggtactcttcaaaaaggaatgccccacaagtgttatcatggcaaaactggaagagtctacagtgttacccagcatgctgttggcattgttgtaaacaaacaagggcaagattcttgccaagagatttcatgtgcatattgagcacattaagcactcctaagagccaagatagcttcctgaaacatgtgaaggaaaatgatcagaaaaagaagccaaagagaaagttaacctgggttcaactgaagcactagcttgctccactcagagaagcatactttgtgagaaccaatgggaaggagtctgagctgctggaacctattccctatgaattcatggcatcataggtgttaaaaaaaataaaagacctctggactgttaaaaaaaaaaagcaaaagtcagcatgggaataaattatatataaagtgccaacagaagtatgtttatagtaagaattttttttgtttcccagctgaagatttattggcataaatgcagccatctaaaaacataagttatgaaaaacagtcatgatgtgccctccccatccccccagcccaggcccctaaaacctcctctgggggagggagggagagagagaggaagggggagccccacaaccgtctaggaatgctcagcccctgggcccgtgcagggcgggagagccgggcctcagcacatcctgtagtctgtggagcaggacaggtcgcacagatggcccctgaaatctaggttgatggtgaagtcccggtcccagttcttggcgttgggccgcatgccgatggtgccgaagatctcctcgcccgtcttcaaggtcaggtagtcctccatgtagaacaccgtctgcttccagtgcgtgtacagggactcgggtatggtggagaagccggtccctccggtcctcttgtggcagtgcgtaaactcgatgttgaagtaggccacctgggtgtgcacgtagtcattctgcttcacttgcaggcagaacggggaggtgaaggtcaggtcttccaccttgacggtgtagatgtctacctcctttatgaggcaggcgttggtaaccagctgtttgaggtccaccacatccactagggtttccttgatggccacatctttgatgcaagatatatcgaagccataaacgttctcccaccagtggatcttgtagtctttgtactgccggtcctcggtggccgtcacatacagtgtggcccgttctgggaagatgaggctattgggcgccagccacttgtccgggcatagagcacagtgttgagcatggactcgtagaagaggcagttagcccatccacttgctgatgatgatgttcaccttttccaccgggagctctatctcctccaccttccccttggtgatggtcaccaagtggtctaacttgttggctttgacaatcttcaccgcataatcagagctactggaacactcgatgccgatgaccttgcgggcccggccttggcggcgaacatgcagaggatgcttgtgtccgagcccacatccagcaccaccttgtctttaaagaggtggcggttgtgaaacatggagttgccgaagtgggcgtaggagtcaaagtagtaatctttggacgtcatgccctcgacgttcggcttctcgctgctttccgcctggccacaggacacctccatgatgcagttcacgacctcggcggccgccatcttcacccgcacctactcctcttccggccgccaagacccccgcctttttctatagtaggattttaagaggtgaaagaagcacagtgagaacaagattaactcggatatattctttgctaaggctttactccccacttcagggtaaaacttggaattacatgtttgagtctagcatgtttgaatcatgctcatttctggcaagagcgtggctcatttctttttggcaacaaaataaaatgcctgcccgtctgctgaaactactgtgttttgaaagcatttatatatttatttatttgaggcaagagccttgctgtcaccctggctggagtgcagtggtgctgtcttggctcactgcaacttccgcctcccaggttcaagcaattctcctgtcttagcctcccgagtagctgggaatacaggcatgtgccaccacgcgtggctaattttttagtagatagggggtttcgccctgttggccgggctgttctctaactcctgacctcaggtgatccacctgctgcagccttccaaagtgctgggattacaggcctgaggcactgtgcccagccgaaaagttagtagttctaaaaggagggaaggaactaaccatatggagatactacttatgtgtcagacgctactaggtaatttattagctaggtgaatcttcaaacagatgtggttattgtttattagagaaaactccttaccgctgaggaaattatagctcagcaaggaaagtgaatttcccaagggcctgtggtcctagagctagaattccaacctgaacctgacgagagttaaataaagcttatgctgtttatactctggtcattatgtgtcactgataatgtttttatttagtatatcttttagtgaagagaaagaaaatatatatatatatgtgtatggatgtacacatacatgacttgcagtcttgtgatctgaatgccacatttttttattcccacaggaggcagccttctgtgctgtgattcttgccctgctgcttttcatcgtgaatgcctgaacattgatatccctgaaggaaactggtattgcaatgactgtaaagcaggcaaaaagccacactacagggagattgtctgggtaaaagttggacgatacaggtaagcctgaagaatagcactcatctcttttaccatcctctgtttcttgagacctctcagatacaatgcttaacgtatttctaatgatctacttaattactcatggtactcctcccctcttcttcttgatttttttccttataggaagagaaacctaactttatgatttacaattataggaataatacatgttctctgtcgaaatttttttttcttttgtgtattttgtgaaaagtttttttttttttttttaaatgaaaagacagtaataatctcacaaggcaggcgcattgttaacatttcggcatatgtactcccagacgtaccaatacgcagttatgccccccaccatccaaaataactgtttttacagattatactctgttatgtgtcttgggttgtttgttttgagacagggtatcctctgtcacccagtctggagtgcagtggtgtgatcattgctcactgcaacttcaaactcctgggcttaagggatcctgccgcctcagcctcctgagtagctgagactacaggtacatgccactgcacccggccactttttcttttttaaaatattttgattgaacatcacacaccgggaactgttgtggggtggggggtggggggagggatagcattaggagatatacctaatgctaaatgacgagttaatgggtgcagcacaccaacatggcacatgtatacatatgtaacaaaccacgttgtgcacatgtaccctaaaacttaaagtataataataataaaattaaaaaatatattttgattgaatatggaaagcacaaaggatgtaacatgcatgactttaaagaatgacaaaagtggcacctgtgtatgtacctcccacttaaagaaatagaacactgttggtacttttgaggtttattccatgccctgattccattctctcctacccccagaggtaaccactgtactcaattctaggtttttcattccttcgcccttctgtgagagtttgttttctttgctgtgttttagacctttatgtaaaggaattattgttgatacattttcctgcaacttttttcattcacttttatgcccctgagattcatcatagtattgtatagtggttcattcatagttcactgttcctttatgtagtcacataatgtctagttcacttatccattttcctgtttggactgtgaacatttggtcagtttttcttggtttatatacttgggaccttgaatataagtatatacttatatacaagtatatatttggtttatatacttagggccttctctagggcattctctggagtaaagtaggtagatagaggtttccagctttaataggtagtgccaaattgtctccctaaagtggctgtatagtaatttacattctttgattttgtttgtatgtgtttgtgttttgatttcttggtgctgttctcccatattcctactaattattgaaggtttcctttttaaagaccaaattgtattttattttgtatagtgtaccatggataatactattattttcttgatgttgagcatttatactttttccagtttttccttcttataatgcttcagtgaatgttattgtcataactctctgttcctatatcattatttcctttaagtagaatccttgaagtagaataattgagtctaagggagtgcgcgcctgtgtgggaatgtgggcagatgttttccagcttctagcacatacgacttgtttgtgttctagttaggttgtaagaatgccgtaagatggactttaatgtggacagacagacattgctaatccttacttttatatgagtaggttattttcctaatgccttgcagccttctagaggttttccttctccttttcacctttcccaggtggtggccagctgagatctgccatcctcgagctgttccttccaacattgataagatgagacatgatgtgggagagttcccagtcctcttttttggatctaatgactatttgtggactcaccaggcccgagtcttcccttacatggagggtgacgtgagcagcaaggataagatgggcaaaggagtggatgggacatataaaaaaggtaactttatcctttttgtttctcaggcaaacacagacctctgttacctgagtgtctgatctgttttagaattcacatatgctccattttgaaactgcctttgtcctctcagggcattatctggctgcaaatacagtattttgcaaggaagttgacccatgtaactcattatttttgagccttaacctttacttaatttgaatttccttgagcttttttttgacttatcagttgttttgtcagcattccatcaaataatggagttctgaaactatttcatagaagaaacacttcagtttgctagacagaggctcagatctctagcagagctacatttgctccaaggagtcttgtcttgtcttgtcttgtcttgtcttgtcttgagctcgttgggaagaagtaaaattcaccagatattgtagaacaaactagtaaaggtcaaagcataaatgctctgaatcaaaataaagttttgtaaactggcctagcaatgaaggcagggtgccctgttataagcagaactagttttactgcttaccaggtggtccaatcaacttcgaacccggttttctcttaccatgtaatggagaaagtttgctcttagaatacagtgggattataaaaagtgtccctgcagagtacataattggtatccccttagtggtaattaccttcttcctctagctgtcctttgaaagataatatatcccttgctatttaatttatttggtacttaaagtacaaatggttcccaactcagaatggtccaacttacagctttatgatgatgcacttccattatgttcctcagcttatgatgggattacatccaggtaaaccaattgttaacatgaggagcatctgtgtaagactttgtctatagggtgagatgaaaagggattctaagcaagtgacatggaagaagattctaagcaggtaaaacttcctggttagggaatgggagtaatgtcgatagggaacaagtttaacaaaggttctgtttgccacatgttattttagtagctcctcacttaccctgtttgtcttgtggtttctgtacatagatatgggctgtctatcagttctactgctaatacaaaaatacatagtactgtgctgttagtactaatacttcaggagctggggtcttgagtcttgtaatctcaggtggtcagggataaagtcgccagtattttggcctgcacagagctggccaccactgagactgggggagaaggcggagtataaggaataccgcaggtctgagcctgcctaagctctgagattctgccttaatcagggggtttctaggtgcctctgacttcttcgagcttgtatttttgcaggagaatctgaaatagataccagcagtcgaaatacctgccgggattttggtattattaatattgtggcagaagtgtgtattgtatatgctgtgggaacagagcaagaagaagctggggagcaatgtttggaagtcatgaatgattactaagtgactttgaggaatgaatcataataataatagttagcatttttgtttgccagaccctgttctgtgtttattttctgctttaagtgcttatgataaccctatgaggtggataccatcctgatcttgcagatgaggaaactgaggcacattaatgttaaagtactcgcctaacatatcagtaccagtaagtgatagaggaatgtttctgactcttatagtagggccagaatctaacctctacactgactttgaagaaggaaaaggacttaaaatgtgatacattttaccaagaaggcatcacatgtgaaagcacgtgttgaatctattaataaaatcctgagttagcaacctccaagtatttggtacagtttaagcacatggttgggggagtgttgggctattttcctgaaaggatgaagatctaactagatccctagttagagcagagttttagaaactttagcctgggacattgttgggaccattaaaaggtgagaggctgcaagtgggaaaatcagtgagatggctgttttaagtagtttggggcagaaatgacgagactctgctggacacagtggctaaagcctgtaatcccagcactatggggtcaggagtttgagaccagcctagccaacacattgaaaccctgtctctactaaaaataaaaaaaaattagctgggcatggtgatgtgcgcctgtaatcccagctactcgggaggctgagggaggaaaatcgctggaacccgggaggcagaggctaatgccactgcactccagcctgggtgacagagcaagcgagactctgtgtgtccacccacccctccccgcccgccccaccaccatcaccaccaaaaaagaaagaaagaaagaatgagactaatggtgaattgttcatggggatggagaatatgatttatattggatagatgttaaggaggtagactaggacatgctgaataatgttctagtctacctccttagaagaacacattttaggaaaatttagatgattctcctggaaagaacacattttaggacaatttagatgactccatggaacacatacaaactctggtagatggctacaaggaaatgaagaaaaaaggataggtcagaggggagaatttctttaaaggattgacagacttggggaaaggcacagagaaagtgggaagaatgggattctcagagtttttaatgtgggtgaagaataaggaattacagttttaagtgcagaatgagaatcttaagattttgttggacttttcagatactgcaatcttttaaacatgagaaagtacaggggccgggcacagtgactcatgcatgtaatcctaacactttggaaggctgaggcaaacagataccttgaccttaggagtttaaggccagactgggcaacatggcaaaaccttgtctgtacaaaaaaattagcctggcatggtggtgcatgcctgtagtcacagctacttgggaggctgaggtgggaggatcacttgagcccataaggtcgaggctgcagtgagctgtgattgctccattgcactccaaccagagtgttagagtgagaccctgtctcaaaaaaaataaagtacggtacttgagtgtagattagctatgaagatctgtgtatcattagagctaatagtttatatttacacaacaagtcttaggataagaggcaagaaggagaacaaagcttcaactttgactttctgccagaggagagtgagcacaatatctggggcacctaagatgtagcatgtttccgaaagtgggaggtttaggactgaggcaagaaaggcttaaaggcagtgactttgctaagcagatgaagcgtagttgttaggagatggcatctgtgggctttctaaagtcatttagttgtttattgttttctcatctaacgcacagttgtctaatcttttggcttccctgggccacactggaagaagaattgtcttggaccaaacataaaatacactaacagtaacaataactgatgagctaaaaaaaaaaaaaaaaaaaaagtccatgcataatttttatgatatccgccaccacagataagcaaaaaagttctcgtattcagatggatggatgccagtgatctaaagggtgatagtctgtattgtgccatttagttctggattatgttttgtcttaatactatgtctgaataccctttggactacattacctgtttgaaaatagctgttatgtgttttctttttcatatagcattggtcgatttttgtgtaaaacatggagtttctccaacttaaaggggaaaaagtaaaaaataagtgaataaataagtaattccacccagagattttgaagtgacttgtgctgtctgttttcatagctcttcaggaagctgcagcaaggtttgaggaattaaaggcccaaaaagagctaagacagctgcaggaagaccgaaagaatgacaagaagccaccaccttataaacatataaaggtgaggagaaaatcttgggggaccttctctagaagagaaatggaatagctggctcttcccactctgttcatgacaagaacggaagcacaagcatagttcgttttaggtagaggtatgagcttaaaagaagatcagaaatagccgggcacggtggctcacgcttgtaatcccagcactttgggaggccgaggcgggcggatcacctgaagtcaggagtttgagaccagcctggccaggcaggtgcctgtaattccagctacttgggaggctgaggctggagaattgcttgaacccgggaggcagaggttgcagtgagccgagatcgtgccactacactcaagcctgggcgacagagtaagactccgtctccaaaaaaaagaagaaaaaaagaaacaagtaccagaacaccattcctagcgcattgccaggattcccagtgtcaggagaattgattttaggtggacctaacctttaacctacctagtgaaatagtcatcaccattatcatctgggtccagtggagcctttgtattttaaacatttttatgtcatttatatgaataattgacagacataaaaataaagagacagtggagaacaaatgtattagaaattttagtgttatgttgttgctaaaataattgcagttttatcattacttttaatggcaaacctcaattacttttgcaccaacctaatatttactaaatcctttttacaaacctctttttatcagataagttagttgcgatgctcaaatatcataaaacatgaaagaatattgttaggcctgttgagaaaaggagattacccaggttgttcttgtaaaacatctttgatggcattgttcctggatgagaataccctatttcttttttgttcttagaaatgcattatttgttcacttatcctttgtgtgtgtgtgtgtgtgtgtgtgtgtgtgttgtttttttgtttgtttgtttttgagatggagtctccccctgtctcctaggctggagtgcagtggtgcaatcttggctcactgcaacatccatctcccaggttcaagcaagtcttctgccgcagcctcccgagtagctgggattacaggcgcacaccactatatgcggctaatttttgtatttttagtagagacggggtttcgccgtgttggccaggctggtctcgaactcctgacctcaagtgattcacccgccacagcctcccaaagtgctgggattacaggcatgagccaccacgcccggctgtgtgtttccaaagactgataatctgagatgctacttggagactaatttgaccaccatcttgagaatctagtatgtttaagtttgtctcaaatattggatcgagcatagttaaactgaaaaactttcgttgtttgtcagaaattcagattgaactagatgacttggatttttatttgctaaatctgataaccctaccgaaatcagaccttcaagatcgtgtctccagtgttttatacttgcttttttatttttaaactcctttcctcaggtgtagtagacggtcttttatactttttttaaacgacaatgcagtactttgggtaatgccgtaagaaatctaaagtgtgacagtttcagtatttcatcgtgcttatatgtgattccattgtgcttcccttgtcttttttttttttttttttttttttttgagatggagtcgcccaggatggagtgcagtggcacgatcttggctcactgcaagctctgcctcccgggttcaagccattctcctgcctcagcctcccgagtagctgggactacaggcgcccgccaccacaccgggctaattttttgtatttttagtagagatggggtttcaccatgttagccaggatggtctcgatctcctgacctcgtgatcggcctgccttagcctcccaaagtgctgggattacaggcgtgagccactgcgcccggcctcccttttcttattatttctgtcttctttagcatagttgtgaattattgatgagttagtaataatgtgtaatgatgaattagtaagttgttacaagatagaggaaaagtaagaacactaaaattccataccgtgtcttagatttagtctgatggacttacatggtatttacaagacagaatcagttttgttctttgtttgttcctttgagacagggtctccctctgtgacccaggctagagtgcattgctgcaattttggctcactgcaacctccgcttcgtgggcgcaagtgattctcctgcctcctgcctcagtctcctaagtagctgggattacagacatgagccaccaacgcctggctaattttggtattttttgtagagttggggtttcaccatgttgcccaggctggtcctgaactcctcagctcaaagcaatccacccacctcaacctcccaaagaactgggattacaggcgtgagctacgacacttggcctgaattttattcttttaaataagtatattttctttttgaactttggaagacctctaaaaagggataaaagtcataaacactgcttctgaagtctttttttttttttccccctgagacagagtctcactctgttgcccaggctggggtgcagtggcgtggtctcagctcactgcaacctccatctcctggattcagcccactctcctgcctcagcctcctgagtagctgggactacaggcattgtgccaccacacctggctaatttttgtgtttttagtagagatggggtttcaccatgttagccaggctggtcttgaactcctgacctcaggtgatctgcccgcctcggtctcccaaagttgagcctcccacggtgagccactgtgccaggcccagttttttttgcttttttctccccccctttattagagatgatgatttcactatgttgcctaggccgatctcctggcctcaggttgtcttcccacgttggcctcccaaattactgggattataggcatgagctgccactcctggcctttaaattgttactttaaatgtcataaaatatccataccaagattagattaaaaaaagaacaaaacgaaaaaagtcataaactgttaatccttacaaatgattacaacttctgaaattaagaatttcaaaacctataattggatctaaatgagtctcacaatgtatgtgaaaatatattcttggaacatagtcgttaggcctcagaaatggaaaataattctattcacatagtcctgagggtcagataacagcaaggtaggcattttagagttaacatattaaccatattgagctactgagagagcagtttcctgtgagtgatctcatcaagaacttagaggccaacttctttactccatttttttttttttttttaataaacatttccaggaaaaggatctagagcaggcattggcaaactatggttcatgggcaaatgtggtctactgcctattcttgtaatactcttgaactacaggttgtttttgtattttttagtgattggcaaaaaagagattttgtgacacataaagatgatatgaaattcaactttcaatcagtatccagaaaattttattggaatacaggcatgcttcttcatttacatattacatatggctgcttttatattacagtggcagagtcgagctacatgtggagatctatggcctgcaaagcctgaagtgtttactttctgaccctttacagaaaaagttacttaactcctgatctatagtgagatttacttagaattacatatccatgtctttgttcttaaccatgtgggatttgttttggtttgcttttggtttacgatgtgataagtacaaaacttatttttggattaataacaggttagatcagttgataagaaacaatgattaaaacatatattttccagcctgggcaacatagcaaaacccagtctctacaaaaaatacaaagaaaaaaaaaaatttggggtgcctgttgtcccagctacctgaatcacctgagcctggaaagtcaacgctgcagtgagctgtgattgcactactgcactccagtctgggggacagagtaagaccctgtctcaaaacaaaaacaaatatatatttgtagagagaaaagaagtagcatgaacctttatgtgtatttgggaagggttcaagtaaaaatatttcgaatcagaagtgaatgttcaaatgccctattcaggacttgtagtcttgggtgactgagattagctgttgttgtctgtccccttagaatttgccttagacattgtaagccttatgccttatggcttccagttgcatgtgttggggatatttctccattagcaagaagtttccaaaccttaccagtgttttgatgaatctaggaacagatctggcagtgagacctacatccattttccccacggacagcatcttgctggagtgtcttgcaggtctatacgatcctcccactgcagcttcctgagtagctggaacctcaagcacttgccaccatgcccggctaagctttataatttttttgtagacatagggtttcattgtgttgcctggtctggtcttgaacttctgggctcaaacaatcctccagtctcagcctccgaaagtgctgggattacagatgtgagccactgcacctggcctcctcctgttaaatgttgatagaaaaatggtttgatggcagcatatatccagattgtagatttcataatattaaaggggagtgggcaaataataaaatgcaagaaatgaaagcatttgaaaatttagaggacagaaatgacttttaagtaagtgattttaggtgtactggaatgagtaatctagaatatttgatatgagagaaacaatcataagggcattatataagaaaggaagaaagaatttaatatgtctaccatgtttaagaggcagctaggtgctgtactatacatatatttcttattcttacaatagtcttgcaagtaatttattcaaaatcacacagttcctgaacagtcaaaattttttgtgcggtttgtgtcttagaagactaaatttgactgttcccactgaaataatatgaaatgaggggagatacattctcatgcacaaatccattattgtactggaacatctattgtctttccttattgttgctagtatttgttaaaacctctacattaatggctttggtgtcacaataactgtttgaccttcatgttttaactcaccaaactttcactgtgtttttgagcactagcaccacttctaaattaatccatgagtgacattgctatagtccttttaaaagattttaaattataagctgggtgtggtgatacctgcctgtagtcccaactacttgtgaggctgatgcaggaagcatagaggaactcaaattacacacagatgatttcatgccatttatttgccacttaagaacagtgcttttgccaggtgtggtggctcacacctataatcccagcactttcagagaccgaggcgggcagatcacctgaggtcaggagatcacaaggtcaggagatcgagaccagcctggccaacatagtgaaactccatctttcctaaaaatacaaaaattagccgggcttggtggtgtgtgcctatagtcccagctacctgggaggctgaggcagtagaatggctagaacccaggaggcagaggttgcagtcagccaagatcccgccactgcactgcagcctgggcaacagagctagactccctctcaaaaaaaggaaggaagaataatgcctatttttttgtagcagcaaatgtgacaccaacatgtggcaatagcagaaacctagtttatagttcacctggcttatcagctttgaaaattttttttttttttttttttttttttttgagacggagtctcgccctgtcacccaggctggagtgcagtcacgcgatctctgcaagctccgctgcctcccagtttcacaccattctcctgcctcagcctcctgagtagctgggactacaggtgcccgccaccacgcctggctaatttttttgtattttgagtagagacggggtttcaccgtgttagccaggatggtcttgatttcctgacctcgtgatccacctgcctcggcctcccaaagtgctgggattacaggtgtgagccaccaggcgcggctgaaattattttttaaaatgaatttcaaaaaaatttttaaagttcatattttattttattttattttattttattttattttattttattttattttattttttgtgaccgagagaccgagtctcactctgttgcccaggctggagtgcagtggcacgacctaggctcactgcaagctcagcctcccaagtagctgggactacaggcgcccaccaccacacctgtctaattttttgtatttttagtagagacggggtttcaccgtgttagccaggatggtctcaatctcctgacctcgtaatccacctgcctcggcctcccaaagtgctgggattacaggcgtgagccaccgtacctggctcgtattttatttttttgagatggaatctcaacatatcggccaggctggagtgcagtggtgaaatcttgtctcactgcaacctccgcctcctgggttcaagcaattcttgtggagttcatattttgtatgtcaagtgaggctctgtttttatatgaaactaagtgttgatagttcaaaatcatgggaaatgtggctgcaacttcaaggaaaaaaagtttgcctttttcaggacgtgaattgtcttctgctgacttgttttatgcggtgtactttgtgttacttttccaggtaaaccgtcctattggcagggtacagatcttcactgcagacttatctgaaataccccgttgcaactgtaaagctactgatgagaacccctgtgggatagactctgaatgcatcaaccgcatgctgctctatgagtgccaccccacagtgtgtcctgccggagggcgctgtcaaaaccagtgcttttccaagcgccaatatccagaggttgaaattttccgcacattacagcggggttggggtctacggacaaaaacagatattaaaaaggttagaaaaagctaaattaccatatactttctcctctttgcagttgcttgatatcattgatccttgacattagaaaattcatcatagaagaaaataacacagttaataattaaccttattgttgtgtcttgccatatccttctaccgtttagaggcttacgaatggatggttttgatctcccaagtcctttgtattgatcatggtcactgtgtaggaggttggaaaaaatgggacattcatagagatgctatggctttgtttgcttttttgtgaatatcctacagctggtaattaagagagatgacagtgagcacatgatacagagacattgatccacctactaataaaacatttttagtgaggaaaaaacaggtctggcttcatgaaacatgaaggataagaaggttaagccttattggatgaaaatgcagtcatgtcttcaacttaaaacttggcaggatctctaagtttctaataaataaataatattgtatagtcttttttttttttttaataaaataagccttattctggttacattttctgaagaattttattggtttccaggaaatgtagtgtatatgggttggcgtttagtcatttgctaagtagttatttttatatttactgtatgtgccaggtattgtgctggggatgcactaaccaagacgagagatatggcctatactttcataaaatttacatttcggagggagagaaatattgaacaaatcatctcccagtgtgaaagtataaagggctctagagatgtgtgacaaaggaactgaaactagtttgtctctgatgatattatattttattttatttattttttgagagagggtctcactctgtcgcccaaactggagcgcactggtgccatctccgctcactgcaaccttcaacttccaggctcaagtgatcctcccatctcagcctcctgagtagcagggactacaggctcgcatcaccacgcctggctaatttttgtattttttgtggaggtgaggtctaaccatgttgcccaggctggacttaaactcctgggctcaaattatcctcccagagtgttgggtttacaggcatgagccatcactcttgacttgtgaggctattttaaattgagacttgaaatataagtagctgttgacccaggcaaggtgcattaaagccctgcaggttaggagtgaacacgtgtgaaaagccagagtgactgtagcataatgaatagggaggatggtactttgaaatatagagcagagcaagcaccaaggaagatgaacatagtttatttggggaagccaattctcgggctctggggcaggtagagattggccatccatctctctttataaggacgctctagtttacttactaatcttccattctggaggatctttagtatccagtgtatcctaatctttctgctgctgacagtggtaggagtaaggaggtgtttctcattatcaaatagttggggatcgtaaagtaattatgtgtgcctaaaattatactcatgtaatctgctttgtagaatgtgatgttttcattaattttttaaaaaaatgtatacatttggataccagtgtccttttttgccattaagtcaggaggtatttcttgttctagggtgaatttgtgaatgagtatgtgggtgagcttatagatgaagaagaatgcagagctcgaattcgctatgctcaagaacatgatatcactaatttctatatgctcaccctagacaaagtaagtaatgggaaatgctgttttcactgttacaagattgtaaatttgtgttgtcccagccatagtatttgtaggcatgtaacgcagttcccaaggtagggtcttttcccatacccattgggattgctggattggggttctggagtaggtaagagtgctcattttctgggtattcatggccagaggcaatacagcagcttttagcattgtttttgaacaattcaatgaaaattggagcttatatctttgagtattttttctacaggattacaagtttgaactcagaaaagtacataattcttttttattttattttacagttgagaaaattgttaaatatttaattattttactgataagattatgtaaatttttttttaaaattattttgagacagagtctcgttctgtcacccaggctggagtacagtggcatgatctcggcttgctgcaacctctgcctcctgggttcaagcgattcttctgcctcagcctcccaagtagctgggactacaggcatccgccaccacgcccggctaatttttgtatttttagtagagacaaagtttcaccatgttggccaggctggtctcaaactcctgacctcaggtgatctgcctgcctcggactcccaaagtgctgggattacaggcatgagccaccgcacctggccttagtttttataataaaaccctttcttggtatttacctttgtaaacatttctcaaattgtgcactaggatttgtgagatcttcacttccagatattctgatcttactttgggattgggactccgcattagtatttaaatctccttaggtgatttctaatgtgcatctgggttgaaactacctaaatagaaagtgggacaagctgctatttgtagggcagtggtcctcaaacttcaatgtagtcagaaacccctggcagccttgttatatataacgcagaatgctgcaccccacagtctctgctttagtgtatttgaagcacaacccaggaatttgcatgtctaacaaattgccaaatggtgatggtgctggtccagggatcacactttgagaaccaaagttctttgggatcttttctctgagaggttcagtctttacaaatagaaactccaacttattagagagaatagtcaaattttaatccacagcagaggtctcaggaagtctgatgtgtagcttcttttggaattctaggaccgaatcattgatgctggtcccaaaggaaactatgctcggttcatgaatcattgctgccagcccaactgtgaaacacagaagtggtctgtgaatggagatacccgtgtaggcctttttgcactaagtgacattaaagcaggtaagaatcatttcaggattctgcagctgacatctgaatttcagggcttttgttttttacaaacagcttcctcagattataattttaaacatttctatatgtaccgttctctggaattaagttcatttacatttttgtgcaaccatcaccaccatccgtctccagaactcttttcatcttcccctgctaaaactctatacctactaaacactaagtccccattcttctttttcttcacagcccctggcaactaccattctactttctgtctctgaatttgactactatatgtacttcatataaatggacaatatttgtccttttctgaccacctcatttcattcattcattgattcatttttaatgtttagggacagagcattgctctgttgcccaggctgcactacagtggcaccatcacagttcactgcagcctcaaactgggctcaagcaatcctgctgcctcagcctcctgagtagctagggctataggcacatgtccccattcccaggttttttgttttttgttttttttttgtagagacggagtcttgccgctatgttgccaaggctggtctggaactcctgggctcaagtgatcctcctgcctcagcctcccaagtgctgggattacaggcatgagccacctcgcttagcttggctcatttcttttagcacagtgtcttcggaacatggatggttttaatggaacaaattttcacattcatatgaacttaccactaataggtttgctttagaaactactagctcttcagtctcctttctcaccttcctgaagttgctcttcttccactttataaaccaaagattgatctctcactcttccatatcttatgggttatggacccaaggctattttaaaaataaaccactgggtgtggtggtatatgcctgtagtctcggttattcaggaggctgaggccagaaatcgcttgagttcaggagtttgagaagcagcctgggtagtatcgtgagaactctgactcttaaaaacacacacacaaaacaacaaaaacctctcaacctctaggatgtcaaagaacaggatctttggagaattcactgctctgtcatggctcacctgggtgcttgtctctctaacggggtagcgagatggttgtaaccaggacaaatagtaagaagctaatttgaatcgaaagtaaatctggtatggctgagtggtttgacagtaaagttatgtggtagatattttccataaattaaaggatcttaatctatagcttcaaggttttgatacaattattttaaacatatatacctatgcatgtaacaccctccaaattgcatgcttttttaagtattaaaatttgtggctgggcgcgatggttcacgcctgtaatcccagcactttgggaggccaacacgggcagatcacgaggtcaggagatcgagaccatcctggctaacatggtgaaaccccatctctactgaaaatacaaaaaaattagccggacgtggtggcaggcgcctgtagtctcagctactctggaggctgaggcaggagaatggcgtgaacccaggaggcagagcttgtagtgagccgagatcgtgccactgcactctagcccgggcaacagagggagattccatctcaaaaaaaaaaaaaaaaaaaaaaaatttgtataaacgttgtacattttgaaatgtacaagaaagttatgatttttcaaatgtagttttgcaaggatatgagcaaaacagttaaaatcagcctcttatactcaaactgggatagaactggcctaggtagtctgtaatatacagtaatatagtctaattactgttgaagcagaatcccatttgaatgttctggaagaccttagttctcctttgctcagtcactgttgtcctcaggaagcattgatcaagataaaagaattagaatgatatttgttcagatcttagtctgtttttgtgtgtgtttgtttgcttgcttgtttgttgaaacggagtctcgctctgttgcccaggctggagtgcagtggcatgatctcggctcactgcaacctccacctcgcgggttcaagcaattctcctgcctcagcctcctaagcagctgggattacaggcatccaccaccatgcccggctattttttggtatttttagtagagactcctgacctcaagtgatccgcctacctcggcctcccaaagtgctagaattacaggcatgagccaccgcgcccggcctgtgttttaaatttaatctatgggacttctcacactcagtgtacttttttctctacaatttaaatgtgttgtccaggagtctttcagactttttaggttgtgacaatttttagattttaaaatttgagccactagttactttcgggttttgcgtttgtttctcataatgttttacatgatgacaccaaggacacttgagcatcactgtgcactgcactctgcttatttgagactggtttttagttgcagatttatttcaagtttttggaatgggtggtttcagagtatattgtttagatttctactttgtaacaggagtaattcaataaatgatacggaataccagatacgattctaagcatattatctcatttaagccttgcaaaagtgctgtaaagtagatgatattatacctatgttacttttatccttggatgtcacacctctctcattcttttctccctttttctctctaatcgccccaggggtggagaggttcctctatattaaatcaatataaatatagttcctctataataaatcagtcacatgatttagttctactatgtctgctgagtgctgatagtcccattcttctacttagaacctgcagttcatgtccatggggatgccctcctctgccatgtctagccacaaatttctcttctttttttcctgtgttcatcagctcaggtagcttggtgttgaaattctcagactcttcctctcctcacttgactttcagtctgcataggttcaggatggggaaaatgagacaggatgtgctaagggacaggcagagtgcctatcagagctgaggccttcattcaacttcctgggcccttcacatacctgcaacttactgtctcccaagtgtcccatccctactcttgtttatctcttctctcatgctctttgccatgcccagtaactgaagatccatcaatgattgctgcatattgaactcttttctagaatggtatcactgtttagtttatgagcactgatactttctgatttaatttagcctctctgtgattacacttacatagtatatgttcagtgagcagcaagttatgacaagtatcctgctttcttttatttgtgtataaggtacagttgtattataagcacatcgtatctataaaattttagttatctatccataaatcttttattaagaaaaagacagtgtggggctgggcgcagtggctcacgcctataatcccaacactttgggaggccaaggtgggaggatcacttcaggagtttgagaccagcatggctaacatggtgaaacaccgtctctactaaaaatacaaaaactagctgggcgtggtggcaggcgcctgtaatcccagctactcaggaggctgaagcaggagaatagcttgaacccaggaggcggaggctgcagtgagccgggatctcaccaccttactccagcctgggcaacagagtgagactccgtctcaaagaaagaaaaagaaaaaagaaaaaaaaacagtgtgaatagaaccacgaaagattcaatccagttaagttcaggcatgagatgggaaacatgaccctcccgttaacattggtgagtctcactcagttcctgcaagctccttatggcatgagcctcatcaggccgtggataattctgctactcctacagcatgaccctaacgtagctgctggtattgtgaacatacttgataaagaaatagtgataagaatgatttcctttaacattcgatgaaaaactatgtatagcagtctcactgataaaaggtatgtcagtctgcaaagggaaatcttcctaagaattgacagtttttaatatgaatgatggttaccttatacattaactgtaaacattacccctgtgataggcaacctcttcacatatttatgtaaaattcttatatttggtaggcctcccataactggcttttagttatgagttttgagtttgaatgtttatttcctctcacagttttggtgaaatggacctttgacagaaagagagaaagaggacagtttgcctgttaatttgagtacctttttttaaagtttacacgttactgctatgtgcattttgtcatattgtctcaataagcttgtcagatttctccattttaaaatgggctgctcaggattcagattaccctgctaagtctgtgacgtagctggatctacaaccagtctgtaatctacagatttctagtgttattctgtactgagatgcctctccagagtgctgccaggtaacatgtgttcacctgagaacagacaaacaggttttcctcatacttgtattcccagggcctgacacattgataagttgttttttgtttgttttggtaatgaattaacatattttgaatctgaatggttaataaacaaatgaaaaacaacttgaggtaattaacacctctggaggaagagttatcttaaatattacttgttaagccatttaagttttctctgttaaattgtattacctgattattaatgttataagattagaattaattaaaatataggattagagctaaattctttttaaaattaatctgttctcttgggagttggtatcctttgtaattaatacagaaataatgtaattaaaaccatagatattaatattttcacggtctcttatgcaggcactgaacttaccttcaactacaacctagaatgtcttgggaatggaaagactgtttgcaaatgtggagccccgaactgcagtggcttcttgggtgtaaggccaaaggtaccacccttctagacttctgctttgggattagtggtgcggtcctccctccctaacagtgttagggcagtctacattttaagaagaaatctctttgaaattaatgacattcagccaggcatggtggctcatgcctgtaatcccagcactttgggaggctgaggtgggcggatcacctgaggtcaggagttcgagaccagcctggccaacatgatgaaaccccatctctaataagaatagaaaaattagctgggccgtggtggcatgtgcttgtagtcccagctactcaggaggctgaggcaggagaatcccttgaacccaggaggcagagattgcagtgagctgagatcacaccactgcactctagcctgggcaacacagcaagactccttctcaaaaaaaaaaagaaaaattcaatgacattgaataggtgttgatagggccacttgcaattcactaagcattcggctgatcaattatataagaggtttttggggatattgttgaagtgttttgggccatctgactttaattggtgctacttttctaactaataatgctgtgaaataggaccttataaagaaggttagttacctccctcgtcttgatctcacatctcctaataagccatatagattcttggtatatctgtgtctgtccctgtctttctctcactttctctttctgaagataccaaaaaatctgcagtttaagcttctaaatgtagcataacatcatagataaaagtagaactcttaatctcaccattataaaaaagtataagcattgttgtgtcttcctgtttttttagtatgcactttctgaataattgaattctaattctgtaactgttaagtatcatttccatgtctatattctccttattttttttgttgttgttgttttgtgtttttttttttgaggtggagtctcgctctgttgcccaggctggagtgcagtggcgcaatctcggctcactgcaagctccgtctcccgggttcacgccattctcctgcctcagcctcctgagtagctggaactacaggcgcccgccaccatgcccggctaattttttatatttttagtagaaacagggtttcactgttgttagccaggttggtctcgatctcctgacctcgtgatccgcccgccttagcctcccaaagtgctgggattacaggcgtgagccactgtgcccggcccttatattattattttttaaagtccttgctgatcatttttagtgactgtcttaatttttttatataatggatggacatactagatgaacatctggataattcaagatttctgtatcataagtaacagcacagtgaaaattgcagtttaattttgatacaaaataaactatatagtgacttcaattgagtatgttccatatgcctttttgattgtgaagctcaacattaagaactgaaaaatgcaaattaacatagaagccaataagaaaagagtaaataaatttttttttttttttttgagacggagtctcgctctgttgcccaggctgaagtgcaatggtatgatctcggctcactgtaacctccgtctcccaggttcaagtgattctcctgcctcagcctcccaggtagctgggattacaggcccctgccaccacacctggctaattttttgtatttttagtggagatggggtttccccatgttggccaggctggtctcaaactcctgacctcaggtgatccacctgcctcagcctcccaaagtgctgggattacaggcgtgagccactgcgcctggccagaaatgaagagcactcaatgatcattttttaatcttgttaaataaggagaatcacctctatattatactggattttattgtgctttttgtttagttttgttggtttaacggtgttgttccttaagatgttgacttgtttcctataaattaaaatagtaactcagtttaacctgtacttaatggtattaagtgtagtgcggatgtcagtttcagcatccttgatgtctgcatgggatagcatttcacaggagtcagtcagaggtagatgctagagaggtcactgtgtgctcttagtagatactggtctgtcagaatagggtggacctccattaagccttacagattggtcctggatgtttctgggttaaaatgaagaatgtgataagatgatttggtgaccaagtgtgggctgcagggaacaaagagagaacatctgctggctgctccagggtctgccttgggagtggtggacctgaagctaatttgacttgatgtgtagtcttattgacggcagggaccatgaattaacttttttgtgtcttaacacattgcttatagtaagttcagttatgctttgttgaatgaacgagaaataggcatgtgtacccacacacagaagtctagtttagttctgaaagtagacgaatataaaagtgaaactttggccaggtgcggtggctcacgcctgtaatcctagcactttaggaggccaaagcgggtgggtcacaaggtcaggagttcgagaccagcttaaccaatatgctgaaaacccgtctctactaaaaatacaaaaattagccaggagtggtggtgggcgcctgtaatcccagctactcaggaggctgaggcaggagaattgcttgaacccagcaggcggaggttgcagtgagccgagatcgcgccactgcactccagcctgggcaacacagcaagactccgtcttgaaaaataaataaattaattaactaataaaacttatgaaaggcatgtcatttaacaccagccttatggatcagcaaaaacacaaagatttttgtcttctgttttgttcaggtggcaggagtagttgatacaaaaattattgctacgtatctgtgatgtaccaggtacctttcctgcattttatcttcatgacaatctcttttcccagagaagagaatgaggctcagagagggtagttaacccggttaagattggtactaatgtgttcacagaatgctgactgttcaatatctgacctgtagaatcaacccattgccacggaagaaaagtcaaagaaattcaagaagaagcaacagggaaagcgcaggacccagggtgaaatcacaaaggagcgagaagatgagtgttttagttgtggggatgctggccagctcgtctcctgcaagaaaccaggctgcccaaaagtttaccacgcagactgtctcaatctgaccaagcgaccagcaggttggtgccaaaatccatttgtaccgctactcgttctctccatcatactcagggtctcatgccatttgcatcagccttgaagaaagtgccatttggtctttccatgcataattttgaggggtatggtctattttcttattttggaaataatgaaagcaaaggcttagaattcttagttatgaagaatgggacagcggtgcacttgctgtgtttcaggtcctttacttacagtcatgtttatttcattcccccagcagcccataatggttggttttcttccataatgcatgtgaagaaacagagtgaggattggggaggtgatctttcacacatagatagaggagctggattgagagctgggtttttgactccaagactattaaatcatgttgcctttctagagaaagaaagattgagatagtaaagcctttaggtggttctagtcagtgagagatggattgccacccttttagcacttcctaccttgctcccctacgcctagtgcagtctccccccatgcagagtagacttttttcctctaaaggagatttggttgtatcagttaatacatgagaaagctgctcaggtggatgtggtacccaggaaatttgtagttgaagaaattgagaacctttgagtagtgatttggggttagagaattttagggatttggatatgccatctattttaatgaacaaaaaagagaaaccagtagggagccattccagggtgaggagattatacattactagtgacctgcttccaagagttgcagaacgttaagaactttagggtataagtaaaaggaatttgtccccaaattggctttccttcactgtatattggccagggtcatgaaataaaagaaactgaggtaggatgagggcaaggccatcacattgacctgtcagcaccaggaagtagaattgtttcagaatcaactgctcagggtcgtcactggcgcaggctatgatagaaccaatcttgcctgtgtgccaggagtgggagctggtgtagttgatttgaaggtggaaacactgtccctggtcaagaccctcaggtttcatgaaatgtggggaggcaggtaaaagcttaggtcagctttgggtcttttctactgattccatgtgaacaacatataacgtgctgtgctgatctcaagacttaaaatagagcaaaggtaaatcttccatttttcatgattttatatcttttctattactgttaatagcaaataagcaggaatctaaatcaccaggatatttctctttgagttgcttatttaaaagctgtatagtacaaatggagattgcaaaaatataaaagtaatatcttaagtttcatgtaaaagaaactttttgttgtccccacccccgcccccccctcacctccttgctggaaatagtcatagaaataccaatttactcttctgcttgtatatttagttgatagtagttgctatttgataattcgctgttactttatgtattctgtgcacaaaaagaagctggaattctggggcaagaggtggctggtgagtggcataagctctctgaagcagggacagtgtgaaggaaggtcatcatccacaccttcggactgtagcatagccttggcccatgtgatatgtatctcttttttcctaaacttttgatttacttctgtgttttcagggaaatgggaatgtccgtggcatcagtgtgacatctgcgggaaggaagcagcctccttctgtgagatgtgccccagctccttttgtaagcagcatcgagaagggatgcttttcatttccaaactggatgggcgtctgtcttgtactgagcatgacccctgtgggcccaatcctctggaacctggggagatccgtgagtatgtgcctcccccagtaccgctgcctccagggccaagcactcacctggcagagcaatcaacaggaatggctgctcaggcacccaaaatgtcagataaacctcctgctgacaccaaccagatgctgtcgctctccaaaaaagctctggcagggacttgtcagaggccattgctacctgaaagacctcttgagagaactgactccaggccccagcctttagataaggtcagagacctcgctgggtcagggaccaaatcccaatccttggtttccagccagaggccactggacaggccaccagcagtggcaggaccaagaccccagctaagcgacaaaccctctccagtgaccagcccaagctcctcaccctcagtcaggtcccaaccactggaaagacctctggggacggctgacccaaggctggataaatccataggtgctgccagcccaaggccccagtcactggagaaaacctcagttcccactggcctgagacttccgccgccagacagactgctcattactagcagtcccaaaccccagacttcagacaggcctactgacaaaccccatgcctctttgtcccagagactcccacctcctgagaaagtactatcagctgtggtccagacccttgtagctaaagaaaaagcactgaggcctgtggaccagaatactcagtcaaaaaatagagctgctttggtgatggatctcatagacctaactcctcgccagaaggagcgggcagcttcacctcatcaggtcacaccacaggctgatgagaagatgccagtgttggagtcaagttcatggcctgccagcaaaggtctggggcatatgccgagagctgttgagaaaggctgtgtgtcagatcctcttcagacatctgggaaagcagcagccccttcagaggacccctggcaagctgttaaatcactcacccaggccagacttctttctcagcctcctgccaaggcctttttatatgagccaacaactcaggcctcaggaagagcttctgcaggggctgagcagaccccagggcctcttagccaatccccgggcctggtgaagcaggcgaagcagatggtcggaggccagcaactacctgcacttgccgccaagagtgggcaatcttttaggtctctcgggaaggccccagcctccctccccactgaagaaaagaagttggtaaccacagagcaaagtccctgggccctgggaaaagcctcatcacgggcagggctctggcccatagtggctggacagacactggcacagtcttgctggtctgctgggagcacacagacattggcacagacttgctggtctcttggaagagggcaagaccccaaaccagagcaaaatacacttccagctcttaaccaggctccttccagtcacaagtgtgcagaatcagaacagaagtagtaccaatcaatgtcacatgaacaaacaagctgcccccagggtaccatttggggaggggaaatcttttctttctttcccccttaaaaaaaaacacatctgccccgaacactttcccactgttattctttcctcatatcccaacactcagaactcttgtgacattagccagtgggggcttatggttgtgtgaaccatgtatgaaaatccagtgggccccaaccaaggagacagacagacttgggtctctttcccccaacttttccacatggtcatcgtgaaataaaaagtccactctggagtcaagtatggaattcaattccgctggtcaggttggaaggtataggggctctcaaagcgatttccccaaccagacagagccccattgagggcacctaggaacccttgggaggaaatggtgttctttcaaatcagtggcgatttcctgagcattcacgtgttctaggccgggtgctagtcactgatgagagatacaggcctcatccctgtgagcctggattccaaggctttcaggaacctttgaccaggaagtaacaggaagttctgaggggccctggggctttagactcattttgaaatgtcctttgtggcaccagaagtggttgtgttgaggaagtgtctcttggctgcggtgtgcatgggtgcgtgtgcatgcgcgcacactcacagaggtctcctctatagatgcaagggtgctgcattgaggccagcaaggctgttggctgtggggtcgccgctgctgcttttgtctgggctgtgcagagtctcaagatcagtccttggaggagcaggtggtcaggggcagtcgggctctgtgcgaatgtagatttccagcagtggaagaaggcatttggcaagcttctctttctttgcttttgtttctacctatttttctctttgtacatgaatccaccccatccctatttccctaaaacactcaggtgctttcagatttcagagcctcgggcagtggacatagggaatctctggcaagctctgagctagacacaccagcttcaggaagagtaccagatcctgatgggaaatttcttttccccattccttttccctcctgagtggagggagtcctcttcttcgcctccctgagaattgctgtgctctgtattgagagcacctgcctgctgacttagctcaaaggcaagccagaacccttccctgaagactggcaagaggtggtgtttagagcaacgtccaggctaagagatgactcctattaactgctgattatctgttactgctgccctgagctggggcccaagggctgggaaatctgttggtgctaccctgccctaccattcacccagctcacagactgccaacaggaagtgctgtttggctagtttcctcccacttgtctacccctcctttgtccttagaccaacatgtttacctctctgctttgccaacttagccagcaggccatccccggccctaacgtctcctggccattatctcttagttatggctttcacgctctcaataggattctgtatttggtcccaatttcctcaagttcttattgaggttactcccatcaattccacggagggaacagtagttattatagaagcatttgcgctttatctaaagattaaaaatagaatctgcttttatttcccaaagtctgtctctgaggttgagacacttgaactcaggcagagggacgaggctgggcagggctgtcctgagtttaggggcctatccctgcatttcactgagacctcggaatctcctctgtgaattccacctgcctagttctcccctttcatcctctctctcttcccacatcatcaaagaggaaaagctctttgttcaaaaggaagagaaaacgtaaagcatcttattttcttttaaaagaattttaaaccatgaaaaagatatttttaaagaaattcaccgagaacattaaagttcattatattaagtatttatcatgtgtgagaataataaatatataactgcagctagtaggtccctttccctaatcttttaggtcatatgagtagggtttgcttggtgccagtcctgtgcccttttctctccagtcatctgtagttgtgatcagaaaaaggtatctgcactgcactgtcagagtctcctttcactatgttgtgtgttaaattaccgtagctctttgtttcatgaaataaactgtgaatttggggggggcggggggagggcgtgcaggccatgtaaaaattttccgtggagaagtttgattctaaagtagcttctctaaagtaggctttggtaggtaatcaacttgacagcagtctagatgtctcacaggacaggagggagtgagggaaaggggccatgattggctgctttgtggttttattttggttctttccattctccgccattcattggaggcttcgttccagacctgcctgggaaaacagcttctgagccattttggggagcagttcttcatctgaatggatggacatctgggcttccttcaagggccattgaatgggaactagaaaaccactggaaactagaaatttgagctattgggcccaccagtagcagcatgtgatactagatggttaaaatcatgaaagcagtcactatccaattagaagcagagtcacaacaactgttgggaaatgtgactcttggaggaaggtggggagggagtggccttgccagccctgtgggacgtcccctgaagtttgtaataagaccccttttccaaagggatgtgaattggagtgaaaaggaaatctttcatcttagaaaacttctggtccttaacgcagggtggtatttgggtatgtgcttggaaattgagatctcaagagtgtttgccttggagccagctccccaggaggccttttccagggacaaggcaaaagttgaaattctccatgggtagctagaaagccaatacatctagccctgctaagtcagaaaaagattatgaaaaatgttgaaatttacattcaaagcctcatttgcttatcttgctggagccaacccagtctaatagcaaaatagctgtcattgatacagaaacatcctcatttttaaatgtctgctttaccctgttactgagtttgagatgacttaaatcactgtgttgaccctcttctgaaccaaatctttagcattgatgaaaatagttattttattctttacatccttcaccccacactatggtcagggcatgaaacaccctgttgatcccttcccaggctcggcactgtctgctcactggagccggactcccaggttgtaattctaatgttgcctcatgagaacagaatggcagaaagtttagtcctgacagattcccccatagggagtaatgaggacagcatgaaacttggataggttttacccttagtccctataaggtggattttactaaggttttttaaatgatactgtcatcctcttggggtttatcagccaggttagaggagcccagtgtcctaacctctctcagatcatggcagagaaggagctgcctccagcccctttcttgctgagtttcatttgagcagttccatgtgtagacattccaagtcactgcttggtagttgctgtgggagcctgtcattggctatggccagttagttctcagctgagcttcctagggccagtgcaacagggccagaggctgctatagtgtaaattgaaataagaatagatcattgttttgtacacacacacaataaaatgtaatgatggtgctaatttcacggtataaataagcactgccaagggttgagggactggcagctcaagaaacccgggttcctgtttgggaggagattttatgtagaaaagtttgaggctttgttaaaagtggggagaaggaagatcctcagtgaagcctgcacccaaccctggagtggcccagtgcaatccagaggtggaagagatcctatatccaggtgaaggtggccattgagtttctcagggctggggccaccttgtccatagcctccgtccacgctgcctggagcaggttgttagagagctctggttgttgggtcttcctcagctcccttctgcccctctctacctcttccactcatggaagcccctctactgcttatgaagattaagggtagtattttctaaggaagtggaaagaattaaactagaaatccacaacctcggaagaagtgtttcgagtttaacatgcgctgtttctgcttatgtggttccttctctagagctgctttcccatggctttcaaaacatcaggttattgtggggcttcaggtgtaaggtcctggaagttcagcaaagtttcgtggacaagacatgggcacagagagtagaagcagaaataaatggttctatgttttcaacttccagggttggggcaggccagagcaaggcggtctcatcgaggtgggtgctacctgtgtgtgtgtagatgagtgtgctgaaggtggggagggcagcacacagcagctcatggcagagccgcctcctaggtcttggcaaagaggcaagctgacgatagacatctacctatattgttaagaaaggggtcggggggatcagccaaggtccatcattgcttttttgccgcgcccccccccccccgcccccatagattgtcagctgtaagtgaaactcctagtgaaaaagaggggagccctgtgttaggagtccccataaacatgtactgtaattctttgtatatagaaaaaaaatttactgtaaagtaaagtttaactttactcatata

SEQ ID NO: 3 - DNA, 426584 bp, Homo sapiens
  source 1..426584: mol_type = genomic DNA
gatcagccaagcaggctgctgagaaagatgacctgaattgcagggatgcagaaagtgctgaagatgctttgtcagctgagaactggttaagagaaagtgggtaaagtccatttttccttccagctctactcttcctcaccttctaccctcttctgttcctgaggctgaccccaaaagacaacatcattgggctctgttgcccactggcttttggttggctcagccaatgggagttactcacagatgaaaagtgagagaaggtgcgatggctcatgcctgtaatcccagcactttgggaggctgagcggggagcattgcttgaggccgggaatttgtgaccagcctgggcagcatagggagactccatctctccaaagaaagaaaaagaaaagaaagagaaaaaaaaaaaaaggaaggaaggagagagagagggaagggagggagggaggaaggaaggaagaattagctgagtatggtggcacatacttgtagtgccagttacttgggaggctgaggcaggaggattacttgagcccaggaggtcgaggctgcagtgagctatgatcctgtcactgcactccagcctgggtgacagagcagaaaaaaaaaaaaaagtgggagaagggtgaggttgagggaatttatcttatttatttattatttatttatttatttatttatttgagacgtagtcgtctcactttgtcaaccagactggagtgcagtggcgtgatctcagctcaccgcaacctccacctcctgggttcaagtgattctccctgcctcagcttcccgagtagctgggattacaggcacctgacaccacacccggataatttttgtattttttgtagagacagagtttcaccatggtggccaggctggtctcaagctcctgacctaaagagatccacacacctcgatctcccaaagtgttgggattataggcatgagccaccgcgcccggccagttaagggaatttaaatttatttccttggcttcctctgtttcaggttgctatgggttgtgtgcgtccctctttcaggctgccttttctgcacaattctccctgtgtctgtggagcctagaaccttctcttcttcaccccttcaggtgtgggtggtaacagcttcctgtagttgctgttgcattatccaaccgatccagcctttgctgtaaatatattttattaaatgcttctcagattacccagtttgaatgtgccctctgttttttgcatgggcccttggaggtaagtgaggtagtattctctgcctcgttcctggactggctgaccaaggccctcccagttttctaactggatcaacacatgacattgctttctaaatggttttgcttccagcatcttttctttcttttcttttctttcttttttttgagatggagtcttgctctgttgcccaggctagagtgcagtggcatgatcttggctcactgcaagctccgccttccgggctcacaccattctcctgcctcagcctcccaagtagctgggactacaggtgcccaccaccacacccggctaattttttgtagtttttagtagagacggggtttcactgtgttagccaggatggtctcaatctcccgatctcgtgatccgcccgcctcagcctcccaaagtgctgggattacaggcgtaagccaccgcgcctggcttttttttttttttttttttttttttgagacagagtctcgctctgtagcccacctggagtgcagtggcgcaaactcggctcactaaaacctctgcctcctgggttcaagtgattctcctacctcggccttccgagtagctggattacaggtgtgtgccaccacacccggctaattttttgtatttttagtagagacggggtttcaccatgttacccaggatggtctccatctcctgacctcgtgatccacccaccttggcctcccaaagtgctgggattacaggcatgagccactgtgcctggcctttttttttttttttttttttttttttttttttgaaggcagagttgaaaaaccaattggaatcatagagaaggtgcccagactttggctactggacagaagttcctttttttttttttttttttttttttttttttagacagggtctccctctgtcacctaggctggagtgcagtggggcaatctcagctcactgcaacctctgcctcccgggttcaagcaattctccagcctcagcctcccaagtagctggattacaggcgtgtgccaccgcacttggctaattttttgtgcttttattagagatggggtttcaccgtgttggccaggctggtctctagctcctgacctcccaagtgctgggattataggcatgaacgaacatggtaaaaccccgcctctactaaaaatacaaaaaataacgagccgggcatggtggccctagcctgtaattccagctactcaggaggctgaggcacgaaatggagatatctccccttcttctgcttttttgttctatccttgccctcagtggattggaagatactcactgcatcgaggaggctgaatcttctttactcagtctacagattcaaacacgaatctcttctaaaaacacagacacatccagaaataaggtgtaactagctatctgggtatctcttaacccagtcaagctgaccccaaattaaccatcacagctgcatcatacatgaccccaaaacttagtggcttaaagcaatagtcatttattccccatgcacatgtgtaccagctgggtttggctgatctggctggggctcagctgggtgactcctctgctccacgtgtccctcctcttcctcctgggacagttgtttccgtggtgggagcagaggtgcaagagggcaggcagaaacacatgtggcttctgaatcctggtttggaactcactccttgccatttctgcccacctaccattgactgaagcaagtcacgtggccaagcctaaggccaagccatggagaagtacccaccacccatgatgagaccatcgcaaagataggcacacaggagagagtgactcatcagggccaatcattcaatctattcatggtcaccaactctggcaaaaaacacaagagtttaaaagatggttgactcaggatggtctcatttgcgtaagaggaaaagtagaactttttgacattttcaaaggacttctaaggaaaccaggatgactatttatgttgatcacgaagtgactcatacaagtcatgtgatttaaaaacaggaaaattcaatgctaattgcatagacttatgactccctgcataataatgacagcttatgtgacatagcatttttgagttcacgaggcactttaataaccacgtcttatgttatactaggaacaaatttctccttttttttttttttttttttttgagacagagtctcaccctgtcacccaggctggagtatagcagcgtgatctcggctcactgcaacctccgcctcccaggttcaaccgattctcctgtctcagcctccagaatagctgggattccaggcgcgcaccaccatgcctggctaattttttgtagttttagtaaagacagggtttcaccatgttggccaggctggtctcaaactcctgacctcagggaatccacctgccttggcctccgaaagtgctgggattacacgcatgagccaacggacctggccaagcctaggatttttattatctggccttttaccaaaaaaaaaaaaaagaaaaaaagtatgatgtctcttgacatgcatgatctcacgttttaattaaataaatttttaaatcaacaagtaaaaattgtatatatacttatggatgttttgatatatatacatacattatacaatggctaaatcaagctatttaacatatgcattaactcatataatccatatcgtactcacatggtttaaaattccctaaatataaaaaaataagcagagaaaagcggacccctatgattgattttcatgtgtctttcagagatggtttttgtcttagccctctttctgttgcttataacagaatacctgaaactgggctgggcatggtggttgactcctgtaatcccagcactttgggaggccaaggtgggaggactgcttgagcctaggagtttgagaccagcctgggcaacacggcaaaaccctatctctataaaacatttaaaaaatcagctgggcagagtggcgcacgcctgtagtcccggctactcgggaggctgaagtgggaggatcacttgagccagagatgttgaggctgcagtgagccatgatcgcgccactgcactccagcttgggtgacagagcaagactctgtctcatttaaaaaaaaagtatacctgaaactgggtaatttataaagaaaaggagttaatttcttccagttacggaggctgagaagttcaaggtcaagaggccaaatctgaggaggagctccttgttggtggggattctgcagagtcccaagtcggtgcaggggatggcatggtgaggagctgagtgtgcaagctcaggtttctcttcctcttctcctctcctctcctctcctttcctctctttctttttaaaatagacacaggggtctcactatgttgcccaggctggtctcaagcttcaggtctctcttccttttccccttccctctcctcctctcccctcccctcttctcccctcccctctcctctccttttaaaaatagagacaggggtctcactatgttgcccaggctggtctcaaacttctgtcctcaagcaatcctcctgccttggctttcaaaagtgctgggattacaagcatgagtcactgcccccggctcatctttctcttttcataaggccaccagtcccacttccataacaaccccttaatccattagcccattaattcattaatccataaatgaatcagtccattcatgagggctgtcatgacccagtcaccttgtaaaggtcccacctcccagtactgccatactggggattcaatttcaacatgaattttagcagggacaaacagccaaaccataacagttttagaagcaaatattattttcttgttgttcctttttaacacgatctcatttaatgctcacaaaatccccaccaggtatgaaggattagcctggttttactgatgtggagatgaagcttgggcagggtcccaggctggcagggtggattgagtccttttgttctccaggccgagggaccccagggctggcttcttctctacactccagtgtaggtgacggacctggaggcctcctggcctggggaaaatcccaccagctttgctttgagttgcttcccatcctagtggctccccagctgctgaactacgggctggactcacccacatagaaatcccccaatctggtttttttttttttttttttttttttgagatggagtttcgctcttcttgcccaggctggagcgcagtggtgcaatcttggctcactgcaacctctgcttcctgggttcaagtgattctcttgcttcagcttcccaagtagctgggattacaggcatgcaccaccatgcccggctagttttttgtatttagtagagaccgggtttcaccatgttggtcaggctggtctcaaactcctgacctcaggtgatccacccacctcggcctctcaaagtgctgggattacagccgtgagccactgtgtccagccaaaattgtctgttggtctaaacccactgacatgggctgcattcttcttaatccacacttcccagacgtctctttaaaatagaaaatttcaataaaataaaataaaataaaaacaaaaaagaaaagaaaaggaaacaaaacaaatatagaaaattactagcctgggcaatatagcgagaccccatctctacaaaaaatcaaaaaaattagctggacatggtgtcgtgagcctatagtaccagccactcagaaggctgaggcgggaggattgcttgagcccaggaggtttgggctgcagtgagccatgattgtaccactgcactccatcctgggcatcagaatgagatcttgtctcaaaaacagaaacaaaatttcaaatatacacaaagtagagaagtagagagaatacaatgaaaaaaatacagcaaatccccaaggccctatcacccagcttctccaattagcaattccctcccttcccctcccctcccctccctccccgcttcccacctcccagtactgccatattggggattcaatttcaacatgaattttaccggggacaaacagccaaaccataacagttttagaagcaaatattattttcttgttcccttcccttccctcccctcccctccccccttccctcccctcctctcccctcccttcccttcccattctttcccccttcccttccccttcccctttcccttcccccttccctttccccttcctttcccttcccttccacaaggtcttgctctgtcgcccaggctggagtgcaatggcatgatcatagctcaccgcagcctcaacttcccaggctcaggtgattctcccacctcaacctctcaggtagctgggaactcaggcacgcatttttgtatttttttgtagagacaggtttttgccatgttgccaaggctagtctctaactcctgggctcaagcgattctcttgcctcagcctcccaaagtgctgggattacaggcatgagccaccctcgtgcgtggccaattagcagttttctgctcttcgggtgtatcttttcccttcttttctggtgggattttttttttaagtagaggtgaaattcacataacataaacttaactattttaaaatgctattctggccaggtgcggtggctcactcttgtaatcccagtattttgggaggccgaggcaggcaattacttgaggtcaggagcttgagaccagcctggccaacatggtgaaacctcgtctctactaaaaatacaaaaattagccgggcatgggggagggcgcctgtaatcccagctactcgggaggctgaggcaggagaattgcttgaacccaggaggcggaggttgcattgagctaagattgccccactgcactccagcctgggcgacagagcaagactctgtctcaaaaataaataaataagtaaataaataaataataaaataaaatgcaattccatagcacattcacgatgttgtgaaaaccatcacctttatctagttccagaacattttcatgaccccgaaaggaaaccccatccctgacagcaatcactccacattccctctccacctgcccctgccaatcactcacctgatttccatctctatggatctgcctactctggacaatttgcataaatggaatcctacaccatgtggtcttttgtgtctgccttctttcactcaacatcatgtttttggggttcatccacgttgcagcacggatcagtgcttcattccgtttcatggctgaataatattccattgcatagctatgccatattttatttatgtggtgctgtttcctggagtttttaaaaaagcaaatccaggtatcatatcaccttatccataaatacttccatatgcatctctaacagacaaacacttttaaagaacaccataaccaaataccaccaacagtccttacaaaactcacatgaattctttaaaatcccctgacacccagtcaggttcgattttccccacctgtctaaatgctgctttgttcttaatgaggtagattctccccattttggctcagccttgggaaaaatacggagattctctgtgcccttgatgctgctgctgcttcttctttttttttttttttttttaaatgagacagagtttctctcttgttgcccaggttggagtgcaatggcacaatctcagctaactgcagcctccgcctcccaggttcaagcgattctcctgcctcagcctcctgagtagctgggattacaggcacctggctaatttttgtatttttagtagagacagggttttgccatgttggccaagctggtctcaaactcctgacctcaggtgatccacccgccttggcctcccaaagtgttgggattacgggcatgagccaccgcaccggcctcttgatgcttcttataggaaaaacaaaacccctatctttaacaggaggcccctttgaaaagagacatgggattaccctagttttgagagcataagtctacacagattgcaaacaaacttaccaagttgtaatggattggtgttttgcatgaaaggactcaactttccttttcctgcctttcttctttaataatacaacccctctgcctaagggaggagatcagggtactgggaagctgtttccagaatgaacacgacagactcagagaggaggctagcagctgtcctctaattatcatttttctaagagcataaataatttaggttgcaatgtggcggagtggagatggttaaattataacacgattccatatccctgctgcctgatgcctattctacacgccccctccccggacccccgacaggaaccagtggaagagagagaatactcttcttaccaccgttcctctgctctttaagggaagcccgaacggggggaaaaagtctcctttttgagacaacagttttgccctgtgctgggaggtcccagtgcggtgttaaggggcatagagaagagagcaagaaatcgtgaattatttttccccctgaggagcagtggcctggcttgttctcagcttctgccttgcctggattgatctccccaggctgggtccccgtgtagcacttagctaaagatgatcagcagctgagaacgatcggtcctcctttccctcctcccagcatcagggaaacctcctcctcctctttttttttttcccttggcagctgatacagcaaccccgttcagtgtctgcttttgtggggagccctctgctcagaaaactgctcttcttggcacccacttttctccctcctgtctctgggccacccttcttctttccactgggtgggccatggatgcatggacttcagatagctcggacccctgggtgctgacgagatgggaccctcgggacccctggaggactcgcagtgctgaccactagccgcgtcgcctgagccccagcgctgatgcgatacaggtgagtggggcttctgagagcgggggacgctggaggcaaagtcctgcagggagtttaatctttctttccttgctgcaaattacctccatctgcaaaggtagaaatacaaagatcttcccctgctccctctatgaagagtttttctttgcgggcgggcagcttatttccagatttcacttgcttctgccttaagaacctcttcccttttctgaacagtttctcttgctgggaagaaggggggcagactcttcatttccagcgtattcctgtttctttcttaaaaatccattttcattcaattgcccttggcaacccccctcccagcaaccgatgtctttgccatctgccctgaacatgtgacgttttcccaagaatgagaatttctgacctaagtcaaattctacttttttatatcttccccaccccccctcattcaagtccacattttaagtctcgtgctgctttgaacaagtgacaacatttagaattatgaaatatcccctcaccgctccccaccccccaattgcccatggctttggggaccccgaacaaaagttcccgacgcctgtgtgcctgggccttgtttgctgtgatcgacgcggcgtgaatgtgttgggaaaagagagataaatggcagatggagtttaggctgttgggaataattacatcgtcttaggaaaccacttcttccttttaatatttaatattcttccctctcttgccccacttgaaggaaaagcagagaaagagctggacaccccctctaagccattccccccttgccccttccgccttttttctttaattttgaaccgagttgtctgggtggcttttgtttctcaataagtgggaaaaactggcagcagaattcctcttctcccctctccttcctttgaagctaacagcttcgtacaacagacgctgctggggacggcagggcatggggatcatgttgattgctccaggctccttccttagaggctcctgagagactgacccaggagaaggagccaatttagaatgtcaacaggaggtcagagcaccttcccagaggctgaaccaacaagagggaagcttctctctctcctccttctcctcaaagccctaggtgctgtggaggaatattctctaggtatccctggctcagggctcctgtcctgttcagagacagtgactctagggcagccttgccgtgtcctgcacctgctctttcagggatagccttcagttgcttgcagggatctcaggtgcttacagctgacacagacctccccttacccatgtgacccctagtccatcctcaacaccccaataccaggctgcaggaagtctccccaactacagaagtctaagaggctgagtttatccctgtgtggatactccattttcctccaagacacagagatctcaggagatgtatcaagatgtcactcggtggccgggcgcagtgactcatgcctgtaatcccagcagtttgggaggccgaggtggacggatcacttgaggtcaggagaccgagaccatcctggctaacatggtgaaaccccatctctactaaaaatgcaaaacatttgccgggcgtggtggcaggcgcatgtagtcccagttactcaggagactgaggcaggagaattgcttgaacccgggaggcggaggtggcagtgagccgagatcatgccatcacactccagctggggcgacagagcgagactccgtctcaaaaaaaaaaaaaaaagtcactcggtgcaaatgccactttccctccacataagatgggttcaattcaatgcagcctccccaaaaagaaaacagaagatcattacaggggtcaggagggagagggtggatttgacactgagtgaaattactgagcaaatgacctgtaaaactcgtggacatcaaaagctctggcagagggtttcatttattattattattatttaaaatgttagggcataggaccagagggccctctgggcccagggcaaatgagggagcttctattccaggatccttcaaccctagctgtctccacagtgacagacagacgaacgctctgggtaagcattttccacccccttataggccaagtttgtccagtggacgagggaggactgacttagcctccggggaagaaatcctcccctcaaagtgcaggtcttggccagtcccaggctccactcagccctgctgagttagaatctgcatttgaacttgaggctgggtgagtcatgagccagtcagcatctgagaagccctggaggccacatactcattggcgtgtgacccaggggagccactcagccctctgtgcctcagtgccccctgctgactgcaaggatgacgatggcgtctgtgtcttagcattgctgagaagcccagccacaggtgatacccagtggcaggcacctagtacgtgctcactaaatgttggctactttcaaattactctccagagcatgtgtttgatttatttttattttttatttatttatttttgagacagagtcttattctgtcacctaggccggagtgcagtggtgcaatcttgacttactgcaacctccgtctcctaggttcaagccattcttctgcctcaactttccaagtagctgggattacaggcacccgccaccatgcctggctaatttttgtatttttagcagagacggggtttcaccatcttggccaggctggtcttgaactcctgacctcgggtgatccacccacctcggcctcccaaagtgcttggattacaggtgtgagctaacacacccagccaatttctttttaaattatggtaaaaaaacacatagagcataccattttaactatttgattgattgactgattgattgagacagggtctcactcaacgcccaggctggagtgcagtagcccgatctcggctcactataacctcaacctccagggctcaggtgatcctcccacatcagcctctcgagtagctggtaccacaggcgtgcgccaccacactcagctaattttttatgtatttttgtagagatgaggttttgccgtgttgcccaggctggtcttgaactcctgggctcaagcaatccacccgcctcagcctcccaaagtactgggattacaggcgtgagccaccatgcccggtctctgatttcttttttagttcacatttctttcttcttcctgtaccacttgtcttaccctccatgaaatcgtcctggtcagacatgagtaacagaaccctactagttagtatggaccctactaactcatacattaattcttagctaccaacaccaaaatcttgaagatggtaggcagacaccatcttcaaacatcttttttcaggactcaactcaagggctactcactttttttccccaaagggactacaacttttggtgtacagttatttttctctccagcaaaaccaacactacattttcttttgaccccccaaggggaggcaggttttgttttgtttttgagacggagtctcgctctgttgcccaggctggagtacagtggcgtgaactcggctcactgcaacctccacctcctgaattcaagtgattctcctgcctcagcctcctgagtagctgagtacaggtgcatgccaccacacccagctcattttttatatttttggtagagacagggtttcatcatgttggccaggctggtctcggactcctgacctcaggtgatccgcctgccttggcctcccaaagtattgggattataggcgtgagttatggtgcctggccgggaggcagtttttaggtgatttctctagagtcttaagatcccaagatgaatgataattggatcacagtggtacacagttggtagttaataaatatttgttgaacaaacaaagcatatcagaattcaaaatgaccactgagggctgggcacggtggctcacgcctgtaatcccagagctttgggaggccaaggtgggaggattgcttgagtttgggagtttaaaactagcctgggcaacagagcaagatctcgtttctataaaaaattttaaaattagccaggcatggtggccaatgtctgtggtcccagctctcgggaggctgaggtgggaggatcgcttgagcccaggagttagaggttgcagggagttctgattgtgtcactgcaccccagcctgggcaacagagcaagaccctgtatctaaaaaaaaaaaaagccagaaaatgacctccataatgaattattgctttaacatgttaatatgttgatgacacacacagacactgtctggccaaagaggcaggataaatgagggacatggtgaaacacctaccagttgctcaatattgaggagtcaagaatacctaatcaggaaaaaaattcaaggagatagaataaaagcaacattacccacccactcctgcccaagaatgacttaagagaacagatgcatggtttagtttgtgggagaaacattagagaaatacagtccctgtgggaggagttttatttttttcctggtactctgtactgtttccttttagttctccaatgctgatgaagtcaagcaagtttgtgagagagacagagagagagagagagagagagagagagaaggtggacaggggatgacacatggtgctaagtgtccaggtatttggttcagtttcagtattgacctgatgccactggttttgccttgcttggacaagaggaataattgatccaccttcttccttccttccttcccttccttcccttccttcccttccttccttccttccttccttccttccttcctttcttccgtccctccctccctcccttccttccctccctcccttccctccctccctcccttctccttcctccctcccttctccttcctccctccctcctttccttcctaccttcctaccttccttccttccttctttccttccttccttccttccttccttccttccttccgtccctccctccctccctcccttccttccctccctcccttctccttcctccctccctcctttccttccttccttccttctttcctttctttttatttctttctttcatccttccctcctccttctctctctttcttccatctttctttcttcttccctccttccttctctctctctctctctctctctctctgtctctgtctttctttgtctggctctgtcacccaggctggaatgcaatggcttgatcatagctcactgcagcctcaacctccagggctcaagtgaaccttctacttcggtctccctcgtagctgggactacaggtgtgtaccactgcacctggctaatttattattttgttgttgttgttgagatagggggtctccctatgtcgcccaggctggtcttaaactcctggcctcaagcaatcctctggcttcagcctcccaaattgctgggattacagaggtgagccaccgcacctggcaatctgcctttcagcaattatttattgagttcttcctgttggccaggcactgtgctaggctttgaggattcaacagagaatgaaactatcattgtaaacacagtaataacagtagcaaacactcatattggggcttaccatgtgtgggacactgtcctgggcatgctgcatagaattaagttatttcatcctcacaatgacactgtgaaggatgtgtttttattatccccattttacagatgaggaaactggcccagagaggtggagcgatttacccaaggtcacatagcaggaggcagctgatcctgaatccaagcccaagcagtctggttgcaaagatggggatatttctctaccaactcctggcagcagccattggttgaggaatattccaggggtagcacctgtgacctgtcccctgcagatgggcttcactcctgcggccagaggagccccaggtcgggagcggcaggtgctaggggcagggagccatgggcagacaggaggtgtgggcactggtaggattttctagaagaggcttgtgaagcagaaatgtattttgagctggaccttggggatgaggagagggaaaggtattcagggtggtgaaagtcagaggtgtggtcaggattgtctcagagcatcagcttcatgtagtgagaagtgaggatggaaggaattctggggctacatcgtggcacatatatggggctggcgaaaggactcacactttattcagctggttgtggaaagagtctctacgggattggctaatggatgaactgattgcttttttttgttgttgttgttggctttttttgtttgtttgtttttgttttttgagatggagtttcactcttgttgcccaggctggagtgcagtagtgcaatctcagctcactgcaacctccgcctcccgggttcaagtgattctcctgcctcagcctcccaagtagctgggattacaggtgtctgccaccacacccagctaattttgtatttttagtagagatggggtttcaccatgttggtcaggctggtctcgaactcttgacctcaaatgatccacctgccttggcctcccaaagtgctgggattacaggcatgagccaccgcgcctggccaggactcacactttattcagctggctgtggggagtctttaggggactggctaatggatgaactgattgtttatgatgacttggaggagacgagattcagagaggaatgaatgtggcctacggcaagtgggaggggaaggacaaggcggagtcatcagctctgatgatgagtagaatgtggaagtgaaggaaagagagaaggaaggaaccccacaatgtctggggtgattgattccactgcatttggggtttcttgcaaatgtgacctccagagggctcccatgaatacctgagtcaggccacatccctcatctccttagatcctttcatagctcccacctcatgcagagcaaaagccaaagttctccctatggcccacaagaccctgtaccatctgttccccttatctccctgcccttacctcctggccccgttacctccctgccctcaccttctggccccctcactcactctgctccagccacactggcctctgtgccgttccttgaacacatcagccacacggccagccatagcgcctttgcaagggccttttcctctgccttggaatgctcttcccacagacaccctcatgcatcctccctcatcctcatctcccttcaggtctttactcaaatatttctttctcagtgaggccattctggccactttacctaaatgacagtcagcttccccttccccctcctcctctaccgttttcttttctctatctgacattctgtctatttcaggagcttttcctgtttcttgttcatctcctttattagaacgccagctccaggagggacttttgtctgtgttattcatgtcttagtcctcagtgttgagaacagtgcctggaatacagtaggtgctcaataaatattgctggatgaatgaatgaatgatgaatggatgcatgagtgatggggaggataacagagccacgaagtgaagttgggaggaagaatttagcctgagattcagcccaacagcctgtacccctgggggtctcctcccctccttcccccgtcctgcagcctcactcagtgtcctggggctgcccaaccatccagcaatcccgggtgatctgttcatctctgtgggagggtgcgtgtttatctcaccgcaccatgatcacaccgtccagctggtgaagaaaaaagtgggtggaacacgagaccagctgtgacatggtttattctcaccaggggatgaacacttgcagccacacttggggctatgctggcttgctggtctcagcttgcgttcaaccttggccatctggcctggcgttttatttagctttgttctcacgtatgtggggcagttctggagttttgccccaagtgatgagagctcttcttggccccagctttactttttctttcatcttgctggttgcttgtctatgcaaagataggggggagggggtccaccctgcccgagatggggaagcttctggttgtggccagaaggagcataaacacccttgtatatgcccatatctaactattgatgctatctctacttgttggtgcctatatccatttattgatgcctatatctacctgttgatgcctatatccacttattggtgcctatatccatttattgatgtctatatcctcttattgggcctgtagctacttattgatacctatacccacctattggtgcctatattcagttactgatgcctacatctacttattgatgcctatatctacttattggcacctgcggctacttattgatgcttatgcctacttattgagccctatatccacttattcctgcctatatctagttactggtgcctatgtctatttattgagggctatatctacttattggtgcctatatccacttattgatgcctatatctacttattgatgtctatattcacttattgatgcctatatccacttattgatgcctatatccacttattgttgcctatatctacttattgatgcctatatccacttattgatgcctatatctacttataggtgcctgtggctacttattgacacttatgcctacttattgacgcttatgcctacttattgaggcctgtatccacttattcatgcctatatctagttactggtgcctatgtttatttattgaggcctatatctacttattggtacctatgtctacttattggttcctatatccatgtattggtgcctatatccatttattgatgtttatatcctcttattggtgtctgcagctacttattgatgtctataaccactcgttggtgcctatattcacttaatgtgcctatatctacttattgatgcctgtatctatttactgatgcctatatccacttattggtgtctgtagctacttattgatgcttatgcctacttattggtgtttatatctacttattggtgcctatgtccatttattggtgcctatatccacttattggtgtctatatctacttattggggtctacatctttttttgtttttgagacacagtctcgctgtgtgcagtggtttgatccctgctcactgcagcctccacctcctgggttcaagtgattctcctgcctcagtctcccaagtagctggcactacaggtgtgtgccaccatgcttggctaactttttttgtttgcatttttagtagagatggggttccaccatattgcctgagctggtctcaaactcctgagctcaggcaatctgcctccctcagcctcctaaagtgctgggattacaggtataagctaccacgcctggccatgcctacatctattgattcatgcctctattcacttattggtgcttatacccacttattggtgcctatatccacgtattgatacctgtattcatttattaatttttttttttgagacagagtctcactccgtcacccaggctggcatgcaatggcatgatctcagctcactgcaacctctgcctgctgggttcaagcaattctcctggctcagcctcctgagtagctgagattacaggctacgcgccaccacgcctgactaatttttgtatttttagtagagacggggtttcaccacgttggccaggctggtctcgaactcctgacctcaagtgatctgtccgccttggtctcccaacatgctgggatcacaggcatgaaccaccacgcccggccagaatttcctccctctctaagcctgaataacttctcattgtgcgtgtgcaccacccacatcttttttttttttttttttttttttttttttttttttttttgagatgaagtctcgctcttgtcccccaggctggagagcaatggtgcgatcttggctcactgcaacctccgcctcccaggttcaagtcattctcctgcctcagcctcccgagtagctggggttacaggcatgcacaaccatgcccagctaatttttgtatttttagtagagatggagtttcaccatgttggctaggctggtctcgaacgcctgacctcaggtgatccacccacctcggtctcccaacgtgctgggattgcagacgtgagccaccgtgccacatctctttgtttatccatcctgccatcgacgcacatttgggttgttccctggttctgagttttcaattctaggaagatccttagcagttgctccacacctggctgcctaccatggagagtgtttgttcagggcctggaaaccgcttttactatcagccaaataaaacatcatccggaaggtgacaaatgcatctgaaggtcgattacaaatgacatttagatgatcttcatcccagcgcctccttagtagctgttagaatccacggtctgctgaatttcacactctctagcctagaacttgggagggaagatcatgcccctgggtcttagcaaccctagttttgtccagggctggattaaggtgttttattgatggagctcttagcacacagagaaagacaggatcaaatgacaagtgaaagaaagaggatcaaggccagagagagagcgagagagagagagaacaagagagaggaggggaggagatgtgatttcaaacatagatgttgtttttaagctgctttttaaaaatatatttattaaaaaaatttttttaagacagtcttattctgttgcccaggctgcaatgcaggggcacaatctcgactcactgtaaactctgcctcccaggctcaagcgattcttgtgcttcggcctctcgggtagctgggattataggtgcccgccaccacacctggctaatttttgtattttgtatttttagtagagacagagtttcaccatgttggccaggctggtcttgaaatcctggtcccaagtgatctgcctgcctcggcctcccaaagtgtttaagctgcttttaaaggaacacttctgtgctctcaaccaggactccacacctgcgtatattccactcgaaggcaaaccccacgaagtgctgggattacaggtgtgagccacctcgcccagtcttacactctttgacagagcaattccacctctggggatttattctgcagagatatttgtagcagaacctgaagatctacaatgcaggacgttggctgcaacattctggggaatagcaagaaatcagaaagacccagaggtccagaccagataaatttgatggagtcattgaaaaatactatcgaaagctgggtatggtggtgtgtgcctgtaatctcagctacttgggaggctgaggcaggaggattgcttgagccctaggaggttgaggctgcagtgagctatgatcgtgccactgtaccccagcctgggtgacgtagcaagaccccatctcaaaacaacataaaaataaactacaggaactgatgtggaatatttgtaagaaacattcctataggaactgatgtggaatgttatctaagacatattactaagtataaaaaagttgtagacttttaatatatatgtatgtatgtatatacacatatataatctcacaaattccatgtttgtaaaaaattattctacatgtatgtaactgcctattaatttttctattgctgccataccaaattaccaccaaataaatgccttaaccacactcagtgggccgggggtggtggctcacacctgtaatcccagcactttgggaggccaaggtgggcggatcacctgacgtcaggagttcaagactggcctggccagcgtggtgaaaccccgtgtctactaaaaatacaaaaattaacagggcatggtggcaggtgcctgtacttccagctactctggaggctaaggcatgagaattgcttgaactcaggaagtggaggttgtagtgagctgagattgcaccactgcactccagcctggacgacagagtgagattccatctcaaacaaaacaaaacaaaacaaaacaaaacaaaacaaaacaaaacaaaccactcacttattatctcacagtttctataggtcagaaagccaacaggcctggctgggctgaaatcaaagtgttgcttggctgtgcttccttccagaggctctagggaagaatctgttttcttgttcatttaagttgttggcagaatccagtttcatgctgtgtaggactggagtcctgtttccttgcttgctgtcagcagggggtcattctcagcttccaggggtggcctgcattccctggctcgtggcctccttcatctcacagccagcaacagtgtttcaagtccatctcttgtactttattttaagagacagggccttgctctgtcacccaggctggagtgcagaggtgagatcacagctcactgcagcctcaacttccccggctcaagtgattctcccaccttggcctctcatttttagtttttaaattttcctccaagatgggtggaaaaagacattttcccacaccagagaataaaagaagagcttgtaagattacagtccagcccctccctggctctatattgaattctttagacaaaggacatattggggcttcctgagctcccatctccttccaaggagcatctttcctcttccttttttttcttttttttaagagtcagggtctcactctgtcaccccagcaaaagcgcagtggtgcaatcatagctcactgcagccttgacctcctgggctcaagtggtcctctggcctcagcctcccgagtagctaggactacaggcacacaccatgatgcctggctccagcatcacatgcttttccaatgtgtatgatgaacccgcaaagtttcagagaatgtttttcctctacttttaaaaattaaggggccgggcacggtggctcacgcctgtaatcccggcactttgggaggccgaggtgggtggatcatgaggtcaggagttcaagaccagcctggccaagatggtgaaaccccgtctccactaaaaatacaaaaaaattagccgggcatggtggcatgtgcctgtaatcccagctactccggaggctgaggcagagaattgcttaaacctggatgggcggaggttgcagtgagtcactgcactccagcctgggcaacagagtgagactctgtctcaaaaaaaaaaaaaaaaaaaaaaaatatatatatatatatgtggtgtatcttttactcatttttaccagttgtgaccacttctttcatttgtgggtggcgaagcctggtgtctgtcacagaaacatgtaaatgtttctgtccatgtaggagggtcacagaaagcacccccagacttccctgtggtccctccctctctgtctcttcccctagagctcctggaccaggctgtgtgaatcaggagcatctccaggtgccatccggttgccatggcaattcaggccagtccaggcttggcagcggagggctcagctcctgtttcaggtgtgggaaagtggtggggaccaccgatacctggcgtatcaggcaggtgctgtgattgttattccattaacaatgaggctttctgtggcctcaggcttcgtgttgtttattttcttctgtttactttttctattgtcttctctttggtgctgtctgttggtggaaccctgctgattctcagtgaagccaagcccacgtactttgccacttcctccgtgctgaggttgggcaaacagagagagagagagagagaggacagcacatttggtcatggggcccccgcaggtgccaggcgcaggcacctggctggggagggagcgacccctggctggaaatgtgtttgtttctcgtgtgtacacacaggacagctggggctccgttggaactgctcacgagtgctctgcaaagcgtccttggtgatgtagctggagtggctgtccccctttcctgcagatgccccactctgcccacctgccccaggttaacactagactaggtgtggacctagcactttctgtggcccagcgctgtgttcgttgcattgacttctcatggaggagcctgataacccttcatgacaacggctttctgaagtacttgccatgatccccacgttgtggaggagaaagcagagactcagaggcttaggcaattttcctgggaccccacggttcattgttgtgtgaagaggttagaccttcctccagaatatgccttatttcccgcatactttatcccttccctgcttagaaaaacatcccaggctgggcacagtggctcacacctgtaatcccagcactttgggaggctgaggcgggaggaccatttgaggccaagaattagagatcagcctgggcaacatagcgagaccctgtctctcaaaaaataaaataaaataattagctgggcatagtggtgtgcacctgtggtcccagctactcgagaggctgaggtgggatgatcgattgagcccaggagttcgaggctgcactgaggtaggatcatgcctctgtactccagcctgggtaacagagtgagaccccatctcaaaaataataataaaacagcagggcacggtggctcatgcctgtaatcccagcactttgggaagctgaggtgggaggatcacctgaggtcaggagatcgagaccagtctggccaacatggcgaaaccccgtctgtactaaaagtacaaaaattagctgggcatggtggtgggcacctgtaatcccagctactcaggaggcagaggtaggagaatcacttgaatccaggaggcagaggttgcagtgagccgagatcacaccactgcactgcagcctggacgacagagtgagactctgtctcaaaatcataataataataataatattaaaaaataaatacataaaattgaaaagtcacagacccctggtggtggtttggaaggggcttaatgacattttcctgggtagactcattcctaagaatattcattcattcatttattcattcattcaggcaagaaatagtgaaggtattggagactcaatggcaaatgagacaggccaagatccttgttcaaattcagctgagatcctatcagggaggtggatgttatagaagcccgcatgtacgtactggtctcagggagcaacaaacaccttaaggaagacctcacaggcgagcgtgatgagaacgcctgctgggggtggtgctttgggtggatggttctgcaagttggcatctgatcacagccttgcatgacgacaggaagctggcttgtccgagactaggggaaaagcattccaggaagagggaacagcaggtgcgaaggtggaatgagcttgacacagcccagaaacagggacaaggccagtgattctggggctaaaagtgcaacagggagaaggggaggggacaaagtcacagggatgaggcagcctgggaggatgcggcttttattccagcaaaagcaaatgtgctgattgacattttttatttttattttttattattattattttttgagatggagtctcactctgttgctcaggctggagtgtagtggcgtgatctcagctcactgcaacctctgcctcctgggttcaagcaattctgcctcagcctctcgctgggattacaggcaagtgccaccaagcccggctaatttttgtgtttttagtagagacagggttctgccatgttggccaggctggtcttgaacccctgacctcaggtgatctgcccacctgggcctaccaaagtgctaggattacagatgtgagccactgtacctggcctgattgacattttagaaagactgcactgactgcagaggagggaatggattgggagtgggagtagggaagaaggcagccccagtccaaatgattgagggtggcagccatgcagtgcaggaagtggttggattcaggatatattttgtatgtatgtatgtatgtatgtatgtatgtatgtatgtatgtatgtatttatttatttattgagatggagtttttctcttgttgcccaggctggagggcaatggcgtgatctcggctcaccaaaacctgcgcctcctgggttcaagcgattctcctgcctcagccttccaagtagctgggattacaggcatgtgccaccatgcccagctaattttgtatttttagtgcagatggggtttctccatgttggtcaggctggttttgaactcctgacctcaggtgatctgcccgcctcggcctcccaaagtgctgggattacaggcgtgagccaccgcaccagccttgtttttatttttatttttttgagacagagtctcactctgtcacccaggctggggtgccatgatacaatcttggctcactgcaacctcctcctcccaggtgaaagtgattctcctgcctcagcctcctgagtagctgaaattatggtgcccaccatcacacctggctaatttttgtatttttattagagacggggtttcatcatgttgtccagggtggtctcaaactcctgacctcaagtgatcctcccgccttggcctcccaaagtgttgggattacaggcatgagccaccatgcctggcttatttttatttttgagatagggtttcactttgttatccaggctggagtgcagtggcatgatcacagctcactgcagtctcaacttcctgagctcaggtgatcctcctgcctcagccttctgagtagctgggattactgttgccattgcatgccaccacgtttggctgatttaaaaaaattcttttttgcagacagggtctcactgtgttgttcgctatgttgttcagttgagctcctgggcttaaaaggtgctcctgccttagcctcccaaagtgttgagattataggcatgagcccccacgtccagccctcaggatatattttggaggtgagtagatggtacctgcggatggatttgatgcctggagttaagggaagcgagaagccaggattgacaactcaatttctggcttgggtatcagggtgaatttggaagcctgtaatgggatgggggaggatgggagctatgtgctatagcaccagagagggaaattgagcatcccatgtcaggctgtgggataagcaggtgcacgtctccaaagatgtcacctgggatattagctttaggttttgacttcctgatctgcttcctactttcccaggtagaaacactccttctgctttcagaacttaattaattaattaatcttcagagatagagccttactctgtcacccaggctggagtacagtagcgtgatcattgctcactacaacctcgacctcctgggctgatcctcccgtctcagcctccttagtagctgggaccacaagtgagagccacagagcctggcttgttcagaatttttgccgtcaaagttcttgcactgtgtctggtttctgggattttagttaatgtgtaggtactacacagctcacccaacctgtaaactggattctttctctttttttttgtcacccaggctgaagtgcagtggcacaatctccacccactgcaacctcgcctcccaggttcaagcgattctcctgactcagcctcccacgtagctgggactacggatgtgtaccaccacacccggctaatttttgtatttttagtagagatagggtttcaccaggttggtcagattggtctcaaaccgctgacctcaagtgacccacctgcctcggcctcccaaagtgctggataacaggcgtgagccactgcacccagccgattttttctttctttaatatcgttgtggccgggcgcggtggcttacacttatcatcccggagctttgagagactgagacaggaggatcacttgaggcaaggagtttgagaccagcctgggccacatagggagatcctatctctaagaaaaatttaaaaattttaaaaattagcctgctgtggtggcacgggcctgtggtcccagctacttcggaggatcacttgagcccaggacttcaagggtgctgtgagttatgatggtgccactgtgctccaatctgggcgacagagcaagaccctgcctcttaaaaaaaaaagaaaaagaaaaagaaaaaaaaatatatgtgcaggaagaatatttttggggaggggtgaaataaaaccttgtagctggaacacacttgaatctacctcttgttttcagttttatttctgtgaaatgggaagaagaatggcatccgtgcagaagtggttataaaaggaaagcagatttctttttcagcacaatgggaaagtatttggcaaaacacaaaagactataaatgcacaatcgtgggcaattaagagtgaggtttcactggagtaaattgaagcttaaaagcgtcatgaaggatagatctattaaactccattagttataggatttcgaaagaaaccggaaggtaactgcatttgctaagctgatagtgagttgatctgcttaggagaggctgggagagttctcatttctttgcatgcttaaagcagggtgagaggaaatggaatggagataattcttccctccttccttccttcaattggttctttgcaatctgggggcagcctcattctgtgcaccacctacttatacctgtgggtgttgaagtgacttgtgaaatgtttctgtatagggttgagcttcttaatttgttttctttctttttcctttttctctctcctttctttctctttctcgctcctctcttttctttctcctttctttcttttctttctcctttcttcctttttctcttttctttctctcttctttctttttctcttctttctttgtctctcttctttctttcttctctctttttctctttctttctcttcctctctcctctcttttctttttctctctcttcttcctcttctcttttctttctctcttttccttttctttttctccttctcactcctttcttttctttctctttctctctgtttttttcattctcctgtctttctttctcttctttctctccgttctcttttttttctctctcatttctttctcttctttctttcttctctttctctctcttctttctccttccttccttcctttttgacggggtctttctttcttgctttctttctttctctctccttttgagacagggtctcccttcccttccccttccccttcctccttcccttctcttccttccttccttcctttctttctctctttctttcttttttctttctttccttctctctcactctctctctctctctctttctttcttgatggagtctcactctgtcacccaaactggagtgcaatggcacgatctcggctcactgcaacctctgcctcctgggttcaagtgattctcgtgcctcagcctcccgagtagctgggattacaagtgcccgccaccatgcccggctaatttttgtatttttagtagagacggggtttcaccattttggccaggctggtcttgaactcctgacctcaggtgatcctcctgcctcggcctcccaaagttctgggattacaggcatgagccactgcgcccggcctctttgtctttctctttctctctttctttctctgttttctttctctcctctctttctctctcttttctttccatcctctcttctttctctcccttctctctttctttctctctctctctctttctttcttctttcctctctttccttccttccttccttccttccttcgttccttccttctctttctttctaacaaggtaggctatctgtagcccaggctggaatgcagtggtgcaataataattcaccgcagcctcgaactcctgggctcaaggtttcctcccatctatgcctttcgagtgtctaggactacaggtacatgccacctggctaatttctttaaacaaagtttatttttgttgtttttgtttttagagacagggtcttgctatgttgctcaggctggtctcaaacttccgggctgaagcaatcctcctccctcggcctcccaaactgttgtgattacagacatgagccactgtgcatggcctaattctatttcattcatgccagcctcccagcagatacgcttttcttggacagacactgagaggctagttgtaggggctgactcaggtgggaaaaatcagtctgggactggaaatatgcttttgggtgaggtgtagattccaaaagccacggaccacgtcacccacagccacacgggcctcttctttgttccttgagacacacagtcctgcctcaagacccttgcatgtgctgttccttctgcctggaaagctcttctctcagatacccatgtggctcctcacctccctcaggcctctctcagatgtcacctcctcagtgaggctgtctctgcacccctatttaatgaagtcaccagtcgggccgggtgcggtggctcacgcctgtaatcccagcactttgggaggccgaggcgggcggatcacgaggtcaggagatcgagaccatcctggctaactcagtgaaaccccttctctattaaaaatacaaaaaaattagccgggcgtagtggcgggcgcctgtagtcccagctacttgggaggctgaggcaggagaatggcgtgaacccgggaggtggagcttgcagtgagccaagatcacaccactgcactccagcctggatgacagagtgagactccgtctcaaaaataaataaataaataaataaataaataaataaataaataaataaaataaagtcaccagtctacccaactcttcttcttctccctcttcttcctcctcctcctcctcctcctcttcttcttcttcttcttcttcttcttcttcttcttcttcttcttcttcttcttcttcttcttcttcttctttcacacagggtctcactccattgctcaggcaggagttcagtgggacaatcacggctcactgcaacctcaacatctcaggctcagacaatcctcctgcctcagcctcctgagtagctgggactacaggcacgtgccaccatgcctggctgatttttaaaacattatttgtagaggcagggtcttgttatgttgcccaggctggtcttgaattcctggcctcaagtgatcctcctgccttggcctcccaagtgctgggattacaggcatgagctggtgtaggcagccagcctacacaccttacccttctttgttaaggactgaatggtgtcttcccaaattcatatgttgaagtctaaactccagtatctcagaatggggctgtatatggagacaggacctttacaaaggtaattaaggtaaaaggaggtcagatgagtagccctaattcaatattactcgtgttcttataagaagagattagccacaaaaagacctcagtaagtgtgtgaggtaatgcatgttaattagctcaaggttgccattccacaatgcatacgtgttcgagaacatcatgttagacatcataaatatgtacaattttgtaatcccaggtatatgggaggctgaggcgggagagttgcttgaaactaagaggcagagggtgcagtgagctgagatcatgccactgcactccagcctgggcaacaagagtgaaactttgtctcaaaaaaaatatatatatatgtgtgtgtgtgtatgtgtgtatgtatgtgcatgtgtgtgtgcatatatatatatacaatcttttttttttttttttgagatggagtctccctctgtctcccaggctggagtgcagtggtgtgatctcggctcactgcaaactctgcctcccaggttcatgccattctcctgcctcagcctcccgagtagctgggactacaggcgcccgccaccacgcccagctatttttttgtatttttagtagagacagggtttcaccgtgttagccagatagtctcaatctcctgaccttgtgatccgcccgccccggcctcccaaagtgctgggattacaggcgtgagccaccacgcctggcctatatatatatatacaatttttatttgtcaatttaaaaactttttttttttgagacatggtctggctttgtcacccaggctagagtgcagtggcacaatcttggctcactgcaacctctgcctcccagtctcaagtgatcctcccacctcagcctcccaagtagttagaactacaggcatgcaccaccatgcctggctaatttttgtatttttagtagagatggggtctcactatgttgcccaggctggcctcaaactcctaggctcaggcaatctgaccgccaaagtgctaggattacaggcatgagccaccacacctggtcctttggcccttcccagcacttttcaactcctaatctctatataatgtacccacttattttgttccttgtctgtctccctcctagaatgccttctccatgagggtggggacatttgccagtcttattcatggctgcgtccccaggacctagcacagggccaggcacaaattgggtggtcgctcagagtttgttgaatgattaagtgattggagataaaaatcttggggcttcaaggtcctttggtgtgttgagtgtccacctgataaatgtgtgagtggaggaaaccctgtctcttttctctttccaaaaaccagctgttggccaggcacggtggctcatgcctgtaatcccagcactttgggaggcagaggcgggccggtcacttgagatcaggagttcaagaccagcttggccaacatggtgaaacatgaaacatggtgaaaccccgtctctactaaaaattcaaaagttagctgggcgtggtggcgcacgcctgtagtcccagctactcaggagcattgcttgaacccgggaggtggaggttgcagtgagccaagatcacaccacaactccagcctgggcaacagagtaagactccatctcaaacaaacaaacaaacaaacaaaccaaagagccgtaacctggtgtggtggcgtgcacctgtcattccagctactcaagagggaggctgaggcaggaggattgctagagcccagcagttccagaccagcctgggcaatatagcaagaccccatctctaaaaaaaaataaaaatgaagttaaaaaaacagagaacctggtgagaagcagtgtggctggacaggtggccactcacatgtggatttatttatttatttatttattttttggagacagagtctcactgtcacccaggctggagtgcagtggtgggacctcggctcactgcaacctctgcctcctgggttcaagcgattctcctgcctcagcctcctgagcagctgggattacaggcatgtggattacaggcatgggccatcatgctcggctaaatttttgtatttttagtagagacagggcttcaccatgttggccaggctggtctcgaacccctcacctcaggtgatctggctacctctgcctcccaaagtgctaggattacctgggggagccactgcacccagccttccacgtgcgtttaaaactgcctcttgaactcaccctttcagctttccagagctcacaggaccaagggactgagggagagccaacccccaggcccatggtggctcattttgcagaaggagacatagagatgctgagaaatccagcatcccgccctctgtggccggcacctgggaggtggagcgagtgcccgcggcacagcctcatagtgttttgctccatggggcacatatgttgccgggcagctcctaagaactggctttctgggccctgagttgccaaggaactactaaatcccggccagcctgggctggggtgtattttgactttctgcgaaggagggtggggcggcctctccttgtcttctgagttcccttctccttgccctctgtgagctctgtctgcctctccctcacactggccctctctgtctcctctttcttcttctagtttccccctcactgtgctggagggagaagaccctgggatttctgagcgaggcccgtggatgttgaagtcttcctgggtccccgactccatgctctcgcgccccagttactatgacgccctgcacaaccgcagctcggggcacgcccagcgccctgcaggacactcggcctccccggctcagcatctgcttcgagggcccccctctgaggcggcggggcggcgtggtggatcaccgagatgtcatcttggcccaccaggcccacaaaatccacagcaccccccaggccaggaggaaagaatgggagtgagtatgcctgggtggtggtgatcggggggcggtgcggctgtaccggggatcccttgggggttaggatgtttttggcgagctttttcggggagcaaattcatgcagctggaacatattgataaggctgtgctggcttctgaaatctcaaaatccttccctgctaactgatcaatactggttgccttatgccccccggacacccccatccggctctgtgaatccctgagctgccccaggctgaggcaacagagattaaccatggatggggcagccaggaccaggctcccaggattgtgagtgtccactctgatgggttggcaaatctttctttctttctttctggtttttttttttgttttttttttttgagactgaatcttgctctgtcacccaggctggagtgcagtggcccaatctcggctcactgcaaagtccgcctcctgggttcaagagattcttctgcctcagcctcccaagtagctgggaccacaggcacacgccactatgcctggctaatttttgtatttttagtagagacggggtttcatcatattggtcaggctggtctcaaactcctgacctcaaatgatccacccgccttggcctcccaaagtgctagaattacaggcgtgagccactgcgctcagccagcaaatatttctgttgagatggctgagaaatgctgctttctggggaaaaacgtgggaatcccatttctacttccagtgttgagttgaaatctgcgggtttcagggctgaagacagaagtgtgtgaaggcagagagggacctagatagggctgggagtacgtggtggcttcagttgagtctggttctgggtccccctttctctttgtcagtgaccccaaaagtgggtcttctggtgggagacactgggggtggaactggctctgtcatgtagttgctgctgggcaatgttggatgaatggctttcctgagctggggtcttggctgttcgagggttgaaggtggtttgtgtgaaggttcagtctcaggccggcccctacgcatccttttccacacagtgggggagctactgggttttttctttccttcctccctccttccctccctccctccctccctcccttccttccttccctccctccctccctcccttccttccttcctctttctttccctccctctctcctttccctcttttctttcatttccttttaagacagtgtctctcttctctctctcctccttccttccttttttccttctttcctttcttccttccttcctttccttccttccttcctttttgacagggtctctccttccttccttttcttttttccttccttccttcttttcttttttccttccttccttcctctctctttctttctttctttttatttctttctcttttctttctttccttttgagacagggtcccttcccttcccttccctctcttcttttctctttccctttccccttcccctttactttccttttcctcaaaagtttttttttttttttggcaaaggcacaggcctagggtggattcctgagcagacatcaggagtgtgggatgagaatataaatattattttgattggagctgaggctgatatggatactaatcaatttaggggaccccaaaatttactctcttaccctcttgatgctcccgacctgaccctgtgggaagcacccttcaccagacacccaccctggccccatttttccatttgcaggagaggaagtggggttataaatgccatttgagttgggagggtgctggtgagggagtgtgtaaatacagggtgcaatgcaaactgttttattaaaatgagcctttgctcattttgaatcaaagaacttcaggatggggccagggtggtgcaagcttggccccgaggtggtttcctgaggttagtctgacatctactggcgtgtttgagcatcatttaggaaggcatgttgtgacttccccaccacctgccacaaaactgggttcctcttaacctcccctccatccactcatctgtccactcacccacccaccacccacccatttaaacttctaattgtgcatgcatccatccatccatccgtccatcacccatccatctttctacccatcaatccattcatccacctccctgttctttctcccatccatccattttccagccatccaaccaacttcccattcacccacctgtccacacatctatccatccacccaacccacccacccactcacccattcttccattcacccattcatccatccattcttccatccattcttccattcattcttccgtccatccacccacctatcatcttatataccaatctgtccatccacccatccatcattccataaataaccaggaaaagcacctattccctttaacgtctgccttggtttctagaacccataaaagtttctttaatttattttcatttttacaaattttaattaattaattaattttggaggcagggtcttgctctgtcacccaggctggagtgcagtggccctatcacggctcactgcaacctctgcctcctgggttcaaacgatcctcccacctcagccttgcaagtagctgggactacaggtgcatgacaccatgcccagctaattaaaaacaattttttttggtaaagatgggatcttgctatgttgctcaggttggtctcgaactcgtgggctcaagcgaccctcttgccttggcctcccaaattgctgggattacaggcatgagtcaccatgcctggcccaaagcgtccttatagccatgatctccaaacttctgaactcctaccccagccagcaaaacaatttttgagcacactcatagctgaaatgcgtagccacggcccatgcatttttagttatatataatttataaaaatattttgctaaatgtgttatatgcactgtaaaatacacataaaaataaaaacgtgaaaaggatgagacatcaacaagatatatatatttccaaatggcttaatagtttgatttaatagtacaacacgcttctacccttatgttttagaagtttgccttcgctttttgaataccgtgctctgtgagagctttttattctgaagatgttccaatacactaaaagtaggaaaaagaggtcagtgagactttcgtatccattaaaatttaataattatcaggattgtgccagactcacatcataaatccatatcctctttctgagatgtttaaaagtaaatccctgaccttatgtgatttttgcaaacttcagactacatctctaaagcacacagacacatcttaatcacatcacactgacaatattaatcatgatttttatatctaatttctggtccacattcagatttccttgctcatctttttacagttgagttttttgaatcaagaaggcttgtgtgttgcatttcatcgtttctctctctttttattgtggtaaaatacacacaacgtaaaattgaccattttaaccatttttaagcatacagttcagtggcattaagtagattcgcattgttgtgcaaccgtcaccaccatccatctccagaacgttttgtttgttttgagacagagtctcgctctgtcttccaggctggagtgcagtggcatgatcttggctcactgcaacctccatctcacggattcaagggattctcctgcctcagcctcccgagtagctgggattataggcgcctgctaccacgcccagctaatttttgtatttttagtagagatgggatttggccatgttggacaggctggtatcgaactcctgacctcaagtggtcagccccgctcagctcccaaagtgccaagattacaggcatgagccaccatgcccggctgatctccagaactttttcatcactccaaactgaaactctgtctccatgaaacactcactccccagcccctggcacccatcattccactttctgtctcatgaatctgatgactctggggacctcatataagtagaaacatacagcatttgtcctcttgtgtctagcttatttcactaagcataatgtcctccaggtttatccatgttgtagcatgtgtcagaattttcttagtttttaaagctgaataatattccattgtatgaatagaccacattttgtccgtccatctatccatccatccatccatccatccatccatccatccatccatccacccatctatccatctatccatccatccatccatccgtccatccatccatccatccatccacccatccatccacccacccacatatccatccacccacccacatatccatccacccactcacccatccatccacccatccacccatccatccacccatccacccatccatccatccagccatccacccacatatccatccacctactcacccatccatccatccatccatccatccatccatccatccatccacccgtccacccatccatccacccacccatccatccatccatccacccacccatccatccatccaccaactcacccatccatccacccacccatccatccatccatccatccatccatccatccatccatccatccatccatgaacacttgggttgcttctattttcgggctattgagaataatgctactatgaacataggtgtacaaataactcttggagaccctgctttccattcttggagatatattcctagaagcagggttgctggatcatatgataattctatatttaattttctggtagtcatgtcttctatgtcttacttagtctacagcagtctctttctgatcccctattttctaccctattgactctgagaataaaccagataaatcatcctgtagaatgtctcctattattattattgttattgttattattatttagagacaggatcttcctctgttacccaggctggagtccagtgggggcaatcatagctcagcgaagccttgaacccctgggctcatgtgatcctcccttcttagcctccccagtagctaggactacaggagtgtaccaccacacctggctaattttttatttttgtagagacaagttctcactatgttgcccaggctggtctcaaactcctggcctcaagtgatcctcctgtctcagcctcccaaatcactgggattatacatgtaagctactgcatctcctaagcatcttccattcttcattgctgtttggaagctttatttttataactgtggtggttttgtccaccagtaggaaccccacccaggcacggtacatgccacagtgaggcttacgtgatttcacctcaccgattgtcttcatgagaattctgaatgttttctggccaccttctgatagcgattgaattagatcaccaccgtgattacttctcatgactgacagactttggtctctttgctcatttctgcttctgttactatcttcttcaatcctctttctctctctctctcttttttttttttttttttttgagacagagtcttgctttgtcacccagactggagtacagtggcgtgatctcagcttactgcaacctctgcctcccgggttcaagtgatccttctgcctcagcctcccaagtagctgagattacaggcacctgccaccacgcccagctaattttgtatttttagcagagacggggtttcaccatgttggctaggctggtcttgaactcctggcctcaagtgatccgcccaccttggcctcccaatgtgttgggattacaggtgtgagccactgcgtccggtctcaatatttgctttctaggcaggaatcttttaaagccacgtgtccactttatcagccaacatcccagtccatcaatcactcatgcaggtctaagcagactgcaatacattgccattcactggaattgttatttatctcatttctagtggtctgtcttgcccactggagtatccccaatcaggttgcttgtctgtcctgttcacagctgtatccccagagactgaggccagcacccagtaggtgctcataaaatatctcttgagtaaaagcattgactgacagtgaatgagagccagtgccagccagtcaagtggatttgggtcaaccatcagttaaggactaataaaactcaatacttttcttatttttatttttgagacagagtcacgttctgtcactcaggctggagtgcaatggctcgatcatggctcactgcagcctcaacctcctgggctcaagcaatcctcctgcctcagcctcccaaaatcttgggattacaggtgtgagccaccgcgcctggcctatggggtcttgttaaatgcagattctgtttcaacaggtctaggctaagacttgggattttgcatttctttctaacaggctgccaggtgaggctgacgctgcctgggtgtaagcagcgagctgctgaaccgtcatcttcatcagagaatagagagaacattagtgtgaatggggagcagagagaggagagttaagggaactaccatgagtatcattaataatacttcttaggccataataataataataaccatgttttttgtttgtttgtttttgtttttgttttgagacggagtctcgctctgtcacctaggctggagtgtagtggcgcgatctcggctcgctgcaagctctgcctcccaggttcacgccattctcttgcttcagcctccctagtagctgggactacaggcgcccaccaccatgcccggctaatttttttggtatttttagtagagacggggtttcactgtgttagccaggatggtctcgatctcctgacctcgtgatccacccgccttggcctcccaaagtgctgggattacaggcgcgtaattccacaggcgcccagcccaaccaggtgttttttttttttttttttttttgagatgggggtctcactatgttgcccaggctgatctcaaactcccgggctcaagcgatccttccacttcagcctctggactatctgggattataggcatgagccactgtgcccggcaataaccagtattgactgggcatggcggttcacgcctgtaatccaagcactttgggaggccaaggcaggtggatcgcttgaggtcaagagttagagactagcctggccaacatggtgaaaccccgtctctactaaaaatacaaaaaaatcagccgggtgtggtggtgcgtgcctgtagtcccagctactccggagggtgaggcaggagaatcgcctgaacccaggaggggaggttgccgtgggccgagatcacaccactgtactccagcgtgggcgacaaagtgagactctgtctcaaaaaccaaacaaaaacccagtgttgatggagcacttactatctgtggggcacggctccaagacctttacatgcattgactcgattagtcctcatcaccattgttataaatagattgtggtgcaggttattgttttccaaagtgtttcgttgcagcacatcttatcaaatgcacgcaacgatctcctgaaacagctagggcagctcttgttgctattgttattgtggttacttagtatcttattatgattacttttttttttttttttttttgagacagagtctcactctgtcatccaggctggagtgcagtggcgcgatctcggctcagtgcaacctcgacctcccaggttcaagcaattctcctgcctcagcctcccaaatagctgggatgacagtcatgcaccaccacgcctagctaatttttttttgtatttttagtagagacggggtttcaccctgttggctaggctggtctcgaactcctgacctcaggtgatccacccacctcagcctcccaaagtgctgggattatgggagtgagccaccacgcccggccatgattacttgttatgaccggtagtacccttattattttgtcccttatgcagatgggtgaacagacccggagaggtgaattccaggttactgaggcatttgagagccaagccaagagagagatggtgtgaccttgaattccaggccagaactgaccacttataggatatggggacccaggctcagccaaactgcaggtcaccagctaggactgggtgactttcccagctagggatcggatgggtggcctgaattgtcctggtccccgaggcctgagctgagagaatgagacacacaaagtgagacttttattttatttttagagacagggtctcactctgtcacccaggctggagtgcagtggtgcaatgatggctgattgcagccttgacctcctgggctcaagtgatcctcccacctcggtcacctgagcagccaggaccgtaggtgcgtgtcaccactcctggaaaatttttaaatttttttgtagaggcagggtcttgctatgttgcccaggctggtctcaaactcctggcctcaagtgatcctcctgcctcggcctcccaaagcattgagatcataggtgttagcaaccatgctcagccccccagagagatcatattttaacacaagtcagattatatccctcctctgctcagaaccctccatggctcccacctgactcatagcaaaagccaaagtcctcaccaagacccataaggccctgcccctgtcacctccctgccctcacctccctcctctctctccctcgtgcactgtgctgcagccatactaaccttatcactgttcctccaatgcaccagggtggtccagcctcagggcctttgcactggctgttccttctgctaggaatgctcttctcctcggcacccacacggcttcttccttgcctccttccagcctttgattaaaggtttcctcctcatcaaacttttcatcatcaccctatttaaaatgcagccccggctgggtgcagtgtctcatgcctataatcctagcactttgggaggccaaggcgggaggatcacttgaggccaagagtttgagaccagcctgggcaacatagtgaggcatctccacaaaaaacaaaaaaatattagccaggcatggtggtgtgcgcctgtggtcccagctacttgggaggctgaggtgggaggatcctttgatcctgggaggtcaaggctgcagtgagccatgatcgtgccaccgcactccagcctgggcaacagagtgagaccctgtctcataaataaataaataaataaataagataaaaataaaataaaatgcagccctactcgtgcttattccctgccccgcttaattttccccactagcactcataaccagatcctatgtgttacatatggggcttcctccctcgttgactgtactgggacctgtagtcctagctactcaggaggccaaggcaggaggatcctgtgagcccaggagtttgagaccatcctggacagcatggcaagattccatctttacaaaaattagctgggcatggtgatgcgtacctgtagtcccagctactcaggaggctgaggtgggaggactgcttgagcctgggagttgaaggttgcaatgagctatgattgcaccactgcactccagcctgggcaacagagagagatcctatctctaaataaataaatagaattgaaaaaaaataaaatgcaacccctacttatgttggttccctgccccgcttaattttccccactagcactcacgaccagctcatatgtgttacgcatcggctttctcccttgttgctgccatatttgctctgtgagctccacgtgggccggtctggtgtcacccaggctggtgtgcaggggcgagatctcggctcactgcaacctcagcctcccgggttcaagcgattctcctgcctcagcctccggagtagctgggactacaggtgcgcgccaccacgcccagctaatttttgtattttttagtagagacggggtttcatttaccatgttggccaggttggtctcgaactcctgacctcaggttatccacctaccttggcctcccaaaatgctgggattacaggcgtgagctaccacgcccgacccgttcattaatttttgttgtcgtataataaaaagaaggataattcttgataggtgaaagttgtatgccgttcaaaatttggtgtccataaagttttattggaacacagccttttctatttgtgctgatgttgtctgtggctccttttgtgttacaacggcagagctgtctctgggacagagactgtctagccctcagagccggaagcatttcatctgaggtcctttatcgaagaggtttttggacccctgagctggaacagcgcctgacacacactgtgctcaaaaagcagcctgcgcgggtctcccctgcgttcacccactgtcgcccgccgctgctaagactggccaccaggtggcgccatggctccccagcctggcaggcgccgggcagcagagcgctcagctcgctctccggagtacccacctccctgccgcttcctttctgcctgttccgagaaatggaagtcagccccaaatcaataattgaattcccatcatgtgataactaatcattacatatatggctattgctttttcatgcacaaagggcttggtaaagaccaactggggcggcaggggcggactcggggctttgcagggctccctgaggtctgatgggttacaagcaggtcctgaggtcaagtgtggggcttacctggcttcaatctggggtgtggttgagtgccccggccagggttcaaatcccaactctgccacttgctgactgattctggggaggagggttcctttccctttcggtgcctcagtttccctctctgtcaaatggggaaaacaatagcacccatctctggggctcttacaaagattaagttcactgcattattacatagaaagcatttagaacagtgcagccacatagtaagtacttggtaatagttttctgtttctgtagcgggtatgccattaagcattttgaggcctcagtttacacagttaaaaaaaaaaaaaagaggctgggcacggtggctcacgcctgtaatcccagcactttgggaggctgaggtgggaggatcgattgagccccggaattcaaggtcagcctgtgcaacatagggagacctcgtctctacgaaaaatgctcacgtaattaaaaaaaaaaaaaaaattagccaggtgtagtggtgcccaactgtagtcccagctactcgggagggtgagatgggaggattgcttgagcccaggagttcaaggctgcagtgagtgatgatcacaccactgcactccagcctgggtgacagagtgagaccctgtcttggaaaaaaaaaaaaaaaaagaaagaaaagcaggttgttttgtttagacatcacaattaaactgcaacctaacctttaaaaaagaacctacttagaaatcagagctctctttctcttcttcttctttttatttacttatttttttgagcaggagtcttgctctgttgtccaggctggagtgcagtggcatgatctcagctcactgcaacctccgcctcccaggttcaagtgattctcacctcagcctcccaagtagctaggattacagggacccactgtgattagctgccatgcctggctaatttttgtatttttagtagagatgaggctttagcatgttggccaggcttgtctcaaactcatgacctcaaatcatccacctgcctcggcctcccgaagtgctgggattataggcgtgagccactgcgcccggcctctttctttcttttcttaagggaggcaggctggccaattctagcctagttgatatttaaaaaaaataggtctggtcccagggagcttctttttcagtgcagctggctgacttttggtgcagagagacccttcttttgttctttgaattagcagctttggcagccatggaaggtctgggtagggccccccagagatggggctcccctatctcttttggtctatcagattctccatgctggtccttgaaacccaagcagcttatgaacaaatatcccccaccacccccactgccaaattatcctctctgttcaatgtgacttttccatctagaatttatctgtaccttgggtttccaatcctgggaacaactatgccttatttatttatttatttatttatttatttatttatttatttttgatacagagtctcactctgtcacccaggctggagtacggtggcgcgatctcagctcactgcaacctccgcttcccaggttcaagcgattctcctgcctcagcctcccgagtagctgggattacaggtgcacaccaccacgcccagctaatttttgtatttttagtagagactggatttcaccatgttggccaggctggtctcaaactcctgacctcaggtgatccacccacctcggcctcccaaagtgctggggttacaagtgtgagccactgcgtccggcctcctgtcttcgttttcttcttctttttttgagacagagttttgctcttgttgcccaggctatagggcaatgttgtgatcttggctcaccacaacctctgtctcccaggttcaagcaattctcctgcctcaagctcctgagtagatgggattacaggcatgcaccaccacgcctggctaattttgtatttttagtagagacggggtttctccatgttggtcaggctggtcttgaactcccgacctcaggtgatccgcctgcctcagcctcccaaagtgctgggattacagacctgagccaccacgcctggccctcttttcttcttgtggggtctgcatacttctgcttgcctaccgctgatccctgtctttcctcctcttccacttcctcctcttcttctacctctttctcttcctcttcttctttgacagggtctcactctgtcacccacgcaggagtgcagtggtacaatcatagctcactgtactcttaaactctcaggttcaagcagtcctcccaactcagtctcccaagtaactaagattacagacatgtggcaccacacctggctattatattttactttattttttgtagagattgaatcttgctatgttgcccaggctgatctcaaactcctaagctcaagtgatgcctctccttcagcttttagagtccctggaattacaggcacgagccactgtgcccaaactgatccttgtcttttattctgtcaccgtcactccaaaattctatcttttcaacacctcagggttatttttgttgttgttgttgttgagatagagtctcactcagtcacctaagctggagtgcagtggggcgatcttggctcactgcaacctctgcctcccaggttcaagtgattctcctgcctcggcctcccaggtagctgggatcacaggcacacgtcatcacgcctggttaatttttatatttttggtagagacgaggtttcaccatgttggccaggctggtctcgaactcctgacctcaaatggtccacctgccttggcctctcaaagtgctgggattacaggcgtgagccaccgcgcccggccttcagggttcttttgatggcgtctgtccacactccaggctcccttaactgcttgaaccttggtgcagggctctgcccatgactctctgcccatgattccatcattattgccctcactttggttgagtcccggtggctttccttctgtcccctgcattttcaaggcctttgcacttgctgttcctcctgcctggaatgttcttcccatggctggctccttcacacactgtggtctcagcacaaatgtcaccttctcctgtagagcccctctcctggggcgactgttcattttgcagagccattctgctcattatataaaattacgtgtttctttctaaattggattgtcagttccacaagggcaggtttgtctgtttgtttctggtctgtcttttctgctaccgtgtctctagtgcttagaaaagtgcctagagtataatagataccaatgtttgttgagtgaataactgatggacccctgtgaacttgaacatctatgtggatcacctcttcgtggctctggctttgagacctgaaagcctcttagagcaagtgaaccctattttcttttccattctctgcccaggggatcttctggttccacatttatgcactgtactcaagggggcctgcctggaggaggaggcagacatgcaaacagcagctgtacaatgtctatgagctacacagagaccagttcccatttattccacacccgccatgggcccagccctaggccaaggggctttgggtatgagctcatgggttactaaccccagtacccattttacagaggaggcaaccgaggcacagaggggttaaataatgaagccaataagttagaaccagctttggaacccaggtctgtcagaatccagagcccatgttcttaactcctgccttttcaaggtcttgaacttggaaatgcctggcatagagtcgaatgaacgaatgaatgaaaggacgactgaatgaatgaaagggagaatgaatgaaattgtgatcattaaccttttccctgcccttcaagtcctaaactctacaaaggcaagtcccttttcttatttgacccttgaagctatgggagtgctctgcacagagctttgcaggtagaaagcacgtgatgtctgtcaaacttggttgtgtgaagtctcaaacaaacttaggatgaaatctatacaatcctgaaggccagcatggcacatacaacccattctctaagtcctggccactagaaccagcttgaaagagaccgaactgggattaaaataaaataagacctcaccttctgatatttccaaattctcacagtcctttcacctcctctgtctcttgcaaccatgaaaacgacatttgggagggcaggtcttgtaatgctcagatcacaattgaagaaatgaaggccaagtccacatagagatgagtgctgggtcaaaatctaatggtgacaatgaacttaaaaaacaatcccattatccccagcattttgggaggccgaggagggcagatcatctgaggtcaggagtttgagaccagcctggccaatttggtgaaaacttgtctctactaaaaaatacaaaaaaacaaaaacaaacaaacaaaaaacaaacacgcaaacaaaaaaacagaaaacaaacaacaaaaattagccaggcgtggtggtggcacacatctgtagtcccagctactcgagaggctgaggtaggagaattgcttgaacccagaaggcagaggttgcagtgagccaaggtcacaccactgcactccagcctgggtgacagagcgagactcctcaaaaaacaccaaaaagcaaaaaacaaagagctacaataacaaaaccccaatcccactatctctctgaaatgccacgttgcaaatcaaatgtattcctttgccatccaagaaggccattcttgcctggtgaaattcctctggagggccccacatatgttgcaaaagacagatctggggacaaaaggagccaccttgaaaatcccagctcatcctgttagagctgggcgaccctgggcaactgccacagcctctctgagcactgaaggaagataacaacagttcctagtgcagaaagtctgggagagagcactgacaaggccaggttcaaataacagtgtcttgaaggataagtcactttctttttttttccttctgtggtctgggcaccgcctggtcaatatttatgtgtagtgcctccatctgtatgctaggtcaagggcttctgaataaggagactgtggagcttattggctctggagctagtctggctggattcacaccctggttctaactatttgctgtgtgaccttggacaagtgacttcacctctctgagcctctgtttccttgcctgcaaaatgcaggaaaaaaatagcagtcacttcatagggtcattacaagaattaagcatttgaaaaatgcttaggacagtgcatctcacattataagcaggaatggccagttaaataataataataataataattattattattattttgaaaggagtctcactctattgcccaggctggagtgcagcgatgcgatcctggctcactgcagcctccactcctgggttcaagccattctcctgcctcagcctccagagtagctaggattacaggcatccaccactatgtctggctaatttttgtatttttagtagagacagggtttcaccatattggccaggttggtctcaaactcctgacctcaagcaatctgcctacctttggccccccaaagtgctgagattacaggcatgagccactgcacctggttaggcctgttaaattaagtgaaatgaacaaattcccacccatactccgaggtgtgacctccaaaagggcatggactttatcttattggttatgtttcaccagagcctagcatatagcaggtggttagtaaaggctgggtgaaagcaagatatgaggttggaatgtgtttgtggctgagagatgaaaatctgacctctaaatctaggatttgcagacttctgtaaagaaccagatagtgggctgtatctggcctgcaggacgttgactgctaacttctgctataaatcacagtgagaggttaatgggaactaagagaggatgtttcagatggtcctttctggagagatggtgatatcaaacgcccttaagtctcaaataggaaggcctatttatttttcttattaacatttatgaagcacgttatcctgtccacatgccaatcagtgccataggcactcatactctcttttttatttttaggacaatcttggaaaatcatatctttaattactcctccctccttttaatttaatttttatttttttatttgtgcaaatatataggatatatgtgcaaattccttcttcttctctttttttctttaaatagatagggggccgggcgtggtggctcacacctgtaatcccagcactttgggaggccgaggcaggtggataacttgaggtcaggagtttgagaccagaccagccaacatggtgaaaccccatctctactaaaaacaacaaaaaaattagctgggcatggtggtgcacacctgtaatcccagctactcgggaggctacagcaggagaatcccttgaacccaggaggcagaggttgcagtgagtcaagactgcaccactgcactccagcctgggcaacagagcgagactctgtctcaaaaaaaaaaaaaaccaaataaataaagagacagggtctcgctctgttgcccaggctggagtgcagtggtgcaatcatagctcactgcagccttgaactcctgggctcgggtgatcctcctgcctcagccttctgagtagctgagactacaggtggacaccaccacactagctaattaaatttttttttgtggagacaggggtctttctatgttgtccaggctggcctcaaactcctggcctttagcaatcctcctgcctcagcctcctaagtagctgggattataggaatgagccacagtgtctggctcacctcttcccttttttaaattaggaaactagggcccagaatggttaaaaaaaactttctcaaattcatacaagtttaactgggtccattttctttgtttctttgtttcttttttttttgagacagattctcactgtatcccccaggctgaagtgtagtggtgcacttctcggctcactgcaacctctgggttcaagtgattcccatgcctcagcctcctgagtagctgggattacaggcacctgcccaccacacctggctaattttttaatttttattttttagtagaggtgcggtttcaccatgttggccaggctggtctcaaactcctgacttcaggtgatctgcctgcctcggcatcccaaagtgctgagattacaggtgtgagccactgcacctggccgaactgggtccattttcaaagctctggcttcttatgtctggaccagagaacagctgaggccttgtctcaaagctgccatttaaatgttcacggctgagtgcacaggccctagaagcaagcttcggaacacagggcagcacccaaggcacaatatgtaaggcttttcagtagacacgcatgactacaatccatcacaaagtggcacggagtccgtgcattggtcctgcgggtgggcctgcgggaacattctggaactcttcagtgcttgccttagaatgaggatgtccccatttaaaaaggttcgcttggcggggcacggtggctcacgcctgtaatcccaacactttgggaggccaaggtggcaggatcacatggtcaggagattgagaccatcctggctaacacagtgaaaccctttctctactaaaaatacaaaaaattggccgggcgtggtggcgggcacctgtgatcccagctactcgggaggctgaggcaggagaattgcttgaacctaggaggtggagattgcagtgagccgagatcgtgccattgcaccccagcctgggcaacagagcgagaaaaaaaaaaaaaagaggctccctaaagcaggagcaggtgcagcccgttggagagctccttgggcttctcaattgcagagggtaggactcattttcacccattttctttccccctttggtgggacctctcaggcgtaccttaaatgttcccttggttggctcccacaagcacagccaattttccagagtctggttcagtctcctgagatctgtgtccaaaatctccagcccatggccaggcacagtggctcatgcctgtaatctcagcactttgggaggccgaggtgggaggactgcttgaggccaggagtttgagaccagcctgggcaacatagtgagacccccatctgtacagaaaaaaagaaaaaaaaaattagccaggcgtggtggtgcgtgcctgtggtcctagctactcgggaggctaaggtgggaaggtgggaggatcgcttgagcctgtgagttcaaggctgcagtgagctgtgatcatagcactgcactccagcctgcgtgacagagtgagatccccatctcaaaacaaaaacaaaaaacaaagtctccagccccagattagcctgtgtgctggacttggagaccccagcatgttcatggcacagtggagttttggagggttttcattgaccttgcgtccatgtggcatggcggtcttgcaagagaaacaggtagtggatctttcattctgccagctctctggtccttgagcacacatcagccccccccttcgggcttgtgaaaacacagatatttctgggttcaccttggggttgctgattcagtaggtcccagcagagcctgagactctgcatttctccaagctcctaggtgatgctgctgctgctggtttgtggaccgcattttaagaagcatggctttacatcagtggttcccaaccttggctgcacaatcatctgggctgttttaaaaatcatgatgtccaggccctactccattaaatccaactctggatgtagggtcctggcattagcacttttcaagttacctggtaggctgggcatggtagctcatgcctgcaatcccagtgcttttgggaggcctggctcctggctttaggccaggagtttgagaccagcctgggcaatatagcaagatcccatctctacgaaaaattttgtttaaaatttagccaggcatggtggcatgcacctgtagtcccagctactcgggaggttgaggcaagaggattgcttgagcccaggaggtcaagactgcagtgaattatgatcatgccactgcccttcagcctgggcaacagagcaagactctgctgctatacaaataaaataaaaataaagttcccaggcgattctagccagtgtgcgagtcatcacgttccactttacttatgatacactcagcagaggcccccaggtttataccaacttggaaatttaaaatccactggggaatgaaaaaacatgatggtgtctaatccatttctaagccaaggcggaatgattgcagtatgattcacggcttggattcttattcttttggcttcaataatctcctttctgtgtattcagggcagatattcagctgagacacattggcacagctgattgttaaaatattaaaatatttccacaccagttagtaaatagctgttgcctggaggcccctagtgagctcccccacccacccaagtcccttcctgggtcctcccatgcctcctgacaatcagtgctctggggatagtgcctcctactggtagctacatattttaaccttccctgcagtgtgtttgatctacttactcacgtctttatctttagtttttgtgtctgagcacgtgagtatctcaaatagataagaaggtgggtttgcaaactcaggagtgtggttctgctgtaatctcaacataatgcagtctctcatttagctgcgttatgttgatggctggcagggctggacagtccatgaggtttcactcacatgtttgcaccaaacatgagctttttcagtatattctttctctccatgtggctagcttgagcttccttatagcatggtggctttgcataattgaacattcaaaagtctgactttaaagaaggggcgtgtcaaacttgaaagcagaagctgcaagggaggctgccaggtttgaaggagctcagatatcaccttgggaagcttgggatttatcccattttcattgaccaggctattggaggtctgtccaccattggctggagtgcagtggtgcaatcgtgtatggctcattgcagcttggaactcctgggctcaagtaatcctcccacctcagcctcccaagtagctgggactacaggtgcacaccactatgcctggctaattattttattttattttttgagcgacggggtctcactatgttgccaaggctggtcttgaactcctagactcaagagatcctcccacctcagcctcctgagtagcatcggaggtcttttgatgggagaccatgcacttcaacacatcataatggtgttttacaaagtaatttctgaaaagagtccaggtcagtgggaagtacagagtctggagagaaaaatgccagctctttctactcttacgtgaccctgtgttttatttaactttcatgagttttcagttgcatcatctgtaaaacaggataagaatctgtaccatacacactctgcagggcttttataaggatcaaataaggtactttgaaatccagggttgctaaactcaattgtctacaggggccaagtgggtaatggtgactggggcagcttccatgtcagggagacattagagagtggtgaggtctttggcaaactagatagctccaggctcatctgaaggatataaccattattcaatagaagctgattgctgtcatgcaggaatgtaggctcagctcgggtaaatcgtctgagtttttgagaaaaagcaaaaatttcacttttatatgtaatctcctgacttgttctgaacatatttttatcttaagatgtggatagatcaaggaagtaatttgtgagctctgagtttgtaacatctgctgtaaaccctaaaactcagtgtaaatactagttattaattttgtcatagatttttaaaactgggaggggaagatgagcaagagggaggtgtggaggggggcaatgccagtgagtcaggagatagctgaactaggacagcagtgttgggaataaaggtggggagaggatctaagaaacactttagaaggagaatcaataggattcacttgctaattggctggcgtgaagattcttaacattttctgagccgtggagctctcttcagtttgacaaaagccaagggatctcttctcagaattgtgctttttaagtgcataatatcaaatgcagaggaaatcaattacattgaacattagttataaaaatatttgaaagaacagatttgtcatacatcactaatgtgtttctttcataatgcataaataacaagagctagtaacagacctaacaacttcaaggtagtcatgagagtaagtgagtttcaagatatctgcaataattacaatgtgacataataaaaatgtggtttctgttttttggttggttgtttgttttgagagagagtcactctgttgcccaggctggagtgcagtgatgagatcacagctcacggcagcctctacctcccaggtgcagtggtgagatcacagctcatggcagcctctacctcccaggtgcaagtgatcctccaacctcagccccctgagtaggtgggtctacaggtgtgcaccaccatgcccagctaatttttgtatttttttgtagagatgggggtttcaccacgttccccaggccagtctcaaactcctgagctcaagtgatccacctgccttggccttccaaaatgctgggattacaggcgtgagctactgcccccagctgagatgtggtttctgttgatgacaaagtcacaggtgtcatgaacactgctaatattgctgcaatttgttgcctccatgcataattacagctagaggctgtaatgaatatgcgaattttcccaaccaaatttacaggctccctgaattataaacaagttaagtaccacttcatctaggaagtgaaagaacaggtgagttcaaagggaaatctgagatttctagtttggggagagtcaaagtggagttgcctaggaggctataagaaattggggaacagagcagaagagactaaaagtgggtagaaatagtgtttggggaactgtgagaaattgaacagagtgactaagcctgtaggctcaggagccacagtgcctggcttcaaatcctggcccaacgtcttaccagctttgtaatcttagtgcatttaacggcaccccacttctgataccaaatccagatttcattggcttgtataccagttactggaccaacatcttgtgcctcagtttttttcaactatgaaatggggatgataattgcatcacctacctctcagagagattgttagcatcaaattaattaatacatgcaaattacttagaacagtgcttggcacacagtaagtgctacatagacatagttatagaagggatggaagtggatgaggttcattcattaatcattcaacagagattcatcaagcagctttaaaaatgactttaattgacaaacaacaattgtatatattcatgggctacaatgtgatatttcaacctatgtgtacattatggaaagattcaatcaagctaattaacatacccatcacctcaccaacttatcactgaacactttggaggcagagaacaaatcagacaaggactttacactcatggagtttaaattttataagggaaaacagataatatactagtaaatagataatacaataatttgaggcagtgagattgacaataacactgcgatggggtaaaacgtgactgaaacaggagaacctaagaaaaggtggttaggggtggttcatctggtgaactgatatttgaattgagtgcttaatgaagaggatgagccagccatgcaaagttcttgggaaaggaagttccaagcagagagaacagcaagtgcaaaggccctgaggcaggaatgtgcctggtgtgttttgagtatcagcaagacagctggtgttggttgggacaaggtgagtgaggtgggagtgatgggaaatgaagtcagaggggttgatgtggatcagctcctgtgttatccatcaggcatatatggatgaatacattatagtcagtgccctcaatgaattcaaaatcattgccatagactgtcccaatgaggtaaatgctttaagagaggtataactgatggattagcaacagctttctttctcctcccctcccctcccctcccctccccttcccttcccttttctttcttgagacagagtctcattctgttgcccaggctggagagcagtggtgcaaattcagctcactgcagcctccacctcccgggttcaagcgattctcctgcctcagtctctcgagtagctgggattataggtgtgcgccaccatacccagctaatttttgtgtttttggtagagatgggggggagggtctcaccatgttggccaggcctggtctcgaactcatgacctcaagtgatctgcccaccttggcctcccaaagtgctgggatcacaggcgggagccaccgtcgccagcctagcaatagctttctaagggactcatgagctgaaaccaaaagataagtaggaaaacaatcaagaatggagcaagaagcctatgagttagccattagcattatccccatttagcagacgaggaaactcaggcacggagggactaggtaacttgtcctaggtcatatggggtacaagtggcatttgaacccaggcagcttgactctggatcttgtgccctgtaaccaccaacctattgtcctcttaaattttgccagttgtagtggctcagcctccagcatttcacttaatctttttacagaaagccggtgagatggggaatcactgatataccatttatgggatgcattaaaagccacgtgtaaaggccccccggcaggtcagttggagagctgggattgaacccaggtttgcctgagctcagcgtgcagttgttcacatgccacgccaggcggcacccttggtccctgcaccaaccccagctcctgagaggcggccggcatggaaatcagagtcattattgtgatcgttgcaaaatattttagtgagtgggtttcaaacactgtaaacaggtttagtcctcttctgctcctttgcaaagacgcaatttactcagagcaaaggaatctgagctaaatttaacaaactgaagctggtgagcggctcaaggagccctggggaggagctaccttggcagtgtcagataaggtggccaagagccttcctggatgctcttctccttctccccggccagtggtctctgggtattccaagtggggcgaggagcagagatgccatgccaaccgagggcgaaggactgaatagaaggggctgcccagggctgggagcggtggttcatgcctgtaatcccagcactttgggaggccaaggcgggaggctcgtttgaggtcaggagttcgagaccggcctgggcgatttggtgaaaccctgtctctactaaaatacaaaaaattagccaggcgtggtggtgggcacctgtaatcccagctactcaggaggctgaggcacgagaatcacttgaacctgggaggtagaggttgcagtgagccaagactgatccttccaagtagctggaactacagatcaagtcacgcactccagcctgggtgacagagtgagactccatctgagagagagacagagaaagagagagagagagagagagagaaggggcttcctattcctctctcatctgtctctgtttctctctatctgaattctgttttccctcggtctctctgtctttctctttgggtctctttctttctttctttctttctctttctttgggtctctgtctttttatttctgcccctttctctctctccctttggatctctatctctgtctttgcatcaccctctctctcttttgttctctcttcctccaacagcctccctgcaccagtgtgtgtgtgtgtgtgtgtgtgtgtctgtgtgtgtgtgtgtgtgttgctctttctctgtctctggatctctctgtctctttctcttattttctctgtctctctctgtctctgggtctctctgtctgtctctctttgggtctctctctgtatctttcttttttcttttctttttctttctttctttctttttttttttttttttttttttgagacagggtcttgctttgtcagccaggctggagtgcagtggcatgatctctgctcactgcaacctctgcctcccgggttcaagcaattctcctgcctcagcctcccgagtagctgggattataggcatgcgccaccacgcctggataatttttgaatttttagtagagacggggtttcgtcatgttggccaggctggtctcgaactcctgacctcaagtgatctgcccgcctcggcctcccaaaatgcagggattacatgagccactgcacccagccattctctctctgtatctctccatatggctttgggtctctctgtctttgtgtctctctctgtctctctctttgggtctctgtctgtccccctgtctctctctccctcctgcccccgcctttctctctcacacatgctttctctcatcgcccccttttgcccacccccgttcttgctgctccatctgcatgaccagaaggccaccctggctgtgggctgggctctgggcctggaagaggaattcctgcacccccggcattgggtcctagctgctagtaggcgctttcagtggacagcaagtgcgttaggtcagatttcctggaagaggagcccacgctggcgattcttgggtaaggagcttacaaagggggtgttctcaggagagacctctgaggcagtgcttctctaagttggctgcactttataattgcctggggagatttttaaaaatccgtgtggctgggcctcgtgccttaccaattaagtcaggacctctgggagtgtttccagtttgagaatcggtggtctaaggagaatgagaaaagcagcacagggcagaggaagaagctgatcaaggatgcggttcagcccaagttcagcctccacctgatcctgggggaggttccggatggtgaggagctcattgattcacctcagggtgatctacccaccagggtatatgagcaaggggtctgggctcttttttttttttttttttttttttttgagacagagtctctctctgtcgcccaggctggaatgcaatggagtgattttggctgactgcaacctctgcctcccaggttcaaatgtttctcctgcctcagcctccagagtagctggaatagctggaactacaggcatgcgccaccacgcccagccaatttttgtatttttagtagagacggggtttcaccatgctggccagggtggtcttgatctcttgacttcgtgatccgcccgcctcggcctcccaaactgctgggattacaggtgtgagccaccgtacccgtctgggtctgggctcttaaaccccaggctcagccagctacaggcagtggccgcctcccggaagaggggtcatgggtctaacccaggcatctcatggtgacgtaacgcccatcagctaaggggatgtctgggagccactaagaactcaactgggcatcgtggctcatgcctataatcccagcactttcggaggccgaggtgggaggatcacttgacgccaggaatttgagaccagcctgggcaacatagcaagacccagatttcttcaaaaaattaaataaaaaaacattagccgggtgtggtggcatgcacctgtaatcccagctaatcgggaggctgaggcaggaggatcacttgagtccaggaggtcaaggcagagtgggccgtgtttgcgccactgcactccagcctgggcaacagagcaagatcctatctcttaaaaacaaaaacaaaacaaaaccccaaaatcaaaaaaacagcccaactcacagtagcctgggacagacccccagctgggtcagagggatctggctggggaccagtagcttctcatcgggatgtagaaatggctggataatacaggacctataatattaacatgtttacatttctttttggaatcccatgcctttactcccgggagccactggccattgaaccaagagaaactgaaggtgctaatgaggtagagttgatgcatttgttgaattcctacaacatgctaaggcctggagtctggtggtggataatatcaatgtggaatttacatttgcttttttttttctttttctttttcttttgagacagggtctcgctctgtcacccaggctggagtgcagtggtgcaatcacagctcactgcagccttgacctcccagcctcaagccatcctcctgcctcacccttccaaatagctaggactacaggcacgtgccatcgcacctggctaatttttgtatttttagtagagatggggtttcgccatgttgcccggactggtctcgaacttctgagttcaagcaatctgcccacatcagcctcccaaagtgctgggattacaggtgtgagccaacacacctggccggaatttacattttcacaggaaagacagataataaatgattaagcccaaaagtaagcacatcatttcagattattttgaagagagatgttttcaggggtcattatgagatgggctaaggaggggtgagcagttgggtagagaaggtctctcaagagatggcagtgatgcctgaatggggagaaggaggcagccactgaggatgcaaggataggtgttgcgggctgagggaacagaaagtgcaaaggtcctgaggcagcgatgaccctgatatgttttaggagcagaagagaggctggtgaggatggaatgggatgagttgggggagagaagtagaagatgctgttggtaggagtcagattatgtagactcctgtagaccagcatggagaggctgggtcattttttctttttcttttaaatttaattttattttaagttctgggatacaagtgcaggacatgcaggtttgctacataggtaaacgtgtgccacggtggttggctgtgcctatcaacccatcacctaggtactaagcccagcatgcattagctatttatcctgatgctctctctcctcctcccaccgatgacaggctccagcgtgtgctcttcccctctctgtgtccatgtgttctcattgttcagctcccacttataagtgagaatatgtggtgtttgatcttctgttcctgttttagtttgctgaggataatgataatggcttccagctccatccatgtccctgcaaaggacatgatctcattcgtttttatggctgcatggtattctatggtgtgtatgtaccacattttctttttccagtctgttattgatgaacatttgggttgattccatatctttgctatcatgaatactgctgcaatgaatatatgtgtgcttgttttttctaagtgcaatggggagccataggaggtttgaagcaggggagtaacatgatttgatttcaattttttttttttttttttttagagatggtcttgctttgacacccaggttggagtgcagtggtgccatcatagctcacggcagccttgaactcctgggctcaaggaatcctcctgcctcagccttccaagtagctgggaattcaggtgtataccaccatgtctagctaatttaaaaattttttttggccgggcgtggtggctcacacctgtaatcccagcactttgggggtgctgaggcgggcagattacgaggtcaggagattgagaccatcctggctaacgtggtgaaaccccgtcactaataaaaatacaaaaaaattagccaggcgtggtggcgggagcctgtagtcccagctactctggaggctgaggcaggagaatggcatgaacctgggaggcggagcttgcagtgagtcgagatcgtgccactgcactccagcctgggcgacagagcaagactctgtctcaaaaaaaaaaattttttttttgtagagacggagtctctctgtgtcgcccaggctgcagtgcagtggtgcaatcatagctcactgcagcctcaaaactctgggctcaagtgatccttccacctcagcctcccaagtagctgggatttataggccctcacccccatgcctggctattgatttagaatttttaaaaagatgtaaaattcacataacatgcagttaaccatattaaagcaaacaattcagtggcatttagtatatttatgatgttgtgcaaccatcacctctagttccaaaacagtttcatcaccccagatggaaatcagaccagtgtctgatgcacagtaaataaagtctctccagatcatgcagggctggataggtgctacaatcaaataatgatttgtgttcaatatccatggtggttaatattattatgattattagaataataaataatattattatagcaatactagtaatagaggcagctatagcagagcaggtcaaagaagggagagagggtcaaatggcctgggttcaaatcctggctctgccacactcactagctgtgtggtcttggaagagtcacttcacctctctgggcctcagtttcctcacctgtaaaatgggagagcaatcagccgggtgcagtggctgatacctgtaatcccagcagtttgggaggctgaggcgggcggatcacaaggtcaggagttcaagaccagcctggccaatatggtgaaaccccgtctctactaaaaatacaaaaattagctgggtgtggtggtgtgcacctgtactcccagctacttgggaggttgaggcagaagaatcacttgaacccgggaggcagaggttgcagtgagccaagatcacatcaccgtactccagcctgggcaatagagcgagactccatctcaaaaaaaaaaaagaaaaaaagaaaaagaaaaagggatcgcaatcatatcaatctcataaggttagctaataaatgtgatgtgtcaggtatatagtgagtgctatgaaagtacttcctatttatccctctcactgattatgagatctgtcacgttcagatcttccctgtagtttgagatattttccatgtgtatcaaagtgggtagcaggttaaaatagctctttccaaaataacctcattggatggttcttctaatactggatcgattccctcttctccagctctcactctaccttccctagttcttagcaagatggtggccatctacatgggacaggaagcccatggaaggtgagcagaatgatccaggcaggactgaatcattcttttcttttcttttttttttttgaggcagagtctcgctctgtcacccaggctggagtgcagtggtgcaatctcagctcactgcaagctccactttccaggttcacgccattctcctgcctcagcctcccgagtagctgggactacagttgcctgccaccacacccagctaattttttgtatttttagtacagacagggtttcaccatgttagccaggatggtctcgatctcctgacttcatgatccgcccgccttggcctcccaaagtgctgggattacaggtgtgagccaccgcgcccggcctcttttcttttattattatttatttttatttttttgaggcagagtcttattctgttgcccaggctggagtgcagtggcacgatcttggctcactgcaaccttagcttcctgggctcaagtgattcttatgcctcagcctcctgagtagctgggattacaggcattcgtcactacacccagctaatttttgtatttttaatagagacagggattcatcatattgaccagactggtctctaactcctggcctcaggtgatccacctgtctcagcttcccaaagtgctgggattacaggtgtgagccaccgcacccgggccattattattattatcatttagagacagggtcccactctgtcatctaggctggagtgcagtggtgtgatcatagcttacttcaaacttctgctcaagtgatcctccagcctcagccttccaggtagctgggactacagatgcacaccacgatgcctggctattttaaaatttttttgtagagacagggtctcactatgttgcccaggaaggtctcaaactcctggcctcaagtgatcctcctgcctcggccacccaaagtgatagtattacaggcgtataccattgcgcctagcctgaattattcaaatagaatcacagaatagtcgggaatgatggctcccgcctataattccagctactcaggagttagaggcagaaggatcgcctgagtgcttgagcccaggagttcatatagtgagctatgattgcgccactgcactccagcctgggtgacagggcgagatcctactaaaaaaaaaaaaaaaaaaaaaaaaaaaaaggaaggaaatcctgtaatttgcagcaacatgaatgaacctgaaggacattatgttaagtgaaataaactacacatagacaaatactgcaggatctcacttacatgcggaatctaaaaaagtcaaactcacagaggcagagagtagaatgatggttacccgggactgggggcagggaagaaatgcagaaatgtcagtcaagcagtgcaagctttgagttaggcaagatgagtaagttctggggagttaatgtacagcatgatgactatagttaagaatactgtattgtctacttgatttgttttgttttgttttgttttgagatggagtcttgctgtgtcacctaggctggagtgccgtggtatgatcttggctcactgcaacctccgcctcctgtgttcaaacaattctcctgcctcagcctcctgagtagctgggattacaggtgcccaccaccatgcccggctctttttttttttttgtatttttagtagaaacggagtttcaccatgttggccagactggtttcaaactcctggcctcaagtaatccacctgcctcagcctcccaaagtgctgggattacagacgtgagctgccacacccagcctgtctacttgaaatttgctaaaaggatatatcttaaatgttctcaccacacacagactaaatggtaaccagatgaggtgatggatgtattaattcgcttgatagtggtaatcatttttcgatgtacacacattatcaaagatcatgttgtacacctgaaatattatcttagtccatttgtgttgctataaaagagtacccagcttcaggtactccttgggtacacaaatggaaaacaggcttattggtcatagttctgcaagctgtaccagaagcatggcaccagcatctgcttctgatgagaacctcaggctgcttctactcatagtggaagggaaagggggacccagtgtgtggagatccatggtgagagaggaagcaagagagggcagggagatgtgcggggctctttttttttttttttttcctgagacagagtctcgttctgtctcccaggctggagtgcagtggtgcgatctcagctcgctgcaacctccacctccccggttcaagtgattctcctgcctcagtctctctagtagctgggataacaggcacccaccaccatgcccggctaatttttgtatttttagtagagacaggatttcaccttattggtcagtctggtctctaactcctgacctcaggtgatctacctaccttggcctcccaaagtgctgggattacaggtgtgagccaccgcactcggccagggctccttttagtaatcagctcttgctggagctaatagagtgagaagtcactcactcgttactatgagaaagccaccaagccattcacgagggatccactctgctcccatgaccaaaacacctcccatcaggccccacctccaatattggggataaaatttcaacatgaggccaggtgcggtggctcatgcctgtaatccccacacttttgaaagtgaggtgggatcacttggggccaggaattcaagaccagcctgggcaacagagtgagaccttgtttatacaaaaacaaacaaaacacacacacacaaaaacaaacaactagccaggtatggtagtgcatgtcggtagtcccagctattcagcaggctgaagcaggagcatcacttataaccaggagtttgagactttagtgagctatgactgcacaactgcactctagcctggggaacagagcaaaaccctgtctgtaaactaataatgataataataaaatttttaacatgaggtttggggacacaaacatccaaactatagcaaatgtacaccattttttatttgtcaattatatctcaacaaagctggggaaaaaagcaaaagtcttcaaagaaggcaggaagaacagcctcaatgaaggaggaaatgaagccagtgacctaggcagaggcagattaaaacaaaacaaaacaaaacaaaacaaaacaaaacaaaacaccacagctcctttaaactttctgggcctaaacaaatcccatccaagggtggagggagaatttgcacatgtggtggggaagccacttgttgcggactttgaaaatcatgaagcaagccagactgggccaggactggggtgaggtaggggaggtgcttacgttaggcacaaactctaagagtaccaacaaattcagagatcaaggtaaataacattttagtacaataatttcagaaataaaaatcaatgcaaaaatccatgatgagcaaaaatatcaactttctcaataaaagcaagatcagtatttcagatttttcctttggcctcaggatgcaatatggcttggcatgtgtgatgagttgaaatgtttccctctcctacccctcacgctcatatgttaaggtcctaacgccccgccttaatctgtttgggctgctataacaaaatgtcttagactgtgtaatttataaacaaaggaaatttatggcttacagttctggaggctgggaagtccaagatcaaggcaccagtagatttggtgtctggtgagggcccttcctcatagacagcacattgtgtcttcaaatagtggacgtggcaagcagactccttggaatctctctctctttttttttttgttgttgttgttttgttttgttttttgagataggctgcccaggctggagtgtagtggtgcaatcatggctcactgcagcctcgacctcccaggctcaagcaatcctcccgcctcagcctcctgaatagctgagaccacaaaggcacaccaccacacttggctaattttaaaaattttttggtagagacgggatcttcctgtgttgctcagactggtctcaaactcctgggctcgagcaatccttttgtcttggctttgcaatgtgctgagattacaggcatgaaccacccttgagcctcttttataaaggcactattcccattcgtgaaggtgcagtactcatgacctaatcacctctcaaagtcctccctcttaatactattgcactgtggactaagtatcaacatgcaaatagtgggctggggcagtggctcacgtctgtaatcccagcactttgggaggctgaggcaggcggatcactcaaggccaggagttcaagaccagcctggccaacatggtgaaaccttgtctctactaaaaatacaaaaatcagctgggcgtggtggcgggtgcctataatcccaactactcaggaggctgaggtgggagaattacttgaacacaggaagcagaggttgcagtgagctgagattgcaccactgcactccagcctggacaacagagcaagacttcatctcaaaacaaaaacaaacaaaaaaaccagaaatgacaacaaaaaaacatacaaattttggagagacacaacattaagactatagcatcttgagtaccctagaatgtgaacttttttggaaattgcagacatagttggagacataattagttaagatgaggtgggcccctaatccaatgtgagtgggtcgtccatatagaaaggggaaaactggacacagccatgtgcacttgggagaatgttgtgtaaagactggagttgtggggccgagtgcggtggctcatgcctgtaatcccagcactttgggaggccaaggggggcggaacacgaggtcaagagatggagaccatcctcgccaacatagtgaaacccaatctctactaaaaatacaaaaattagctgggcatggtggcgcacgcctgtaatcccagctactcgggaggctgaggctggagaatggcgtgaacccgggaggcagagcttgcagtgagcagagatggcgccactgcactccagcctgggtgacagagtgagactccgtctcaaaaaaaaaaaaaaaaaaaagagatggagaccatccttgccaacatagtgaaaccctatctctactaaaaatacaaaaattagctgggcgtggtggtgcacgcctgtaatcccagctactcgggaggctgaggcaggagaatcgcttgaacccaggaagtagaggttgcagtcagccaagatcgcaccactgcactccagcctggcgacagagtcagactacgtctcaaataaataaataaataaaataaaaagattggagttgtgctgccatatgctgagagacgacctgaagccaggagagagacctggaacaaatccttcctccgcaccttcagagggaggatagccccgttgacaccttgatctatgaattctagattccagaactgagagacagtctgtttttttgctgaatccactcagtgtggtgccttgtcacggcagccgtagcaaactcaaatagcccagcgtgtaagtgtttaattttgtgctcaaagccagtgctcattctcctcactctggccccaatctcgatgcacgggggtgtcaggaaatggggtttaggctgttgttttctttcctttaaataaaacaagagctttggcgaggcacagtggctcacgcctgtaattctagcgctttgagaagctgaggcaggaggatctcttgaagccaggagttcgagaccagcctgggcaacatagcaagaccttgtttctaccaaaaaaaaaaaaaaaaagaaaattatccaggtatggtggtgcacctgtagtcccagctactcagggagctgaggcaggaggatggcttgagcccaggagttccaggctacagagtgctgtgattgtgcccctgcatcccagcctgggcaacagagtgagatcttgcctcaaaaataaataaataaataaataaacagctttattgggctataactcacataccttaaaattcacccctttaaagtgtacaattcagtggtttttagcacgttctagattgtataatcaacaacaccatctaatttcgtaacatttttatcacccccaccaaagaactttatacccaccataggttgctgttttctggattaataaaaaaacaacctagtctgggccttacctgaccagctcaggtaaagcggatgacgccttccttgtcctccccactgaggatgcatctctatgataatcagatctggcacaggcatcagcccatcagtgtgcacatgacccatagctagggactgggagcccagggttttcctgagtgcccgaactatccctttatttatttttattttattattattattttttgagatggagtcttgctctgtcacccgggctggagtgaagtggcgtgttgaaaccttggtctaggaattctatattccagaactgaattctagaattccagaattctcagctcactgcaacccccacctcccaggttcaagtgattctcctgcctcaacctccctactagctgggattacaggcatgagccaccatgctgtgctaatttttgtatttttagtagagacggggtttcgccatgttggccaggctggtcttgaactcctgacctcaggtgatctgcctgcctctgcctcccaaagtgctgggattgcaggtgtgagccaccatgcctggccctatccctttatttgatgggtcaaaaggaggtctagggtggcttggaggaaggacccagagagcaggtggggggccctcaggggtactcatatattaatcaaagttctccagagaagcagaaacaataggatgaagcctatatctctaactccatctccatctatgcctatgtccatcttcatctatgtctattcatacccacgtgtatatccacgtctatgtctatatttatcctgttggccttacatgtgtatacatgtaggagagggtgtactataaggtattggttcatgtaattatagaaactaagaagtcccctgatttgccatctgcaagctggagacccaagaaagctggtggtgtattttgaaggcttgagaaccagagggctgattccagtccaggtctgaaggcctgagaaccaggagcaccaagggcaggagaaaattgatgtcccagctccgcagtccagcagagttaattcaaccttcctccacttttttgttctattcagcccctcaacagatgggacaatgcccagctacactgcggagggccatctgctttactgagtcccccactgcaaacgctaatctctttcagaatcaccctgatatgatttggctgtgtccccacccaaatctcatcttgaaattgtaactcccataatttccatgtgctgtgggaggaacccggtgggagataactgaatcatgggggtggttgccccatactgttctcatggtagtgaataagtctcatgagatctgatggttttataaggggaaatccctctcacttggttcttctctcttgtctgctgtcaagtaagatgtgccttttgccttctaccatgattgtgaggcctccccagccatgtggaactgtgagtccattaaacctctttttctttataaattacccggtctctggtatgtctttatcagcaacatgaaaacgggctaatacccaccctcacagacacacccagaaatcatgtttaagcaaatatctgggcatcccatagcccagtcacattcacatacaaaattaaccatcataactcaggacagtggctatctatgaacttatgtggtatatttcaccattgtaacagcctgagcagtgagcagcagccatgattacaacctcccagttggtttggtgtttctcccttcaaatatttgctccctagtttgaccttcagctatttgagagcagggtcaatgaatcaatgtggtgttagtacttggtatactgtgggtgcttaataaatgtttgccaaatttatatttaaagcctggacagtcacaagcctgtgggaaagagatgatgagggtggctttacccataaatgtgcttgacgggggaggattcccttgtggagaagtccagcttgctggacagcaatggagttaagaggttgaatcctggagtcaagatgggaatttgggtctcagctatgttacctccttgctgcataacctgggatgactgtggtctttctatgtgtcctggtctgtgcattaaaggtgataataatttatccccaggcttcgtttggggtctcctgaggcagactctgagaaaagaattcaagtgcgaatagtcatttgggaggttactccaggaaatacccataggcgagaggggaagtgaaagagggaagggaagggaaggtagctagtgaatggtatgttattaagtcatcactgtgggcaattggggctcagccccatcaggaagcactggaggaggatagcatagacctcaggcatcctactttagaggtgagggagctggggtatttatccaacaattctcattactcatgggttgaggacattaattgtttccaggggtgttaacttccagcatttttgggtgtactccctccctcaaaatttactgaggggttattattggtgggctaccaaatgagttggcagaggcttctcaggaacactcagtgaaatgatgcatcaaaactgcaaatcctcaatgttgggtgctcttctctctgaaattgcagctctcaggctcagtagaaaaaaaggctgatatatctgttaggataaggctaggctgctgttaacaaagaaccccaatactattaatatttcaatgccttaaagagggtgggagtattttcctctcaattgttacagttcaagttgctacggtctaggttgatgacagtggctctgctccaggcagtcattcaggagcccaggttctttctgttgtgtggttctgccattgctgatactatagatattccgcgtgccatccttctggcacttcccatatctataccttccagcccaattctcggctgacagcaactgcatctttatgtcctggcagccaaagttctctatgtgtgcaaccaaggcaagcctgaagtgctggggagcaggcccaacaatgactactgagggttggtgtttaaatactccagctccctcccacttgggtggatgcctccaaggtctatgttccactctgcttcccagaactcaccagtgttattcagtcccaggtgcccacagtggtacctggttcaacaacacaccactcactggctgccttcgattccttgtctcacttcctttctgccctactggtgttttctcgggtcatttcataaataaatgcagtcatgtgcctcataatgatgtcttggtcaatgacagaccacatgtgtgaaagtggccccgtaagattatcatggaaggctgggcacggtggctcatgcttgtaatcccagcactttggtaggctgaggcgggtgatcacttgaggtcaggagttcaagaccagcctggccaacatggtgaaaccccgtctctactaaaaatacaaaaaaaaaattagccaggtatggtggtgtgtgcctgtaatcccagctactcagaaggctgaagcagaatcgcttgaacccaggaggcagaggttgtagtgagccgagatcgtgccactgcactccagcctgggcaacagagtgagactctgtctcattaaaaaaaaaaaaaaaatctaacggagctaaaacgtttatattttctagtgacgtcttaatgatcctgaccctgtatagtactaggctaatgtgtgtttgtgtattaaactttaacaaaaatgttttagaaataaaactattttttaattaaatatagaaaaaagcatatagaataaggatataaagaaagaaaatattttttacagatgtacaatgtgttttatgctaagtgttattactaaagtttatcagtgttattccagtgttattacaaaaagcaccagcatctagatttagtaatcttcgattactaaagtgttattacaaaaagtttttaaggctagtgcaattgctcacgcctgtaatcccagaactttgggaggctgaggtgggtggacctgagatcaggagttcaagatcagcctggccaacatggtgaaaccctgtttctactaaaaatataaaaattagctgggcgtggtggcacatgcctgtaatcccagctactcaggaggctgaggcaggagaatcacttgaacccgggaggtggaagttgcagtgagctaagattgtgccattgcactccagcctaggtgacaagagcaacactccacaaacaaaaaacaaacaaaaaaattttttaaattaaaaagttaataaagtaaaaatagttatagtaaactagggtaatttattattgaagaaagaaagagttgttttttgtaaatgtagcgtggcctaagtgtggagtgtttgtaaattcttttttttttttcatttttaattaaaaagtaaactttaatgtcaaaaatgcaaacttgggggaagacagaaaagatcacacacaaggctatcacttcacacttggaaggttgcacagcagccggacagaggcgctcctcacttcccagatggggcgaccggggtgtttgtaaattctatagtagtgtatggtaatgtcctataccttcacactcactcactcttcactgaattagcctgtagtcctgtaagctccatttctgatgaatgtcctatatagatgtaccatttcttatcttttatatcatgtctttactatattttttctatggttagatatgtttagatacacaaatattttcctttgtggtaactatctacctaatccagatctgaaacaggcacctgcaacctctcccatttccctggtcacatgaccacacagaattgcaagggcatctgggaaatgtagtccatcccatgcccaggacgctggtagacaccacctttctcttctacatccaggagtggcaaaggtgactgatcaaggacaaaaacttacaacctttactcataaagtgcataattcacttgcggataacttcacgctcacaatcataactgtctttctccctgggttagcctaaaagttccttttctgttcatttccaggagcaaagccagttcctagtcttgaaatcttagtggtgtagcacttgagcgctgaagaacagagaaatctgcctctatttttgtgtttctggttagatgacagttctataggtgtagtatctggaccctgggatacctgcccgcacccaagccagccaactagacagtcatggaacacaaaaatatatgtgtgttttctttgtgaggctgatctagtatttgtacctagttttcttgggaatgctttctggataaatattctttagagggttaattttttttgtttttattttgtttgtttgtttgttttgagacagtctctctctgtcacccaggctggagtacagtggtaggatcttggctcactgcaatctcttcctcccaggttcaagtgattctcctgcctcagcatgcccgaggagtggggattacaggcatgtgccaccacacctggctaatttttgtatttttagtagagacggggtctcacattgttgcccaacctggtctcaaactcctggcctcaagcgatccgcccacctcggcctcccaaagtgctaggattacaggcgtgagccaccgcccccagccaaaaaataatttttttaagtgagctctattttcattttggtggtggtggtggtggggcggggtttgttagtgaagcttaaatgttgcatttctggagggttttttttttttgccttttctctagaggaggcagaaatgggtggaaatctctccagcctccaaggcagtgtattcagatcccatcagagctggttcttaatccttttttttttttgccttggaagcatcttttttttccaccaccccagcatcttgccagccagttcttctgagagctctcctcttcctcccccgactcggaggcttttccaaagctctcagattaaaaagtgctgagaccagtgtctctaagtgctgcactctcctgttgtcatgggaagggagctggcacggatgagctaactccttcctcctcaggggcgacaagcaacctgggcccacggtacaacatgggcccacggtacaacctggggcgttagccttttacagtctccagcagcagccttctaccagccaagccattgtgctcgtcgataattcaaaaatattttgcattttaaaagtttttaaaaattgggatgtcaagatacatttgacaagatgtataaaaatgcatatactttaagttcagagcaccacaaatttttacagatgtatacaactagtgaacatcacccacatctggatggagaacaaccctgaccccccagcaaggtgccttggcaccccttctgagtctataccccattattctgatgtctaacttattcttatttttaaacttccaataaatggatctctcctgcctccccaccccaccgcacaattcttggccatggacaattgacattttcctagttttaagtgtgaataaaaacatcagcttcccaaagtgctggtattgcaggtgtgagccaccaagccaggcctaaatcaatgtttttgacgtgtttgagttgatctctgatttctcctgcaagatgatccccactattggtgaatggtcctgcagaatttttcccatccatgtataaagataagcaaaattcatctcctacctatctgttgctttataacatgttcttttccacttagtaatgggtgatgatgttgatgatgatgtctttacagtatgggctaggatttctttcaaaccttcattcagtattgttcagtgagcacctactctgttttgtgttccagagctggggatccaccagtgccttcatttagaaagattttaaaaaattcctgccttgttgcctgggctcagtggctcatacctatgatcccagcactttgggatgctgaggtgggatgatttcttgaagccaggagttcgagaccggcctgggcaacaaaggcagatcctatctctaccaaacaaacaaacaaacaaaactcagactggcatgatggtgcatgcctggggaggttgaagcagaaggatcacttgccaggagatggagactgcagcaagctatgatcgtgccactgcacgcctgtcagagcaacagagcaagaccctgtctctgaaaaaacaaaaatccctaccttgtcctctactttatttttgctcctctttctcatttgtaaaataaggataacactggaacctatcccatacagtttcaaggagaatgaattgagttaatacatgttaggttgtcagctaagtgcctggcgcatagtaagaatgatatttcttagccattactgtgatcattcttcttttatcttttcccttcttttctttcccctttctatgtctcttttgcatatcttctcactctccctttctcttatggggaggaaggatggttaaattccaagtgttctgtgtgggtctattaccaatggctaggaagagaagaatgaactaaattagaagatgcattcggctagctcagggagcagtgggggagagctggagccagctggaatggaatggacatatcttcctccccctttcccatccgattcccccctcagacaaattatttcttattgtttctggggatccagaggagattagcctggcaagtgggcactgggggcaggggttggccatacagcagatgaaagaaaggcttactgctggcaagagccacccactcgtttatctgcctgtctctgaggtccctctgttcccttcccacacaccttgcctgctatttaatcagaggagagaatgcatgcatgagccctgcagccaccatcagtggtacagccttttgtttttcttaccctttttaaaaataaatccattgtcagaggaaggcaacactttttactatttaatcattcacttactggttcattcaacacaacagctatttactggatgctgctggggtcagggctgggaacacaaacacgaagagaccacagtgctcacccctcaggaacgaacaatctagggcagccaacacagaaatcaacaatcgtcacggtgccagatgaatgctgcagggaggaatgttcggagtgaaataggcacccttaggtttgctctatggaatcacggaagccttcccagaggaggaagcattgggtcaaggtgggaggtgagccagagtgtgtcaggctaatgaatgtggtgggctggggaggccattccagatggacgggatagcccaggggtatctatcagaattctttaaattgcaagagacacaatgcaaacagacttagattaaaaactggggtaagggggatttattgactcaagtcatttaaatgtaggctccaggaatggctgtatctagaggctgaaataaggtagctgaccttatttcagctttcaggaatggttgtatcctggggctgaaataatgttagttttcaggaatggctgtaaccaggggctgaaataaggtcagctttcaggaatggttgtatccagggggtgaactattgtcaggtttcaggaatggctgtatccaggtgctgaaataatgtcaggtttcaggaatggttgtatccagggggtgaactactgtcaggtttcaggaatggctgtatccaggggctgacgtaatgtccggtttcagaaatggcctattcaggggctggaatgaggtcatcaacctgtggtataataaaaaatacttggtctctgtccccagttcctgtgacatgctcaaggtgaagccagctcttgcaggacacagagtgggtgacagagttaggggtcaaatgatttcttgtctggttgtgtcccacactttgttgattccagacaccatttcagtttttccacacctactttactgcttgtattacttcagtaggttaaatagtgtcctctgctgttattatgatataataagaaatacatatttgatcttcatccctgattcctggtacagcgctcttaaaactcttgtaatttcctgagtaataaagatgataggagcatcttttgttatgttcagtcttagtctagggttcctaatacaaaagcttctaagacccttagaatctcctgaatgataagagtctcttgggtacgctaatgattggttcggggtgcctagatggtttcaggatggggcctggtcaccagaaaaaccaagatatgattaaaaggttgagattttcttttcttttttttttttttttttttttttgaggcagagtttcgctcttgttgcccagactggagtgcaacggcacaatctcggctcactgcaacttccacctcccaggttcaagcaattctcctccctcagccttccaagtagctgagattacagtcatgttccatcatgctcggctaattttgtatttttagtagagacggggtttcgccatgttgatcaggctggtctcgaacccctgacctcaagtgatacacccgccttggcctcccaaagtgctgggattacaggcgtgagccactgtgcccggccagggttgggattttcaatcccacccttcagcccccagggagtggagagaagctggagattgagctctttcatctctttaatcaccagtggtcagtgatttaatgaatcatgcctacaaaatgaagcttccataaaaattcctaaacaatgagattctcagtgagggaactctgatatgtgccataacatggatgaacccagaggacattgtgctcagtgaaataaacctgacccaaaaggacaaatactatatgattccacttatataaggtccctagagtagtcaaattcatagagacagaaagtagaatggtgggtgccagcaggtagggaagagggaatggggagttatagtttaatggtgacagagttgcagtttgggaagatgagaaagttttgcagattgatgatgctgatgcttgtacaaccacatgaccacttaatctactaacctgtgcacttaaaaatggttaagatggtaaagtttatgttgtgtgaattttgccacaattagaaagagagagttattaaagagttttgccagcgtggtggctcacgtctgtgatcccagcactttgggaagccaaaggcaggagaatcacttgaggccaggaattcgagaccagcctgggcaacatagtgagacctcgtctctacaaaacaaactaaaaaaataaaaattaggtgcctgggatgacactcacctgtaatcctaactactcaggaggctgtgacaggaggatcacttgagaccaggagttggaggctatagtgagctatgattatgccactgcactccagcctgggcaaaaaagaaagaccccgtctctttaaaaaaaaaaaaaaaaaaaaaaaaaaagttagggccgggcgcggtggctcatgcctgtaatcccagcactttgggaggccgaggcgggtggatcacgaggtcaggagatcgagaccatcctggctaatatggtgaaaccccgtctctactaaaaatacaaaaaaaaaattagccggcgtggtggtgggcgcctgtagtcccagctactcaggaggctgaggcaggagaatggtgtgaaactgggaggcagagcttgcagtgagccgagatcgtgccactgcactgcagcctgggggactgagcaagactctgtctcaaaaaaaaaaaaaaaaagttttaccatctcctcgatcagatgtgtaagttagaaaaggccatctggggccagtgtaagggacggttggagaaaaatgatactagaggaggagaaccaggagggaagatactgctacagtccaagcaaatgatgatggaggccagaattgagtggtcacaggggcagagaggagggaatgggttgcagaagtatttgacaagtggctggctgcttaattgaataggggttgtgaaaagggctttgaatctgtttagacctggttattaatgctttttaaaacctgtattatttggattagggctcccagcaggacctaaactgggactcctggtttgaccatctcaaatgcattgttgggctcacttggcaaatctgtacagatttgcatgaactgatacagttttatgtggtcccaccaggaaagggtgttgggctgcaagtcacagcaaactcaagcagattgaacagcaagggaaggtactggttttcatgactgtaagtccagtggtggtgtgggcttcaggatggggttgatccagcactattttcacctctcaaggagccaaaatcttaagatagctgccactgcagtcgaagctacctgttttcctgtttatacccagtggaatggttgaaaagggtagtttcccatgacttttgtgaaagataagaattctttgcagatgtctccagtaatttttttgtgggctgtttattacccaaattaaagtgtgtttgaaagttgggtccctttgtggtcacagccagccatgcaacaggacttgaggatgcaacaggacttgaggcagattctacaatgtcacatggagttggttgagttaggttgggggtaaacataggagctccaggggtgagacacccccgtcatcccatcattccacaaagagggatgccagcacccggcaccctgatggacatgcagagggaatctacaagccaggacacattgcctggttggtggaaagtgccttctgataagataaagttgcctttcttccaggcagccacagcccatcctagggaacatgtttaaatgcatgtaggcttaatttaaaacaattttcaaaaccactttttattatgaacattttcaaactcaccccaaaatggagagaaacataaagacgatcttcaggaatctatttcctgacttcaataaatatcaatatttggcaaatctagtttctttatgctctcacctattatctgcactttgctgtattattttaaagcaaagtctagtcattgcatcattgtatctgttaatgttacagatgattggagtctaatctaatagactctaagagacactgtgtattagaaagtacagtctagccaggtgcagtggattatcctgtaatcttggtgcttttggaggctgaggtgggtggatcacttgaggccaggagtttgagaccagcctaggcaacatagaaagatctcatcactacaattattgttatttttaatttaccaggagtggtggtgtgcacctgtatcctagctactcaggaagctgaagcaagatgattgcttgaggccaggagttggaggctgcagtaagctatgatcgtgccactgcactccagcctggcgacagagcaagatcctgtttcaaacaacaaagacaaaacaaaactgcaatcacaagaccattgtcttaaaacaaactttacatttgggaataattttagatttatagaaaaattgccaagataatagagtgtttctacatacacctcatctagcccctcctgttgttaccatcttacattactgtgatttgtcaccattcactaaatcacagactctattcagattttaccctttttttcattaatgccgtttttgctgttccgtgatccaaccccaaatattatattgcatttagcactatgtcattttcacatctacccaaaatggctgttatttccttaagactcactgaacagccagtcgttatccccatttccctgattggctgatgtatcttataagactcttggaatcttgaacagttttgcctccttcttttgtttgcttgccatttatttgtggaagaaactggatcatttgtcctggaggctgttccacactttggattctgctgattgcgtgcctcatggtgttgatttagtgtgctcctctctcccctgtatttcctgtgaacggggggctagatctagacctggggttggtgaacttttctgtaaaaatctggataatgcgtcttctaggtattgcagttcatatggtttcaactctgcctttgcagtgtgaaagcaaggcacagacaatacttaaataaatgagtgtggctgtgtcccagtgaaaccttatttacaagatcaggcagtaggctagatttgactagggggccatagtttggtgatccctgatctagaggatgaatcagattcagtttcaatgtttctgttttatgcttggttgtgtttgcaaggataattctttgatgatgactggtacatcttgcttcattgggtggcacatcacgtctggctgcctctcatttagtgatgttgaatttgacaagggttcagatgtcaccagcttgatccatccatcatgaagcactccatcagtgagttgtatttcagctctcctctctctcatgtggccaggagcacttgtgcagtgcacgccttgagcaaccatacatggagtcccctccccagccttttttattggctcttgacttctctgttttcaaacagtatgtagaacagttgccctacaggtccttagagtgctacaaactctgccactcagtcaagcaaaacaacctccgggggatttcctgaggacacacagattctggattcatctggatcagaggttgtatataggccacagaaattctcattttctaaaaatttaatccttgccaacatttaaaatctggaaggtttcttataaaaatatggttttccacttctcttgaaaaataagagaagctagccactttggacccacattcaggggtagcaataaggagctggagctgagagtaactcagctttagatgagatgagaattcaacatcaggcagacaatagggagtggtggggactcaagaaaactgcaaggcacgtgccctgtcaataattagatgagcggctgggtgtggtggctcacacctgtaatcccagcactttgggaggccgaggcaggtggatcatttgaggtcaggagttcgagaccagcctggccaacatggtgaaacctcatctctactaaaaatacaaaaattagctgggcatggtggcacgcgcctgtagttccagctacttgggaggctgaggcaggagaagaatcgcttgaacctgggagacaaaggttgcagtgagccgagatcatgccactgcactccagccaaggcgacaagagtgagaaaaaaaaaaaaagacgaatgatgcttttctcaagtacccgtaagcttctctggcaatttcaaaattaaatgctaatgtttcagtagttaatccttttacatctcctaccattccccaatctgccccatccccctccccactttcatctccttcccctgaaacatttattgctttcttgtatgtcttcccagagttagttcatgcaaacacatgaaatgtgcgcaaatgtaaaatatttattttactttcccctctcttcttacataagggagcgtatactctacatgcagttcagcatcttgctttttttcacctaacaatatgttcttggagatctttccagattagtttggcagaagcttccttattttcagagaggcaatattacaactgtgtggtcgagagtgcagagacagctgaggaagacagagaaactgaggctccctcttccatcccacccaccattatcttcctgggaacctgtgtgtgagcagaaggtgaccctacagcatcctatggcccgacccactgtcatttatcatccttgtgcatcaaacagcttttttttttttttttcttttttggagacagagtctccctctgtcgcccagggtggaatgcagtgttgccatctcggctcactgtaacctccacctcctgagttcaagcgatcctcctgcctcagcctcccgagtagctgggactacaggcacacaccacccaccctcctcagctaatttttgtacttttggtagagacaaggtttcgccatgttggtcaggctggtctcgaacttctgaccccaagcaatttgcctgccttggcctcccaaagtgctgagattacaggtatgagtcaccacgcctggcccaaacagctctcttgggcttcttccttttatagctacatcattgtgcctgcttccagcccctcaagggaccagctcccctcactgacctgatttgctgcttccaggctgtgtgatcttgggcaagtcactgatcctctctgtgcttcagtgtcttcacctataacatagaaaagtggttagagtgcacctgctatggttattatgaattattacatataacacatttagaatcatgctaggcatgaatgaagtaagtgatgtgtctaggctatgattattatttttatgtagtggtccataatttattaaaccagcctctattgatagattcatgggttgtttgcaatatcctgccattacatacagtctaataatgagtaactttgtacatatgccctcctttcctttcctttcctttcctttcctttcctttcctttcctttcctttcctttcctttcctttcatttcctttcctttcctttccttttgagacaggatctcactctgtcacttaggcaggagtgtggtgatgcaatcatagcttactaaaaccttggcctcctgggctcaggtgatcctcctgcctcagcctcccaagtagctgggactaccaatgcaaaatttgttttttgtagagatggggtcttgctatgttgcccaagctggtctcaaactctgggtctcaagaaatcctcccacctcagcctcccaaagtgctgaaatcacaggtatgggccacacatatgtcactttttaaaacatgtcagttgctgggtgtggtggctcatgcccgtaatcccagctactcgggaggctgagtaatagcaagactccgtctctaaaaaaaattctttttaaattagctggcaggcacctgtagtcctagctcctcgggaggctaaggtgggcagatcaccttgagcccaggggttcaaggctgcagtgagccatgatcgtgccactgcactccagcctgggcaacaaagcaaggctgcctcaaaaatgaattaaaaaaaatagataaaaacatatcagggtatcatagacaatgggataaatttggagaaactggattgctgggtcaaagggtaaagatatgggtaatcttggtgaattttgccaaatgatcctccatggagattgtaccagtttccactcccatcagcgatacaggtgattgtctggtgcccctcggccctgccagcagcgtgtgttatcatgcttttgcccataaggtaggtgaaaaatggcatctcaatacaattttaattggtcttctcttattatgagtgaaaatggtccccttgtcatctgtttaagggccattttgtatttccttgggacctggggaaagtgattactgaagcaaaggcaggacatgcataataggttgataagtctatttttaaatcccagctatcattgccagtcaacacattccgaggatcatttggcttgatttttggcatggaattggcattctcacttgtttaattttaattttaagtgcctggggtcttggatcaaatgccacccctttagagcatgtggtgtgtgtcatcttctggtgccacctggtttatttgtatgttttctattgtctttgcttccttgccattatctactcactcccaaagagaattcaaggtccacaaaagcaaagatgagcaagaatgtagtctcatggaacttctggttttagggttgtccagatgatagttatctttggtttcttttggagtcacagattcacactcagcatcttgaagaaatttattcagccatccgttcttccattcatccttccatcaatcattcactcatttatccatccattcattcatccattcactcatttacccatccatccattcatcaaatcatctatcccaatcattcatccattaaatcatccattcactcatccatccatccatccatcaaatcatctatccatccatcaaatcatctgtccatccatccatttttaaaatttattcaacaatattttagtaagcacctactatatgtcatgccccatgcttgaccctgaaatcacaataatgaacaatgcagatgttggcgctgctggtcagcttaccagtctagcaggtaaatgcagtgctctaaatgcaggacatggtttataatcacagagtcgaatgccatttaacaaactcaaagaaggcttcttggataaaggagcatttaagctgaaacctagagaatgagtagaagtttagctgggaaagaagaagaggagtgttttggctgtgggagcagtatctcaaaggtccaaaggcaggaaaagaatatggtgcatttaaagaattgaaaggagtccaagtcagttagaatatagagtctgagagggaagaggctggggttggggcaggggccagatcacacaggacctctgggccacattaacagaattggaatttatcctaagagatgatggtggcctggaatttgatggaagcaatggtgatgaaagtggatggatttgagaggtatctggatgtagaatcaatacatcttggtgactgatagaatagtgggatgagggagagggaggagtcaaaagtaactcccagctctctgccttagtaactgggttaacagcttgtgtgcttggtttgcctagtggctggacagcagtatctccaaggccaaagtcatgggtatgaggcttccaaagagtttttaatctgtcctgcagcagcaaacagcatctctgtccattttggttgaaacacacattgtctgcagtgcccctttggcattccaggtggagatgagtgcaagggcaaagagacagaggcaagaaacagcttggagaggacaatggcagagatgggaggtggtgaagatgctggatggatggtctgagccttgaaggagtatgaattctttctcaaaggcaggaaaataaaggtttagaagcagaattggagggaatgtaaactcttctcaaaatctacacacactgttatggaaagggtgtattatacaggataagggatttagctgctgtgacagctaagccctgaactctcagtggctgaacacagtgagcgtttccttcttgctcactctactgtccaagatggatggtgtattagataggataagggatattagctgctataacaaataaaccctgaattctcagaggttgaacatggtgaaagtgtccttcttgttcactcaactatccgagatagatgttttctcccagtaggcttttctctttttaaaaaattttttgtaggtacatagtatatatatatatattatatatatatattatatatatgtatatatatatattatatatatgtgtgtatatatatattatatatgtgtgtatacattatatatatatgtgtatatatatatgatatatgggatattttgatacaggcatgcaatgtgtaataattacatatggaaaaatgaggtatctttcacctcaagcatttatcctttgtgttacaatccaattatgctcttttagttatttttaaatatacaaataaattatcattgactatagtcaccctgttgtactatcaaatactacatcttattcattcttttctatttttttgtacttattaaacattcctcctccacccccatccactccccttcttagcttctggtaaccatcattctactctctatctccatgagtgcaattgttttaatttttaactcccacaaataagtgagaacatgcgaagtttgtctttctgtccctggcttattttccttaacataatgacttccggttccatccatgttgttgcaaatgacaggatctcattcttttttatggctgagcagtactccactgtgtatatgtaccatattttctttatccattcatctgttgatggacacttgagttgtttccaaattttggctattgtgaatagtgctgcaataaacatgggagtgcagatatctcttcgatatactattttctttcttttgggtatatacccagcggcaggattgctggatcatatggtggctctatttttagttttttgaggaacctccaaacttctccataatggttgtacttcctgggagactcttctccaggcagtgacgcagggattcagggtcctcccatcttgtggctttgccattgtctaggaagggcctctgctttcccctaattgcttctgaatttgtacacagagaattatgctggacattttgtatgggttaggcttagaagtggttcacatcacttttacctaaatgccattagccagaatgtagtcccagggcccaacgaacttcagtgagagctggaatatgtccctttgctgtacgtatcccaggaaggaaaagaaaatgggatttgccagatccatagcattatctctgctacaaatgggaccagagagggtggttggataaacgaacacctatgtccacaatgtaccaaaactggagggaaaagcacaggtacgaagggtttgcttttggtgctgaagggtcaggaacattccctgggaagatggatagggctttagagttaaaagccttgttatttcattctgccgagatcccatttaacatcagaaactcctttagaaatatctttttttaagaaaaagcatatccactttccctcctaatctcagggtctcttcgctttgccacaaccttcagattctgtttttctccaatgcatgatttctaggctgctttttctttcaatttctccctaagtccttggtcctttcttcagtacgattggttatttttcttgccagctccaggcaagagagagaggttgagcagttgtatactaattactgggctattactgttattattcagctgtggaaaagagaattcagagagtcccaaatataattcacctcattgacatctctctctgtctctgtctctccttgtttctgtcccctcctccccacattctctctttccctctctctccatctctttgtttctttttctttctctgtatccctttacctctattcatgcatctgtctctctccccaatacctctgagtatatatttttctagcatcatatgcctttctttcattacccacatcaacattctaattcgctcttattgattttctcatttagttagtataaagataaggactggccgctcacggtggctcatgcctgtaatcccagcactttgggatgccgaggccggcagatcgcttgagctcaggagttcgagacccacctgggcaacatagtgagacccccatctctacaaaaattagccaggcatggtggtgcatgcctgtaatcccagaactttgggaggctgaggcaggtggatcatctgaggtcaggagtttgagaccagcctggctaacatggtgaaaccctgtctctacaaaaaatacaaaaattagccgggcatgatggtacacagctgtagtcccagctactttggaggctgaggcatgaggatcacttgaacccaggaggcggaggttgcagtgagctgagatagtgccactgcactccagcctgggcaacagagcaagacgctgtctcaaaaaaaaaaaaaagataaagactatgtccagttttgcctctaatgcatccttagcatggatcaggggctcaaagatatttattaatgagtccacacacagttgttaatacctaactgttaacatctctttcttacattttttttcttattcttgtgactaatttctgcctcacctccttcaggtctctgctcacagtcaccttctcgacctcagctatgtaaaattgaaactactgcacccccattcactttttcctgccccgttccttctttccttcctttgttcattttttccttccttcctcccatccttccctcctttcacctctctctttccttccttccttttctttcttttttctctttcttttccttccctttctcccctccttttctccctccctcctcccttactttttctttctttccttctcttccttccttttctttctttcttctttttcttccctctctcccttcctccttccctttctctctccctccctcccttctttccttcttccctccctccctccatcccatactgtcattttaatgcctatagaagggtcttttccttataacctactgttgggtatattttgacattatacataatgctacaatcaaatctttacatacattttcccttcactgggattcatttctttgtattagatttccaggagtagttttactgagtcaaaaatgagtactattttaatggtttcttatatatatggtttttccaaagggttgtatcaatttacacatttaacagcaacgctgaagtctattcatttcaatgcacacagaccagcattgggttttattgttttaaaaacattttttgggccaggcacagtggctcatgcctgtgatctcacactttgggaggccaaggtgggaaaattgcctgagcccaggagttgaagaccaatgtggggaaactccatatctactaaaaatacaaaaattagccagacgtggtggcacgcacctgtagtcccagcttctatggaggctgagatgggacgattgcttgagcctgggaagttgaggctgcagttagccgtgagtgcaccactacactccaccctgggcaatagagcaagaccctgtctcaaaaatatatatatattttttgttaatttaatagacaaaaatggcatcaccttattatttttattctggtttatttaatgggaagtgaagttagttattctataaatattcattgagcaacttctccatggcagaacctgtgctgggtccggggtactagtgagtaaagcggatatgtgttctgtgcccttgaacttaccacctggtggggagtgtctctcagagtctacagaggaaacagagttcactctccagcccccagatatttcaaaggaagaggcattaaggaggagctttgctgggtgtggtggctcatgcttgtgatcccagcactttgggaggctgaggtgggtggatcacttgagcccaggagtttgagaccagcctgggcaacatagtgagaccccatctctacaaaaaaatcaaaaattagccaggcgtggtggcatatgcctgtagtcccagctactcggcggggctgaggcaggaggatcacctgagtctggaaggttaaggatgtagtgtgctgtgatcatgtcaatgcactccagcctgggcaacagagagagaacctgtctcaaaataaataaataaatatatatataaaaagaaagaaagaaagaaaagaaaaggaaggacttccttacagaggtgtggacagagttaacccatgtgggatgttgggcacccagaggctagcaatagcaggaagcccctacaatccttggattgaagaaattgcaacattggagccagtggcagctggaacgatgagggaggagctgctggcagtagctgtcatcacggaagggatcagccactgccagagatgtggcacccaagcagagagcgaataggggaagaagatgcccttcctgggcctgctgcgttttaaattataaaagtcatgctaccttactcattcatgaattcatctgacatttcttgagggcttatgaagctaaataaaattggtttctgcactcatgaagtcttcctttttactgttacttttattatttgtttatcccttgagacagggtctcgtgctgttgcccaggataaagtgtcgtgacatgatcatagctcactgcagcttcaacctcctgggctcaattgatcctcccacctcagcctcctgagaagctgggactacaggtgtgtgccaccaaacccagctaatttttgtgtttttagtagaggcagggtctcgctgtgttgcccagctggtctcaaattcctggcctcaagtgttcctcctgccttggcctcccaaagtgctgagattccaggtgtgagccactgcacccagcctcaagaagtcttatgtggagaaacaggctaataaaaagacaactttttcagaacatacatgtgcatcagtcgaaaattttatttggttgcatataaaataaaaatgctgcagtggcccaaggatgttcagccaagaccaaggtcagcttggtcttttcctcatggtcagtctcaggatggctgctgctgctccagccatcacatcagtgcttcagacagaaaggaggaagaaggtcaaaggacaaaggtcagttgagatcagcatccttatggttgattggccagaactgttcatgtggccacatctctctgcaaaagtgcccaggaaatgtagttctgttttattgctgggttctgaaagctagggaagttatgaggggataatgggtgggtgggtaacaggtggtctccgaaacactctatctcaagcatccagtgcagtgcctgcaacatagtagaagcttaataattgtttgttgcatgagtaaataaacaatagactacagcagggcagtttgtatgatcaaggtggccgcaaacaacaatggaagcagagacacagattctaatccatccagcattggtgagggttaggcagcaaagagagaaagaagagtggaactgcccgtagttccactacggcagctagttagtggagctagttaggtgtaatcatctcctagcttgagaagtcctcatctagtcttgccaaacatcctatcccccacgattattttgttttctcacttcacgtctttctatagctctgttatgtttatctttgtgttcagacaatcctgggtcttacagaagggtagatgaaggcatggtaatgttagattaaacagattctcacatgaggaagggactttgccattctccgtctactccctgatggcattttattggctttgagagctgtagaagcttatttggggatttttttctggcaaaattcccagagagcagggtttatctaaactggctaatatgcagcatttgcgaataattattaatagatgtttgcattttcattctttatgaatactgctgtggggtgattctataattcaagggggaagtggtgagtgaattgttatcttcccccaacactacccccaccctcccacttccccgccccagttttcttcccctcagctgatagcagagctgtgtcctcagactgctcatgtcaaaatccctgagacattcttgactcctctcctccaggcatcctccacttccaatccataagccacacctgtctgctttaccatctcaacataaccagaattaactcaccgtggtacccacctggtcacggccccccacctaacccagtgtggtttcctcttcctccccctcccagcttctgctttctttcccatctgctctcgtggccagagggcacctgtgaacacctgagccaggtaacgcccctcctctgctcagaatcttccacagctcctccctcactcacgataggagccaaagtcccccctgtggtccacaagaccctgcatgatctgcacccatctacttctcggtgcacacaaagcacattcctgccccagagccttcgcatagctgttccctcgtgctagaatgctcttcccacggatttttgatggtatccttcctcgccgccttcaagtgtctgcttgaattttatcttaccaaggaagcttccctgatcatcctctctggatcccgctgaagcggtgttgttgtctggggtaaatctgcgaagttcgtcctctcacaccaaggaaatcgaggacacggacacaagaagtgggtttaggagtagaggtttaataggcaaaagaaagagaaaggagaataactctctctcttgtgtgagaggggcttccgaatgggacttcccacccatggcagagtgcaccagtttatagacaggcttgagggggcggtgtctgatttgcatagggcccaaggattggttggaccaggtgtgatgtttacatagcacatggggaagctggatggctcgccctaatcttatgcaaatgggatctttgcctcgctggtgccatgttatctgctccttactgtacacgtggctgacaaagagaagggaagatgaggccgccattttgaacatgcctagtcccaggtagccttttcctattggcacagctgccggcattcacctggcaagtttccagcctgcttgtctatgtctgcagctcaattttacaggctgctctttgttagaaaagaaataatttgggggctgcttttcatgaaaaggaaaaccttattgaggacgctcataccctatctgcctaaataatttcttcttagctcttgtatcaccaccctacatttctataatacatcatgtctaacatattgaacaattatttgtttgttgtctatttttctgaatttgactgtctgttccatgagggcaactattggaggtcatctcattctgggctgtatcccaggtgcctagaacagcgcctggcccacagtggtgtttaacaaatatacgtaatctgtgaggagtagaaatatctctccaaatgtttctgatggcagggtacatttctacagccagtttggaaagacactgagaaatatgtatcaagagccatacaaatgttgcaatttcgcatctaatccagtaattccacacgtgggataaaatcctcacagctaaacgcacaaagacatatcattacttatttccttattgcttttaaaagcatctcatcagaaacattattaaaagttcattaaaaaaggaataagtaaataaattaaatgaatgtagccatcaaagataatggtggttataatatgattttaagtaagaaagtgctagaggaaacctattcatttcagagtactaagtactggaaaaagctgcttaaactgaatccactgaatacaggaatccaaatttcacagggagcaccgggtgtgggggtgaggagagagaggcaattgggactttgtcctgtaaaatgaagccacactttctaagcctcagttaattttttaaattgtgttcaacaaagtttaaatagtaattccaaacatgatcagcttcttagaattaacaaagaatcaaaagttgatacagtcagccctatacactgaatccacaggttcaaccaaccatgggttcaacaagttgcagatgtaaaatgtaattaggcctgcgatggttgtgcctgtactgaacatgtacagacttttttcttgtcattattccctaagcaatacaacaactgtttacatagcatttacatgatcttgggtattataattaatctagagatgacttaaagcatactgggctaggcgcagtggctcatgcctttaatcctagcactttgggaggctgagacaggaggattgcttgaggccaggagtttaagacttgcctgggcaacatagtaagattatctctacaaaaaatatataaatatatgtgtatatatatatttctacaaaatatatatgtgtatatatatatttctacaaaatatatatatgtgtatatatatatttctacaaaatatatatatgtgtatatatatatttctacaaaatatatatatgtgtatatatatatttctacaaaatatatatatgtgtatatatatatttctacaaaatatatatatgtgtatatatatatttctacaaaatatatatatgtgtatatatatatttctacaaaatatatatatgtgtatatatatatttctacaaaatatatatatgtgtatatatatatttctacaaaatatatatatgtgtatatatatatttctacaaaatatatatatgtgtatatatatatttctacaaaatatatatatgtgtatatatatatttctacaaaatatatatatgtgtatatatatatttctacaaaatatatatatgtgtatatatatatttttttttaattagctgagcatggtagtgtacacctttagtcccagctactggggaggctgaggtgggaggatcacttgagcctgggaggtcgaggctgcagtgagccgagatggtgccactgcactccagcctgggcgacagagtgagaccctgtctcaaaaaataaatgaataattaattaattaaagtgtgctggaggatgtgcacaggctatatgcaaacacggtgccatcttctatcagggacttgagcatctgtagattttgttatccgttgggggttcctagaaccaatccctcatggatacttagggatgactgtattcaagcgtgccttatttcccaacaaaattatatggtagaacaacagaacccctttcatttcatctttgacttcagtggtgtaatttttttccccaacttttaagttccagggtacatgtgcaggtttgttacataggtaaacatgtgccatggtggtttgctgcacagatcataccatcacctagatattaagcccagcatccattagctcttcttcctgatgctctccctcccaccccccaccttcaaaaaggccccagtgtgtgttgttcccctctatgtgtccatgtgttctcatcattcagctcccgcttttaagtgagaacatgcggtatttggttttctgttcctgtgttagtttgctgaggataatggcttccagctccatccacatccctgcaaaggacatgatcttgttcctttctatggttgcatagtattccatggtatatatgtaccacattttctttatccagtctgtcattgatgggcatttaggttggttccatgtctttgcaattgtgaatattgctgcaataaacatacacatgcatgtgtctttacaatagaataatttatattcctttgggcatgtacccggtaatgggagaaaaaggaatgcttttacacttttggtgggaatgtaaattagttcaactattgtggaagacagtgtggtgattcctcaaaaacctaaaggcagttatgtaatcttgaactttgttgggaatcattttgtgggccaaaacaaggtgcctcagagggctttttaaaccatttgatcatccattcattccatttatttatttatttatttatttgagacagagtctcgctcccccgcccaggctggagtgcagtagcgtgatctcagctcactgcaacctctgcctcccaggttccagcgattctcctgcctcagcctcccgagtagctgggattacaggcacctgccaccatgcctggctacttttcttgcattgttagtagagacggggtttcgccatgttggccaggctggtcttgaacttctgacctcaggtgatctgcccgcctcagcctcccaaagtgctaggattacaggcataagccaccgctcccagcccattcattttatttcaaagtgttcatcactatcatccacctgtcatctccttttctgttgttaaccagtctcactgcaagttcctcacttaacaatgttattctctgcattgcaagtagctctccaacatcactttcattgacttcatgaaatcctgctgccccttgcaaagattttcaatgttcactctgcagttgtttcacatagttttgaattgtgtcattgagtttcaagcaaccatcaacaatcagagataaacagtgacaaacacactgatctgatggcttccaaagcaatatttgtattactccgaaatggatggttgagggggataattgtcaagttgtcagttcattagtgacaatttttatgttaggatgacttttgcttccctaaacacataatggtgtaaatacttggataatgagccgtatagtgactactcagatgatggaaaactattgtatataaaatctttaaattataattacatgtgtatgaaaaataaaaacctagagggggagaaccagacagaaatacaataaaatacccagtatttgtattggagaagtcatgggagagtggctttaaaatattgtgctttttctttttttgagactgtctcactctgtcgcccaggctggagtggcgcgatctcggctcactgcaacctccacctcttgagttcaagtgattctcatgcctcagtctcccgagtagctgggattataggtgtgcgccaccacgcctgctaatttttgtatttttagtagagacggggttttactatgttggccaggctagtctcgaattcctgactcaggtgatctgcccacctcagcctcccaaagtgctgggattatgggcatgagccacggtgcccagcctaaaatattttaaaataaaaattactttacttttgcaaaaatttttaaaacaaatgaaagaaatttgatttatggctggatgcagtggttcacactttagtcctagtgctttgggaagctgaggcttgaacccaggaattcaaggctgcagtgagctatgatcgtaccactgcactccagcctgggtgacaaagtgagaccctatctcttaaaaaaataaaaacaaggaaatttaaagaaaactttcagactcactgtttgtttgtttgtttgtttgagatggagtcttgctctgtcacccaggctgaagtacagtggtacgatcataactcactgcaacctcaacctcctgggctcaagcaatcctcccaccttagcctccaaagtatgaggccacaggcatgtgccaccatgcctggctatttttttgggtggggtcttgctatgttgcccaggctggttttgaactcctaggcacaagcaatcctcctgccttggcctctcagatctctgagtttacagatgagagccaccacactggccacaattgttacattcagtgggagctaatgcactaaaatgtccaaaggacacgattgcttttcacatggttttgatataccaggagccctctcagactcatgtgggaggaggggagtcactttggtgataatacgtgactgtaagttggaggcagtgaaaattaccaacaccgccacccaggctgtgagcctatctaacatgactttaatccacacaatcaccaatcacaagaacactgcactttccctgttttactaaggagcacgctgaggccagagaggttgagcagcttgcccaaggtcatacaactccaacatatgccgtgccgccttgtaacacatctttaagcccagttaaatctctttcccctgattctggtcccccaaggtgacttggttttttcttgatttgggaacaaataacacttttactcgtagagtaacttggacagaatttatttttatgcagtattgttttcctctcaataactgcatttattttcgtgtattggaggattataccacattcttcagtagaattttaaaattcttttcataagggttcttcccactccataagtttattttcaatacagtactttatcctggtttgcttttgtaaatgagatttccccccgttttattcactgagtggtcatcatatatagttagcattattattattttattatttttgagatggagtcttgccctgtggcccaggctggagtccagtggcgcaatctcgactcactgcaacctccatctcctgggttcaagcaattctccagcctctgcctccagagtagctaggattacaggcacgcacaaccacaactggctaattttttttgcatttttagtagagatggggtttcaccatgttggccaggctggtcctgaactcctgacctcaggtgatctgcccacctcggcctcccaaagtgctgggactacaggtgtgagccactgtgcccggccaagtttattttcaatacagtactttatcttggtttgcttttgtaaatgagacttttttccccattttattcagtaagtggtcatcatatatagttattattattattattatttttgagacagagtctcactctgtcacccaggctggagtgcaatggtgcgatctcggctcactgcaacctccacctcttgggttcaagctgttctcctgcctcaccatcccaagtagctgggattacaggcatgcaccaccatgcccagctaatttttgtatttttagtagagacggggttttgccatattggtcaggcctgtctcgaatgcctgacctcaggtgatccgcccgccttggcctcccaaagtgctgggattacaggcatgagccaccgtgcccgggcagcattaatttttataataattttttggttttttttttgagacaaggtcttgccctgttggccaggctggaatgcagtgtcatcatcgtagctcactgcagcctcatcctcctgcctcagcctcctgcgtagctggactacaggtgtgcaccactatgcccttgtaatataattttttttttttttagaaacaggatctctgctatgttgactaggctggtcttgaactcctggtctcaagcaattctcccaccttggcctcccaaagcgctgggattacaaggatgagccactgtgcccgatccaatttttatattaattttataactagccaccttatggaattatctcattgtttctaatatttttatttaacttcctatgttttataattagatcatcatttaatatgcaaatagtattaatctctatatttgttcctcttaatttccttttttctatggatacataataattgtacatatttatggaaggcatgtgatattttgacacgtgtccaaggaacacacaatcctctgaggcatgctcttaaatgagtgcctcaggtgagagttgagtgatttctgtcggcatgggatgaaagctttttccacaacaaaagacacagacgacgccaaggaagggaaggcaagagacacagaagcgagatttaatggtctgccaagtcaacctattaagctctctgtgggacaacatgcatttgaacagtctgaacacaaatgcgttcatgtttttctccacatgtaattcttaggtgaaatttttactcccaccaataagtgatgctggggtctctttttctattacctttatttgattgtgtctccagtgggtctttttttttttttttttttttttgagacggagtcacactctgtcatccaggctggagtgcaatggcaagatctcggctcatcgcaaccttcacctcctgggttcaaatgattctcctgcctcagtctcttgagtagctgggactacaggtgcgtgccactacacctagctgtaatttttgtatttttagtatagatggggtttcactatgttggccaggctggtctcaaactcctgacctcatgatccacccgccttggcctcccaaagtgttgggattacaggcgtgagccaccgcgcctggcctccagtgggtctttttctgtttttgccttctctgtttctggagcaccaggtgctttcctggacacgagaagcaatttctttttttttttttaacttttaattgtattattattattttttattttaccgtaagttccaggatacatgtgcagaatgtgccggtttgttacataggtgtacttgtgccatggtggtttgctgcacccatcaacccatcatctaggttttaagccccgcatgcgctaggtatttgtcctaatgctctccctccccttccccaccactgcctgacaggccccagtgtgtgatgttgccttccctgtgtccatgtgttctcattattcagctcccatttatgagtgagaacatgtgatgtttcgttttctattcctgtgttagtttgctgagaatgatggcttccagtttcatccatggccctgcaaaggacatgatctcattcttttttatggctgtatagtattccatggtgtgtatgtgccacattttatttatctagtctatcattgatgggcatttgggttggttccaagtctttgctattgtaaatagtgctgcaaaaaacatatgtgtgcatgtgtctttatagtaaaatgatttataatcctttgggtatatagccagtaatgggattgctgcggcaaatgatagttctggttctagatccttgaggaatcgtcacagtcttccacaatggttgagctaatttacactcccatcaacggtgtaaaagcgttactatttctccacagcctcgccagcatctattgtttcctgattttttaataattgccattctggctggcgtgagatggtatctcactgtggttttgatttgcattgtaagaggcaatttcaactgcactcagtaaagaggattgccaatgaagtcagtgtttattttccactaccctgtgcttggcctgtcacatatagagggagggcattgttccatcctttcgtgatcccatggggtgtgtcctgtcctcatcctcattttgcaggtgaggaaactgaggctcaaagaggtgaaatgatagttcaaactcacataagtagaacccagcatggatgttagcatggtattattattctttgttgctgttgcattgtttctagatgaggaaaccatttctaaggggtcatggagctcagaagtgcagggctggggtagccatccaggcaagcactctccaacagaaatacaacaagggatcagggtgctgtggctcatgcctataatcccagctctttgggaggctgagacgggaggattgcttgaggccaggaattcaaggctgcagtgagctatgatcgtgccactgtgttccagcctgagcaacagtgaaaccctgtctctaaagaaaaaagaaaaaagaagccaagcacggtggctcatgtctgtaatcccagcactttggtaggccaaggtagggggtggatcacttgaggccaggagttcaagaccagcctggccaacatggtgaaacaccaactctactaaaaatacaaaacttagccaggtgtggtggcaggtgcctgtaaccccagctactcgggaggctgaggcaggagaattgcttgaacctgggaggcagtggttgcaatgagccgagagcatactgccgcactccagcctgggtgacagagcaagactccatctcaaacaaacaaacaaaaagaagtgcagggcttggtagtcatccgataagcactgtccaacagaaatacaacaaggggtcagggtgctgtggttcatccctgtaatcccaagtctttgggaggctgaggtgggaggatttcttgaggccaggaattcaaagctgcagtgagctatgattgtgccgttgtgttccagcctgggcaacaaagtgagaccctgtctctaaaaaaaaaaaaacaagaaagaaaagaaaacaaaagaaatacaaggatcacatatgtaatgttaaattttcaggtagcctcgttagaaatggtaataagaaacaggtgaagctagttttaataatatatttttaacccaatatattgaaaatgttacttccacatgagatgaacatataaactattgagatatttcagacttttaaaaacattaagtcttcaggttgggcacagtggctcatgtctgtaatcctagcactttgggaggccaagacaggcagattgcttgagttcaggagttccagaccagcctggacaacatgacaaaaccccatctctacaaaaagttagctgggcatagtggtatgcacctgtagtcccagctacgagggaggctgaggcaggaggatctcctaaatccaggaggtcaaggctgcagtgtgccatgatcacgccactgcactccagcctgggcgacagagtgagaacctgtctcaacaaacaaacaaacagaaacaaaaatcttcaatatctggtgtgtattttatgctttactgatctcaattcagatgagtcacatttcaagcactcagtggccacatgtggcttatggctaggttttggatagtgtgtgtgggtctaaatctttgacgagtatttctggtattttttggtgacacaataaggctcaggtagtaaacatatcgggggtacctgatatatgcttgttttgtcatacaaaaccctttgcttttggtctggatatttgacccctccaaatctcatgttgaaatttaattctcaatgttggagatggggtctagtgggaggtgtttgggttatgggggcagatcactcatgaagggcttggtattttcctctcagtaatgagtaagttcttgctctattaattcccccaagagctggttgttcaaaagactctggcacttctctctgctctctcttgcttcctctgtcatcatgtggtctctgtacatgccagctccctttcaccttctaccatgatggaagcagcctgaggccctcaccagaggcagatgcctgtaccaactttcttgtacagcctgcaggactgttgaccaaacaaacctcttttctttataaattgcccagcctcaggtattcctttatagcaacactaatggactaagacacctttcatactcttttttgatgaaggaaggaaggagaaaggaaggaaggaaggaagggaggaaggaaggaaggaaaaaaggaagtccttcctaaaaatatttcccccaatatggaaaaaaaacctttgtatgtaacaccattaagtattgccccagcagaagcagccccatgtcttgagctggaaggaaggaaggaaagagagagaaagaaaggagaatgagaggaagaaacaagaggaagaaatggaaggaaggaaggaaggaaggaaaatgaaaggaaggaagttcagtggaggatccaggaaaactgccctgaatgccctgaagttccttccttctgcctaaatattttgaagtagctaacagaatctgtccaactccattgtcttagtttgaatcccgccccccaactcccaagaagcagatccagaagcagagatttgaatgcttctggaggagatcccaaaacacactggcagaaaagtaggaaagggaagacccagtgataagtgagtcatcaggcaagttaccaccatgagcaactgggtctcaattaccagtggggacctctgggaggcagcagagagcacattcctcagcgttgttgcatgctagtggtgagggagctggggtattgatccatcaactcccatccatcataagttaaaggatgggagtattaattctctaacaccacagactgctgagtggacactttgatagccagagaaaatgccctgggggctggcagggggaagtcagacctgcatgcactcaagtggtcagggcatggctggacagtgtttgctgcaccagtgtagtacctacttccttataattcaaaaagtttactttttgtaccacaagcccttgtgaactttatgtccattaactttgtgacagtctggctgccatatgggacatgagatgatttagttgttatttcagtgacggaaaaggcagaacagctatggaaggagatcacagatgtatgcatatatttatgtgtaaccttgcaaacatgtgcgtgtgctcccattcttgttgtcaccaagcctaactctcttaccacattctctgttgtcttccccggatacatacaagctcttttttagtcgttgggcaaaacagaagaaaataaaaggaccaagtctccattttctggggaaatcatgctattctccttctaaggaggcatcagaatcaaatgccccctacctgtgtccccagcttcattctctctctctccccattggaaaataatttgtattggtttctggctaatcttttgtttcttcttgagaatatgagcaaaatggtttttctttttttcatgtatttctgtctctttctttcataaagatagctcaacacctgcacttctctgcaacttgcccttttcacttctggaggtgttgggtttctattttgacctctcttcatggctgaggctgaggcagtgaacaagacagacaggagctttgaggtcctataactcgaaacattttaagagccccaatgtgcctttacaagaggaaacatctttgaggcaagtttcataaaatcaacgtattaaccatgtctttttgctcgtttgtttgttttttgagatgtagtctcactctcacccaggctggagtgcagtggcatgatctcagctcactgcaagctctgcctcccaggttcaagagattctcctgcctcagcctcccaagtagctgggaccacaggcacccgccatcacaccaggctaatttttgtattttttgtacagacagagtttcaccatgttggccaggctggtctcgaactcctgaccttgagtgatccacccacccccctccacctcccaaagtgctggaattacaggcatgagccactgtacccggtcttaaccatgtatttctgattctctgatatgtggggctttgctgaccctacaaggatgccccctcccagagctagacaatttctagatagtaaagagccttttacatgcaaaccaaccaatccagatctacacccccaaccatctcctttcttgggctctcacatgctgggacactattcccctgctctaatgatctcagagccaggtaccaaacaacgaggggcaactcccatgccccgaagccctcaccctgcctggctcattccttcccatggaaaccacaataaaggctcttgcccacatgttttctttattccctcggtccctggcccagccctggtgcttccctgtgtggccctgcatagcatgggcgtgccccttcttcttggacctgtgagtaacaaactgtcttttcaatggcagtcatcccctgatctagtggccttgccatacctgaataataataaaactgggctgggtgcagcggctcatgcctgtaatcccagcaatttgggaagctgaagtgggaagattgcttgagaccaggagttcaagaccagccctggcaacataacaagatccctatttctacaaaagaaacccggaaaaattagccaggcatggtggcacacgcctgtagtcccagcaattcaggaggctgaggtgtgaggtttgcttgagcccagggggttgaggctgcagtgaatctcccccatgatcatgccatggcatccagcctgggcaatagagcaaaaacctgtctcaaaaagataacaataataataaaacctacattttaaaacaataaaggcccaacatggaatgccagccccataatccccatcacctccctgccctcatgtcctattctctccactccagccacacaagcctccttaatgttcttcaagcatgccaggcatcttccatctaggcctctgcctatgctgttccctgtgcctgcgatgctcttccttcagatagcagcacgtcttttcctgccttcatgtctctgctcaaatatcaccttcttagagcagtcttttgcaaaatagctcccactctgacccttacctgcttctttctttctttctttttctttttttctttctttctttctctcttttcttttctctttctttctttttcttttttctttttctttctttcttctttctttctctcttccctccctccctcccttcctttcttccttccttctctctctccctttccttccttccttccctctctctccttccttcctttattccttccttctctccctttccttccttccttccccctctctccttccttccttccttccttccctctctctccttccttccttcctttcttctttcaacagggtcttgctctgtcacccaggctggagtgcaatggtgtgatcttggctcactacaacctccgcctcctgggttcaagcaattctcatgcctcagccacccaagtagctgggattacaggcatgcaccaccatccccagctaatttttgtatttttagtggagacagagtttctccatgttggccaggctgatttctaactcctggcctcaagtgatccaccagccgtggcctcccaaagtgctgggattacaggcgttaaccaccacacctggcctccatttttcttataaaaactatctttacctgacagatgataaatctgcctgagtttatttgtctgatttctctgccctaaacagtgagtttcctaagaacaggaaattatttgctctattaatggatgtgcctgggataggatctggtatagaataaatgcataatcaacatatgtcaaatgaatgaatgaacagatgaagctgataatttttctcaagctttctaggtgaaatagtgcacttgatcctatcgttggtaactttatctccaggtgtggtaaaacttgttattttgcaacctggggacaccttgctcggttcttactcaagaaaaaccagccgggcgcggtggctcatgcctgtaatcccagtactttgggaggctgaggcgggaggatcacaaggtcaggagttcaagaccagcctgagcaacatggtgaaaccctgtttctactaaaaacacagaaactagccgggcgtggtggtgggcgcctgtaatcccagctattcaggaggctgaggcaggagaattgcttgaacccaggaggtggaggttgcagtgagccgagaccgtgccgttgcactcctgcctgggcgacagagtgagactctgtctcaaaaaaaaaaaagaaaaaagaaaaactaagatctgcatttccataagcaggtgtagctcatttgattaaatttcccttgctaacttcttaggatacacatgaatatataactaagcatttaatcaagctcctgacttaccagaggggttagatgctgaatataatttgtaattgcctaagaatatagtaagcttgagtacttttgtttccataattaagtgtgaggcccttgtctcaatgtgaattaagaatacttcaagcactttatatgaaaagtaaatttattttcttttggaaaagttcaaacacatatgaaagaagagaaaatagaatgatatcccacccaattcctataacccatcttcaataattatcaactcataacacatcttgtatttctctagcccaaacttaaacataaccttaatttgcaaattgaagcaaacctttaatttgctctaacataaccctgggttgtgtttaaccctgttaaaggaaatctcagacatcgtatgatttcatctgcaaatattttaatatgtacttctcaaagctaaggactctgcagccgctgcagaaaatggtatggtgattcctcaaaaactcaaatataaagttaatgtataatccagcaattttacttctgggtgtaaacctcaaagaaatgaaagcaggggctcaaacagatgttcctttgtacatccatttcatagcagcggtattcacaataaccaaaaggtggaagcaacacaagtgtgtgtcaacaggtgaatggataagcattgtgttgtatatccatatgaaggaatattattcagccttaaaaaaggaatgaaattatgacacatgctacgacatgaatgaaccttgaggacataatgctaagtgaaatcagccagtcacaggaagacaaatactgtatgattctgtttatatggggtccctagagtggttaaattcatagggacagaaagtagaagagtggttgccaggggctgggggagagggaatgggaagttagtgtttaatggggacagagtttcagtttgggaagatgaaaaaattctggacacgaatcatggtgacggttacacatctatgtgaatgtacttaatgccactgaaacgtacaccttaaaaatggttaaaatgatcaagtttttattatgcatatatattttttgagacagagtttcgctttgattgcccaggctggagtgcaatggagcaacctcggctcactgcaacctccacctccctggttcaagtgattcttctgcctcagcctccccagtagctgggcttacaggtgcccgccaccactcccagctaagtttttgtatttttagtagaaacgggatttcaccatgttggccaggctggtctcgaactcctgatttcaggtgatctacccaccttggcctcccaaagtcctgggattacaggcatgagccactgtacccggctatgatgcatatttttccacaataaaagaaaaagctaaagagtcacttatgttgcatgttgtcctcactctggagctagtcttaaggagcgtttgccacctggagctttgccagttcctatgcagaagaaaaaagtggtgtagagcactgccgtggaccactttcaaaagttcaatagaactttccaaaaatgttccctatctccaatgtttaataaagtagctactagatacatgtagcttttgaggactagaaatatggcttgtaccactgaacaacaggattttaaatgttgtttaattttgatagccacatgtggctactgccttggacactgcaacattagagagatttgtattggttattaaatgcttcaacctgggagtgacatgtttcatttccactgagaactcattggtcagaattagtcacatgaccccagcagaccacaagggggccaggaaatgccagcttacatcttacacatgcctgtatatggagaactggaaatatttggtgaacagctctaatgcctgtctcagagaataaatctttttgagatccagaaaggagaaaaattggctattttatttcaggaagagaagataagaaatatggagacttaatgtattatctattgctgtgtaacaatttaccaaagccttggcagctttaagcaacatttatttcacagtttatgtgagtcaggaaccagggtgcagcagtttcagggtctctcttgaggctgcaatcaaggtatcaactggggcttcgttctcatcttaaggcttgactgggggaagatgtgatttcaagcttaaacttgtggctgttggcagaatactatggaaaaggaacactcagagaacaattatagcaataccaaaagcctcttgaaattaaaaaatataaaagcataaataaaaaactgaacaaaaggtggaaagataaaattagagaaatctctcaaaaagaagattaagacacaatggaaatacaaaatagaaggaaaggaacagataagagaatcagtccagaaagtccaacatctaaataataagtttaaaagagaatcatgaaaaaagggtgagaatcttagctgggtgtggtggcacactcctatagtcctcaggagcctgcggtaggaggactgttttgagcccaagagttcgaggctgtaataagctatgatcacaccactgcactccagcctatgtgacaaagtaagaccttgtctctaaaaaaagggggtaacaatcatcatactaagtgcccagtacaatgactgaaaatagacctaaactaacttacatcataataaaattttagaacacaatggaaaaagattctaaaagctactagagaaaaaaaatgaggtcatatacaagaaatcaggagtaagaatgcttcaaacttcccaacagcaatactggaattgagaatacgttggagcaatacttcacatttttgaagtaaaatgatctccaaaccagaattctatacccagccaaactaccaatgaggtataaagctaaaacaatagcatttcatacatagaagtctccaatatttacttcctgagacagattagactgttcaaaaatggctgcacaatggctcccattttacacttgcttagaattttatcacttccccataaaggattggaatctatattctctccctttgaacctgggtgaacctttgtgactgattcaactaatagagtagggaaggagtgatgctttgtgacttccaaggttagctcataaaaggagatgcagcttctgcctggctctctcccttgagacatgtgcctttggagtcctgaactggcataagagaagttcagctatcctgaagttgccatactggagatgccatgtggagataccacatagaaatggagatagatgcttgagaaacctcagttgtttgagtctttccagcctaagttccagccctgtgactgaggaagcctttgagatgaccctagtccctctcgccatctgactgtatttgcatgaaagaccccaagtgaaaaccactcagatgatcccagttgaccacccaaatcacaaaatgtgataataaaaatgaatgttgctgttttatgctactaagtttgggctggtttttatgcagcaataggtaactggaaaacctctcatgcatcctttcttaggaagctaccagaggatgtgcttcacccaaacaagggagtaaaccaagaagagggaaacagagaacactggacttaagaaatccaacaatgagaagcaaagggaatctcctggatgatgataaagagagagcccaggatgaaagctgtatgccagggaaagtcctgattagaccatgtgacaagtcttcaggaaagactgcttctggatgataaaatgaactgaatacctgttaagagacttggggggtcaaatttgcaataagtaccaaacaaagaagattaaaaaatgataagtcccaagggaaacaatatgttgtaaagaaaaagtagctatagtttgttcatgacataactgtaacttgccttgtacatgataatataaacaccgaatcttcctcactttgtgaaagaacaatattgggcaaatgcgcaggttttggaaagttccatgtgtagggggatggagggagaaattagcaaaatcctccttttctatagctaatacctataaagtgctacaacacccagacaggatacttctttgttgctttcattataatatccttgggtattgctgttggctatttcttaatactacttaaatattcacaagtgtacgacttgttttcccaacctaactataagctctttgatagttaatgcttctctatattatctgtagtggctggcatagtatgctacgcatagtatgtggtcagtttgagaaatattagttgaataaaataatagtgttggaacaaataaataatgactaaaactgaaaaatttaaaagtagaaagaagtaagtgaatgaacgatgtggggcttggtgtggtggctcatacttgtaatcccagtgctttgggaggctgaggcaggaggattgcttgagactaggagttcgagaccagcctgggcaacacaacaagacactacctctacaaaaacaaataataaaattagccaggtgtggaggtgtgcatcagtagtcctagctactcaggaagatgaggtgggaggattacttgagcccaggagtttgaggctgcagtgagctgacattgcaccactgcaccccagcctgggtaacagagtgagacctccatctctgaaacaaacaaacaaaaacccaatataaataatatggtagtaaatagcaaaataatcagctaaagggaaccaggcacagaaacacaaatatcgcatgctgtcattcatatgtgggagcttaaaaaaaaaaaaaaaaaaaagaagtcatggaggtagagagtagagtgatagttaccaaaagctgggaagggtagtggggagggtggaataaagaggaaatgattaatgggtacaaaaatagagttagataggaggaataaaatctagtgcctggcagcacaatagggtgactataggtaacaataatttatgttcccatcacaaagaaatggtaaatcctttcttaaaaaatacttttaagttcagggggtatatgtgtaagattgttatataggttaccttgtgtcctggagtttgttgtacagattattattattagttttcgcggcagagtctcactctgttgcccaggctggagtgcagtggcaccgtgtcggctcactgcaaactccgcctcccgggttcaagcgattctcctgccttggcctcctgagtagctgggatttcaggcacctgtcaccactcccagctagtttttgtgtttttagtagagatggggtttcaccatgttggccaggctggtctcgaactcctgacctcaggtgatccgcccttcttggcctcccaaagtgctgtgattacaggtgtaacagattacgcctgtaatctgggtactaggtcttaagcctagtacccattagttatatttttaatcctctccctcctcccacactaaaccctccaattaggccccagtgtgtgttgttcccctctatgtgtccatgtgttctcatcatttagctccgacttataagtgagaacatgcggtatttggttttctgttcccgcattagtttgctaaggatcatggcctccagctccattcatgtccctgcaaaacacacgatcttgttcttttatggttgcatagtattccaggatatttatgtaccatgttttctttattcagtctaccgttgatgggcatttaggttgattccatgtctttgctatcgtgaatagcgctgcaatgaatacgcgtgcatgtgtctttgtaatagaacaatttatattcctttgggtatatacccagtaatgggattgctgagtgtaatggtatttttgtttttaggtctttgaggaatcaccacactgtcttccacaatggttgaactaatttacactcccaacaacagtgtataagcattcctttttctccacaagctcatcagcatctgttattttttgactttttaataatagccaagaaatggtaaatgcttgaggtggtggatatcccagtcaccctaatttgatcattacacgttgtatgcttgtatcaaaatgtcacatataccccatagataggcacaactattatatatccataatgatttttaaaatcagccaaaaggtggccaggttcaggggctcatgcctgtaaccccagcactttgggaggctgaggaaggcagatcacttgaggtcaggaatttgagaccagcctggccaacatggcaaaaccccgtctccaccaaaaatacaaaaaactagccgggtgtggtggtgggtgcctataagcctagctacttgggagcctgaggcaggagaatcacttgaacctgggaggcggaggttgcagtgagccaagattgtgccactgcgctgcagcctgggtgacagagcaagactccttctcaaaaaagaaaaaaaaatcagcgaaaagtgttgatagtgagtatctttcaggagggggatatgaaacatggagggaggcagggggctgctattttgcataacaaaacctgtttcagagacgcatttgactctaattcccaatggcagcaccctctattccctttcctgctttgtttctctccttagcacttagcctcatctgacatactatgtattttccttattatttactctatttattcctcatctccattcaactccacgacaacgggaaattctgtctgccttgttctgtgctggcaaaattactgggcacatggcagatgttccatacagtcaggagaatgaatgaaccttgtgcctctgcaatttttgtagccactcatttattttaactttttattttgttgaaatttcagatttaccaaaaagttgtaagactggtacaaagaagtcgcctatatcacttatccaggtttctcaaatgttaacattttaccacttacactttactttatcctctctctctctctttctctccttaccccaaccgttgaccactgagagtaatttgtagatatcatggccctttaaccctatataattcagtgtgtttcccaaaacagggcattctcttacataagcacagcacaatgatcaaaattaggaaattagcatatgaacactgttattatgtaatctacagatcttattcagatgtcaccaattgttccaatagcgtcctttgtagcaaaaggaggtcctggctcacttgttgaatttggtcagtcacatttcctttactctggaccagttgttctgtctttatctgggcttcacgacattaacacttccaaagaatacttattgtataaagtgccccttaatctgaacatggttgtttaccaattattcaaatcatgcatttttggcagaagttcctagaagcgatgttgcagccttcttggtatgtcattctaggaggcacgtgatttgcccgtcacttgcttatctgccagggtgctccactatcaggttactgttttgaccattaaaattaacagttgtctttgggaagatactctgacactatgtaaatgatctgttatccctcaaactttcattatcccctgatagttcttgtatgtttttatggtagttgccaaattgcctacatatataactttttttttttcttcagaaatacggtcttattctgtcactgaggctggagtacagtggcaagatcatagctcactacagccttgaactcctgggctcaagaaatcctcctatctcagactccagagtagctgggactacaggcgagtgccaccatgccccgctaatttttgttattttttgtagagatgggattttactatgttgctcaggctggtctcgaactcctcagctcaagtgatctgcctgcttcagcctcccaaagttctggaattataggcatgagctactgtgcccggcctccttatgaaagaattctaaagaatacggatagatacttcccagtccagaaggggatatttatccctcttcctccacttcatgtgggtaggccttagtgactgttcagaaggtagagtaggtattgggaaaaacagtagcttgatggtggagaaacttggcagacaccaccttaaccaagggatcgaggttaacatcactaatggtaagtcatgtaactatcttacaccctgatctgatgcaaagagaacggcactgcacctctgtgcaatggtcttctctcaaatccattattccagtttaatcatgaaaacagacaaacccaaggtgagggacgttctacaaagtacttgatcagtactcctagacattattaaggttgtgagaaacgaagaaacagatcagaggagactaaggagacaaaatgaggctgggcacagtggctcccacctgtaatcccaacactttgggaggccaaggtgggaggattgcttgagcccaggagtttgagaccagcctggacaacagagtgagaccctgtctctacaaaaaattaaaaattagtttggggctgggcgcggtggctcacgcctgtaatcccagcactttgggaggccgaggcgggaggatcacgaggtcaggagatcaagaccatcctggctaacacggtgaaaccccgtctctactaaaaatacaaaaaaaaattagcccggcgaggtggcgggcgcctgtaatcccagctacgcgggaggctgaggcaggagaatggcataaaccctggggggcggagcctgcagtgagccgagatcgcgccactgcactccagcctgggagacagcaagactccgtctcaaaaaaagaaaaaaaaaaagaaaaaaaaattagtttggtatggtgttttgtgcctgtggtctcagctactagggatgaagacaaggcttcttaccctacaggttgctgtagggatgaattaagatcaagcagaggccaggtgtgatggttcatgaccataatcccggcactttgggaggccgaggtgggtgcatcgcttgagcccagaagttagagaccagcctgggcaatatggtgataccccatacctactaaaaatacaaaaattatcggagcatggtagcacatgcctgtagtctcagctactcagctactcaggaggctgcagtgggaggatcgcttgaacccaggaagtcgaggctgcagtgagccgtgattgtgccactgcactccagcctgtacaacagagtgagagcctgtctcaaagaaaaaaaaaagtcaatattagaggaagctgggtgaagggcataatgataactctcttgtactacgttttcaaactttctgtaaatctaaaattatgccaaaataaaatgtttatttaagaagttaaaaataaggtaatatttaatcaatcttagtcagtgatattcacaaatttcaggtctggaagattgactatggtgaatttttttttttttttgagacggagtctcgctctgtcgcccaggctggagtgcagtggcatgatcttggctcgctgcaagctccatctcccgggttcatgccattctcctgcctcagcctcccgagtagctgggactacaggcgcccaccacctcgcccggctaattttttgtatttttagtagagacagggtttcactgtgttagccaggatggtctcgatctcctgacctcgtgatctgcccacgtcggcctccctaagagctgggattacaggcatgagccaccgcacccggccgactatggtgattttttaaaaatctacttaccatgaattcttatataatatgtatgctagtcattatgctgagggcttatctgcttgatttttgtttgtttgtttgtctgttttctttttgagacagggtctcaccccatcacctaggctagaatgcagtgacatgatcacagctcactgcagcctcaaccttccaggttcaggtgatcctcccacctcagcctcctgagtagctgagtagctgggactacaggcgtgtgctaccatgccgggataatttttgtatttttagtagatatggggtttcaccatgtcgcccaggctggtctcgaactcctaggctcaagtgatgcacccacctcagcctcccaaagtgctgggattatggtcatgagccatcacacctggcctctgcttgatcttaattcatccttatagcaacctgtagggtaaggagtcttgtcttcattttattgaggaagctgaagttgagagaggggaagcacctttccaaatgcacactactaggaatttcgagagctaggatttgaaaccaggtctgtgtccagaattaggctttgcctcattcgtttttggaagcttgcagagcacatgctgctatgcaatgtaatgcccaaagtcgcagccacattccgtctctgaattcactcttgggtgcctacatcatgacccgtagatgtctggatgatcaaatttggctttgtcatttttatcctccacctcccaaagatcttgatactcattccccatgggtatccagaccagaaggcagagaccaaatgtcttttggccgatccatttttgcaactcaacatgactagatttgctgataattgttttagcagtcaaatgaatgcgatttgcagttatttatttggggcatttatttcaaagatgctagccccgttcaattgaataacattcttaaagccagtatagtaatgctgctgctgattgataaattaaacctccagctggcagatgtgttaaagattagaaccaatggttggggctggtttctggctgcctgctgttaaactgcttctgtctgcaacgctaataacattctaaatctttctacctggtcaacattagtaatttgtattagtgggggtccaggaactacctactacagtcatttgaggaggctgcaatgacttcttgcccatccattcccatttgctaggtgataggtaagattctggtgttagagattcattcctttggctacagaaatgttatgtctgcaaagtgaatctataagataatgcacatggagccctgccacactttatagtaaatgagttaagttctttctggaaaagaggtattgagcaattgggggttgaaggacttgagaagattcctaggaaggagaggagaaccccagcacaccaaacttcgtagtcaggcaaactttggaaatgccatttggtgagaggaaagtgtagactcttctgtcaccttgatggcaggtgagaggaggtgtttgcaaatgtatgtgggtatgtctggttatcacatgactagggatgctactgacatttagtgggcatttgccaagaaggctaaacaatccgcaatgcacaggacagccctgaagagcaacaagtgttgcaccgaaaatgccaacagcacctcctttgataacactagagaatgccaagaaagagatggtgagtttgcccccttccagagctgtggttgccaaaactggctataccccagggacatgctgaataaataaaagagagtgtgggatggctcaggaatctgaatgttcacaacactttgccggcagttctgtacacagccagcttctctgctgcctaggcacggtttggggcatcctggaggactgttctttgtcctccagtaaagatgtctgattttgttgtataggggcttcatggtcaaagtgtgcaaagagaacaatcacaaatcatcatgacaagtggtgctgcttgggctgtacttcaggagcatcacgaatttttttttttttttttgagacagagtctcactctgtcacccaggttggagtgcagtggcatgatctcagctcactgcaacctccgcctcctggattcaagtgattctcttgcctcagcctcccgagtagctgggattacaggcatgcaccagcatgcccggctaatttttgcattttaagtagagacagggttttaccatgttggccaggctggtctcgaactcctggcctcaggtgatctgcccaccttggcctcccaaagtgctgggattatagtcttgagccaccatgcccagcctacaaatattttttatttaagtaggcagcacacacaaaactgcacaaatcagtcacgtgcagctcagtgaaaaggtacaaaatgaacaaaacttaaaaagtgagcacacccatgccactgtcacccagatggagatgcttccagaatgtatccctttaccctcaaagcgactactcctttgacttctaaaggtgatcagtgttgctcattttttaatgttattatttacttatttaattttttaaaagaagagattgggtctcactctgtcgcccgggctggagcacagatcatgtagctcactgcaagcctcgaattcctgggctcaagccatcctcctgtcttggcctccagagtagctgggaatcaggatacctgggactacaggtgtgcaccatttttttttaaactttatataacaggaattatacaccatgttctgttctgtgtctgtcttcttgggttcagcatggagtttgtaaaattcatccatgcacctgtgtgtagctccatattgtcctttcttattgctgcataaaattccatgttctacagtgtatttatccattacggtattttggaaatttccaacttttagcaagtatgaatagtgctgcacattctagggcatatatcctcatttctcctgggtgtatacccaggagtgacattgttgggtcataggatactcaaatggccatgttaatagaaatgaccaaaaagtttttctttttatgtgtttgttgtcgttgtttgttttttgagacttgactgtctcccacactggagtgcatgatcttggctcattgcagcctcaaactcctgggctcacacaatcctcccactttggcctccccagtagctgggactataggcatgcaccaccatgctcaactaatttatttatttcctgaccttttcttttcttttttcttttctttctttctctttcttttctttctctctttcttctcttttctttctctctttctttccctcccccctccctccctccctccctccctcccttccttccttccttccttttgtagaggcagggtctcactatgttgcccaggctgctcttgaactcctgggctcaagcagtcctcctgcctctgcccaccaaaatactaggattacagatgtgagccactgcacccagccaacggttttccaaagtggttgtaccaaattcccctctgtccaacagaatacaagagtcagaaatgggttcagatccacgttagtgaccttgggaaagtttttaagtctccctcaccctcagtgtttgcatctgttccacggggctgctgtgaagactcagtgggagatttaccctggcaggagctccatcagtgagatgtcactctttcctgaaaaactctggggtcttcacagatctatgcaggtaatgctcctgctctaaaactgaataatcttctcagagaggtccatcagaacaaatgataagttcaactcagctcctctcatatgactggttcttcccatctgaacacatgggctcgcttcttgtttcatattagttgctgttcaccttttatatctgaaacaatgtcaagtacaaaaatcactgatatttggtgagcgccttaaaagcccctccttctccctgaatcccacacaattctatctccttgcaattccaatcactcttggtttaatcatttcatccatatcgtgacaagttagaaaatcttgaaagtgctatggggcaatgtataatagttggtgcattggcacagaacggggactttatataaagacatatcatctttccagagtgttccaaaagaactcgaatattgatatgtgtgtgtggggtggcgaggggggaagggaattaactaggatttaactagctaaggcttgaaagaatatttgcctttttcatccttttcccattcctctccatttggcctttctgcgtatacaagctccatgaaaattcaatggtttcttggtacattgaatttgcaagacagtttgatgacatcttataagcttgaagatatgaataccttgtggacccagacattccacacctaaggctattcctagagacatgcattcttatctgcaccaaaggtacctgaggcagtaatgtttaatagccccaactggaaaaaaaacagatacccatcaacaagatgatggataaacaaattgtggcatattctcttgatgaaatactatacagcagtgaaagtgaatgaatcacagccatgtgtgacaacaaacaggtgaatttttctaaaattcgaaacagattaggatgtatgaatcttgttttttttgtttgtttgtttttgttttgttttgttttgtttgacagagtctcactttgttgcccaggctggagggcagtggtttgatcttggctcactgcaacatcctggactcaagggatcttcccatctcagcctcctaagtagctgggactaggttcacatcaccatgcctggttaatttttattttaaaaaaggtttttggagagacagggtcttgctatattgcccaggcttgtctcaaacccctggcctcaagcaatcctcatgctctgcctcccaaagtgctgggattacaggcgcagacaccgtgccctgccagatgaatcttaaagacataatgttgaaccgaagaaacaagaaactgtagaatatatactatatgattattccatttatataaaagcccaaaagaagcaaagtaaaattgtattggttaggaacgcataataaggtagtcaaactttttttaaaaaagcaagatatgaataccataaagtcaggtagcgattattgctggaataaggggctgtgtaagcgtgttggcaaagggggttctgcagaggtggtgatgttccatttctagccctagacttgatttcatgagtgttcatttcagaccaatttcttaactccgtacctttatgttttatgcatttttctttgtgcttattgaatttcaccacacaaaaagcagaatgggaagtaatcaaagtggttctggagagacgtgagtatcaagcaaactataccacccagaacccctatccagccaactaggacctggttaattatttcctcctgggagttcagacttgtcacctctggggtctccaaggtagaataaacctttaattccaacttgcaggagtccttgtgatttgaaacgttcacagaagtaaccccaaaccactctctccactttcaaaaatggtcttttgctaaacagagcaaatttgtttagagactgacgaatcgcacctctagacacaaatccccttctcttttctgtcttttaagtttttttcctgcctccatcctgccttctccttgcaagatgctggggagcgtccggctgtctgcaaccgaaatggaacggggtggaaaacaggctttcctcccaggggaggaggaagcaccccaattcccccctccctgcctcccaaccatgcgacgctcccctctctcccccacaaactccgctgagcccggtacccccgcgcctccacgagcctccacgattggtcgcgggccctcatgtgtcgacactctgggtgggtccttctactgttaaactcatcaattgctccccttttccgtttgctggccagtggttcagacctttgcgcccatttttttttcctctttaccttcttctacccgcaaccctccacaccagtcttattttagcaaaacctagagaaggaggaggtggagggatttggagggtggagaggcattgccgcatccaggggcagctattgagtggctaagcggagggcgcatacctctctctctctctcttttccccctgttgggaattttcaggatttcactgctgcaatttaaccccaagatgaggcaccattgagcgaaacgctgtgcgcacatacacactcacacttcctccgggagcagaagaggcagccgttggtgattcaggaagaaaaaaaatttttttttttttttttaaacctggaccctgcggtgtgaagactccttaggaaccctctggagcgtcttactccccttccctcctctttcccttccctttcatcttctttgtttttattttattttatttttggagctacagatctttcagcatttttaaggtctaggaactccagcaaaacagaagggcacttaattttttttttttttttttttgccctccccacccagacctgggtttcgtctttctttatttttaaatatatatatatttttttattttttattttttatttttttttaatgggccgagcgcactccttttgcaagatgccagcctgacccggacctcggaggaatttgaagcttccactgcgtcccggggggggcgtcctttgcaaaccgttcgcgtcttaaagggggtgtgcgttgggtggattttttttttttaactgtctctttttttttttttccggagtgggtggactggggattgcctggattccttcctcggttattttttgcctcgcttctctctcccctcccccctcctccccgggcccccgcgccccgcccccgcaccctcctcccgcccctccttctccggggtcagccaggaagatgtcccgagctgctatccccggctcggcccgggcagccgccttctgagcccccgacccgaggcgccgagccgccgccgcccgatgggctgggccgtggagcgtctccgcagtcgtagctccagccgccgcgctcccagccccggcagcctcagcatcagcggcggcggcggcggcggcggcgtcttccgcatcgttcgccgcagcgtaacccggagccctttgctctttgcagaatggcccgcttcggagacgagatgccggcccgctacgggggaggaggctccggggcagccgccggggtggtcgtgggcagcggaggcgggcgaggagccgggggcagccggcagggcgggcagcccggggcgcaaaggatgtacaagcagtcaatggcgcagagagcgcggaccatggcactctacaaccccatccccgtccgacagaactgcctcacggttaaccggtctctcttcctcttcagcgaagacaacgtggtgagaaaatacgccaaaaagatcaccgaatggccatatccttttgcccgaaccccagcagcagctgcgcctccccctcctccctccgcctcccctcttccaggctgggagagagacccgggggttgatgggaggtggggaggaggggggtcttccaggggctgggagagggggcaccgggaggagtgtgaaagaatctctccaccccgagctgggttgagctaccctggaggcttgggaatgggtttgtggggggctggggggtgggcagcggagagtggatccttcccaaggaccgactctagaatgagatctggggcctggggtcgtgcaggagccttggtgggggctttcgagccaagtccggagggtttggagttctacggagtgagcttggagcgggctcgggcctgggcgcttctggccagggcaggggaactatgggggccttggttgggttttcttggccgtcgctcactggagtccacgcaggggaagctggacagcctctccactactgctttccccaaggtggggggccgccgcacttttagggcagggcgcttgggggctcccagggctaagagcaagagggagtccatgtggccttcacactgagaagccagcactggccgaagtgagtaccccagggtgggccgctgttcctatctggagaggatagtgatgggctggggggcgcttatgtttccctcatgtgtgcaggtcccattgcctttaaccgctgattggggaacctcatcatctttgggggtgtcgagaaagagatcccacttgctttatctgggcccctggcctgggaagacctgatctggacactttcagtaagaaagacagggcaacagcaaatgaggtggtgggtccattttagagcaccatgtccagcttttcctaccccgagtagccgagagggaacaccaggagaatcagcacccatgtggacatcttaggtaggtaaatgccttttaaatttttttttttttaatcaaagatccagaggaaaaaggtgaagcccacattttcttctgtggagatgctatcaaaatgcagatcttctgtgtttctttaaatccctgcctgcttgaaataaaccttgaggagggcttaacatctatcgagatgtaggcaggcaagggtgggtaattagtcgggctttctagcagttatctaagcatgacccagattccaggaggggggacacaccctgctgcccaggctggctggccactgtgccatgcccagatgtgccgcttctccgcacagttccaaccagctgccctctgtgtaaaaatgaacgggctggatgggtccctggggctcagcgatgagtcccctatcccttttgtatgtggttttgcagttatagactaaacggggctgggccctgtgtggtctccgggggttgctgtttgaggagcatggcgggtggtagagggactcacttcaggggggttcaaaatcgagcctggcgcttggatcctgggtgctgggattgcaacagagggcactgaggttttggagtgtgtgagtggtctactttgagggtggggaaaattaagaagttcagcagaggtgcttttgaggggagcatacctctaactacgatgccatctccgttggtgcccaaagcaggtgccaggtctttgcttcctaagtttcagactcttaaagaggctggttcttaaggttagcaattcctcaccatcccaggcccattgaagtgctcaggggtggcttgattactctgcctatcaacagagtgaggagtgggagtgccttgcaggaggacagggtattcatgggtgcacacccagttagctccaggagtgagagggctttgctcggctgacaggtttcctcattgaaaatggctttagatcgccttctggagcctggatttggagacttctaagaggaaaggaaggaggtggggagcccttctgctgtgtccttagcttacctctgtccagcctgaatcctgcagattggagggctgttgggggagagggggattgcagtggcccctcggaagggggaatcgtgggagagggaggcaggtgaattgcgagtgttgcttgccacttcatctattctctggccagctcgcccggggctttcttgctcttatgatgagtttgtgcattatgctctctgcagactgtttttgttctctttgacccgaggtaacaaacacattatacagccctactctggaagggaaaactccccacctcacaatctgtcatcgagctgggtcatccaggactgagctttctctgtcctggatggagcggagggcggtggcggggtgggtgggagggttggagatgagaggggatggacagagacctggggagggaggtagtgaataaaagaattcaggccagtgtaaagagaaagacacgtggaatgtcagagtcacgataccagggcagaacattctactttttaatctaaatatttctgccattaaaaaaaaatgtttcagcatatcctgagagtgaaaaaaaaagtgtgtaggtacttaaataaagtctaatatatgtacaggcaagtacatatattcagatgcatagatttttacaaaatgaacacacccacgtatccagcacccaggtcccgatcagtgccctggaagtccccctccccataccgcctcctagttgctcccccaacaagggtaccgctcacctgacttctaaggttcattttgcctcttttaaacatgtaaatggagtcacacagtacgttcttttgccactggcttcttttgctcacatctgtgtatgtgactctactacaatctatccattctactgttgatgggcatttgtgtcatttctgtttgtgccactgggaacattcttgtgtcttctattatttttttcccacagttctcttagataggagtggaatcgcccctgctactttttgatgcatgtgttgtgggatgtgtatttggaaatggtgttgactaagggttgcaggtcgatatggaaagcaggttcctccctgtcttgtttaagagaagtgagtgaatgatccatgaacttgtcggtatgctcacagggcctaagagtgctacttccaaatgtaaattctggcatggtacactggtgaaggatgcagtcttgctttctccacactcggggcaatttgtcactatgatttcttcctctttcatccctcagtgggtcaaacttgaagccatcaatgacaattaagaatcctcatttatttcattttttcccctcttcctaagtgaggaaacccaaatggaagtctttgatgttcaaatttacattgccgtgtttttctcatgccaggcagcaagccgtcttgaccacacaccttggtttcatgttttcattgactggaattgtgattcaaatagggccatgagggtctctgatgattgccgaagagctcagatctgtcagctcaaaaaggagcatctgtcagccttcctagagttccctccccacttaatgccactcactccttctaccaagtgccaaggtgaatgtcatctttccagccctccctgtgccaccaggtctcccactgaacatgatgtagaaactcaggccatcggaggaacactggaagcaggtcagtgtattatcacgcacagttgcctgaattacacgtagaattccagcttttcatccggtttgcagaaatcttaacaagacacctaaagtcacattgacatcaggtgacatcactttgacatctgtggacattggctgattggcactcctctcatttttttttttttttttttttttaagaaaagctctctaaagagaaactttctgcatgagaagcgctgggagacatgggagcaggttatcagactcttggcctgtcctgagagatagaatgttctagaaggtactgccgtagagggcaggatggtgtcacttacgtgatccttgtactagaccggcttggctggtatttccagaggagcaaaattctgcgaagtaaaatttagcacggcttttccaatgggagtattttcaaaaagggtgcaatttcttatccacaattccccaatccaaaaagctccaaaaaccaaaagacgagctcatatagaggtaaaacctaacctgaactgacttcagtttgaagtcttaatttacagttttcattcattctacttggtgtgcatttgagtatgttttgcagcagaaatgttagatgtgcttgatgatgaggtgctgcttcagctcctgactgttaggtctgcattgtagtcctgtcaaactttcaggtgtatggaagttgtcttgttaacaggatggttctggtccagcaggatttgggtggggtctgggattctgcttttctagctagcttctagggattccccatgtggtaagttcatgggctagggttggagtatccaggttagatcatagagacatcttgttatcatttttcttttccttaaaaatcaggtttataggggccgggtctggtggttcacgcctataatcccagcactttgggaggctgaggccggtggatcatgaggtcaggagttcgagaccagcctggccaacatggtgaaaccccgtctctactaaaaatacaaaaattagccaggcgtggtattgtgcgtctataatcccagctactcgggaggctggcaggagaatcatttgaacctgggaggcagaggttgcagtgagccgagattgcaccactgtacttttttttgagactctgtctcaaaaaaaaaatagatttattgatgtataatttatttgtagcaaaattcacccttttgacatactggtctgcaagctttgacaaatggatgtagttgtggccaccacccaaatcaagatatgggacagtttcatcaaccctaaaatacccccacagtgcccctcttgagtcagcaccccacttctccagccccttcaaccactgatctgttctccatccctacagctttgccttttgccgaaggtcatataaatgtaatttcacagtatatagccttttgaatgtggattcttttactcagactttgagattcattcatgctgttgcctgtgacagtagcgccttcctttttggtgttgagcaggattccatgatatggatggaccagagtttgcttcccagccgaaggacattgggatgcttccagtttcaatgattatgaatagagctgctataaacattggcttatgggttttagtgggaacatttcatttcatacatttcatttctcttgggtaaattaacccaggagtgagattgctgagttgtgtggtaggtgtatgtttaattttataagaggctctcaaactgttttcctaagtggttgtaccattttacattcccatctttgcaatgcgtctaaaagccctgagttctgaattccaaagcacgtctggcctcgatggcttaggattaaggatgtggatctatggaaaggagtggaagtaatagtgttaaatcccggtcagagaaataagaaagattaaggatgtcattcaaagctatgtgcctgcactagagagagagaaagaaggggttctcttgggtggggttccacccctccctggtagttctaccattccccaggaaaaagtcaagctctgaggctgtgagacccatgatctttaccctgttcttcaccactgcaaccccagtgtgtgggacaaagcaggcgtcctataaacgtttgctgagcaaatgagaaaaggtacctgtcttcacccattaactaaattgtataacatctatctgatctacccttgtgccaacgttttaggattttgatgggttttagttgcagggggttgagagactgtccatgagattatcagaccaatgaaagtttctgaaatgttagtgcttgagtagattggatgcagcggccccttgagaatgaagtctttcttcagggacttggagtgggaggcatctgttgggtgcgtagggcttatgcttccccctccctgtttcccccccagtagcaagcacacatatacactttctcagcaataaaaagcaccgccgggaaggtggactccatccagaaatgatcagagcctaagagccgtgcagtaacgcatttccgagaatgccagctcagctcctgagaaaagggccggatgggatggtgcctgctctgaaagagggcagagaggagagggaaaacactccggactctgggtcagactggcccaggttcacattattcaccagccatgttatcttgggcaccagagcctatttcttgacatgcatgatgaggatattccttctagtagcatctcccttggagggctctcaggagattaaatggggtcgtgcgtgaaaaatggccagcacagtctccagcacagagaaaaaccccaaaacgccagagccgtaatactatggagtcatttaggttccagtgttctttttttggaaaccggccagaaaagaggctttctgggtgggaatgggagcgaagtgcccccccccaccaccccctgcgactggtcagtgtggattgattaacctgatcgtggcgctctttaaagccacctttggacattttgcattctccgttctctctggaagctttcaggggaaaaaaaattcgtggccacttgacccatttttctattcccttgagtctaaggtaaaaattaattctctttcctcctttggtccctccctctctctgtgggtgacaaggtgagggagttttaaagtatataattagcttccctcttccccttttgcactccctgtctcttcctttggggccggtcgagagtgcagcccaggatggccaccccaggtgtccactgcaaactccacagaaaaactttgctcaacttttggtttagaatttaggtacccccctccccttccaaactttggtcttctttctcctcactccctaaaaaaataggaaaaacaaggaacattcctggcgagggaaccatgagtgggcacagcaacttaggtttcaaaaaccactgggcctcagttcttatctgagtagggtgacccttcagccagggttgcctgggactatcctgggtttagcatctctggaaactcacagtcctgggcaaactgggacgctggtcaccctaatggtgagttcttaacacctgagagagaagaatggtgcaagagatggtgccgttgaccaagaaagggggagagtcagttacttattccctctgaaaagccaagactttttattggaatgaatgcagcttttagaagccgtctttaaggcagctaatacaagagagattccagctatgaagggaaatgcctgagttaagtccggatcaagttttgacatctcgcttcggtcagacacggctttatctgccgttcagactgggagcagccgtgagtcttccttaaaggtgcctgttgctcaggcggcacctgcagttagaaattagcagcctcccacccccagcccccaaataacaggattcaagagtcccctctctgaagccatgagggaaacccaacttagtcacccacttgccagtaaataatattcatgctgttaagttctgttctcattttaggcctatgtgtaaaaaatatatgtaattttaaactgatttttaaagtattttcatacgaacagcatttgcaggagggcgaagtctggatgttacctttttgtaaaagtggatggatttgtcttcaatgagactctggggcagacttaaaacttggcccgcagtggtgttacatggattctgatcttccagagtctgtcacgttcttttatctccatgatctttattatcttctttattgagaatgatgggcatggtgtgtgtgggtgggagggctatgctgaccatcactgcagtgaaatgtgttcgtggcatgttgtggcgtctgcataggaatgtgtctgtttgattaacagcacaagcagtggaggctgtaaggaggaaaagaggagggaaggtgatattggatggaggggagacatatagagcttgggaacagtccaccctggctgcaaatctcagctccagctcacagttgtggagcctcagtcttctcctctgtaaaacggggacagtagtcctatgtccgaggaattgtaagaaggttaaaagatactgtacccagaaagcacatggcatatataatcatcctgtgaagtagccaactcaatgaattttattttatttattttgagtcagagtctcactctgtcacccaggctggagtgcagtggcatgatcatggctcactatagcctcgacctcctaggctcaagcgatcctcctgccttagcctcccgagaagctgggactataggcatgcaccaccgtacccagctttaacaacataaatttatatatatatatatatatatatatatatatatatatatatatatatatatatatatattttttttttttttttttttttttttttttttttgagatggagtttcattcttgttgcccaggctggagtgcaatggcgcgatctcggctcactgcaacctccgcctcccgggttcaagcaggacgatgggcatttgggatgtttctagtttggggtgggggattgtttgtttgtttgctgttatgaacaatgctgctgtaaggaatcaataattttgaatgaatgaattcgaggtgttaattttagtctgtgtacttggaaatctagcttcacctagaatcagctgagattcatcagcatttatggcaggagctaagacatttcacagcttactcatcattttctctaagaggctgggtcaaccggttagctcttggtcctgcttgtattctgagagtcagaacctgtggtttagacactggcaattgatatggttgtagagaagcagcatggttgagttgagagcatggattctggagctaggtggctggggttcaaatcccagctctactagtcactggctgcgtgatcttgggcaagtcacttaagtgttctgtgcttcagtttcccagtctgtcccagtggtgattctaatagctccatggggatcctaatagctcctatctgggaggattaaatgagttaatacatctgatgtttagagtggtgcctgacacttaggaagcactatatgtgtttatacatggaagagtggatagatggatggacttatgtgggtggccatatttgggcttctctgatccactgctgagaatagtgtgtggcacacagtaggtgctgcataagtgttaatattctgctctttcttgccaagtctctcaactcccttgatctctgttatttttggcgtctgtgttgttaacccattcttctgaatgatcagctgaatcactgttgctccaatatataagccaaggagaacacaatcacaaggtctcattgattgtccatactagaattccatgattcctaggcccaagtaggattttccccacgtctcagcaatccttcttccatgtttctaatctttttctctcatttgttatgccccattgccagactctccaatctccccacagcttccccttcctctaactatactgtctctagtcttaccttctccctaagggcaccgtctttgaagacatcaaatacttcagagcaccaaatataggttagcttctctgagggccttacaaggacatggagtgtttgggtcttacacaaattggaatggtcagaaatgtttagagacttgagttgtctttgaaagagttgtcagaatgcaaatttttgacttgtggcctgtttctgatcacaacgcagtcttttaagttatggatcatagctggatgtttgtggtttagaggggatggaggcatcctctgcagttagtgttggatgtctgggtggatggatggatggatggatggatggatggatggatggatggatggttgaacagatgcatggatgagtggatggatggatggatgggatgaaggaaggaaggaaggatgggtgattggagggtaggtgggtggataagtagattggtagatgactcgatgggtgggtggacaaatggatgggtgaatggatgactggatggatgactggatggattggtgtatgagtgaatatatggctggatgaataaataggcagatgactagactggattgaggggtaaaaatatggatgactggatgggtggatgagtggatgatagatggttgaatgggtgggtggatgggtggatgttggatataagggtgtatggtagggtagctgtctatgtgtgggtctccctgatatttggtgttctgtttgacttgggaatgaccaagtctctccgcttaccaccttatttgtaccttttccagtatcaagtgaattttgcacacttttgtaaaaatcaataagattgtatgtttaggactttgggaggccgaggcaggcagatcacaaggtcaggagatagagaccatcctggctaacagggtgaagccccatctctactaaaaatacaaaaaattagccaggcgtggtggcgggcacctgtagtcccagctacctgggaggctgaggcaggagaatggcatgaacccgggaggtggagcttgcagtgagccaagatcatgccactgcactccagcttgggcgacagaacgagactccatctcaaaataaataaataaataaatattatatgcttaggttttacctatgtaattagaaagctccttgagggtaggggacagtgatttgccttcctcacatccccccaaagttcctgcactatatcatgcataagtatttaattgagtaatggtgaggaaagtaaacagtgttattgaacaaagattattaaaattctggaaacacctggttttgtttcagcactgggactgaaagtggaattccttggattttgctccattggtggataggatagcatgtggtggtggactggtagactctttctcttccaagcagattgggtaaatgccccagattcttacccactagtcagagattacagattactgattgatatggtttttctctgtgtccccacccaaatctcatctcaaattgtaatacccacatgtcatgggagggacctggtgaaggtgactggatcatgggggtgatttcccccatgctgttcttgtgatagtgagttctcatgagatctgatggttttaaacttgtgtgggcctctttcctctctctcctctcctgctgccatgtaagacgtgccttgctttccctttgccttctgccatgatttgtaagtttcctgaggcgtccccagccatgcagaactgtgagtcaattgaacctcttttctttataaattacttttatagcagtgtgaaaacggactaacacactgatgtagcaaggtcctttaaggccccatgtgatctggtccctgttttgtctttgatctcatctctttcattgtctaccttcctttcattgtctattctgtctcagccctgctgaccattttactcacacccatgtcatttgcattacatgacattccttctgttcagcataagctatttcctctgcctgcatcactgtttctccaggtctccccatggctaactccttctcttcatttaggtctcagcccaaaagttacctcctccaagaggcctatccttttcatttactgaacatctcatgtacaaaaaagaatataaaatatatgtatactctctcatccacaaaaaaatctctgaagacattttaatgtatttcatcccatacctttttatgcatgtaaacttttaggaacacatttccatgccactaggtatccttgaaaaaataagggccaccatgtatagttgcacaggttgtgcactgcacaaagatagcatgtcacatatcttaagtatcatggagcttgtatgtctactatttcagtaccccagctgataaaagcttaagtatcttgttctagcaagatgaagctattatgacaatttttgacagagaaaggggtgttttgtttaagttcacaatcagagaaatgggtgtcttgtttaatttcacaaccagagaaaggggtgtcttgtttaaattcatacagtggtgctgtatgggttggtggcaaccccagaaaagactgttgttaatatctgataatgttccactttatacgtgtattatattcatgtaacaatctctggctgtttgttttgccattataaataacagtgcagtaaacatctttgtgtgtgaatctctgtccaaggttctgatagttttctgaatgaaattcctgtctatatatggcactccaagcccataattgaaactctgctgttaccactttctttgaatctgtagaaggaattttgagaacaggtgactggtatattcaggatgttgatgacaaggaacagagaaagaacagttaaatggtttggaatttttcctgggctgcatgtaaagcagtgcttttgaactgggagcaatttttcccccaaggggacttttggcaatgtctggagacgtttttggttgtcacgaatgtagggggagggggcaagatgctactggcatctggctggtagaaaccagggatgcagttcagcatcttaaaatgcacaggacagcctttctcagtaaagaattatccagctccaaatgtcagtaataccaaggttgagaaatcttgatgtaatcgatgtcatgggtttcttcaagaggagtgggtggatttagggtttttgggtgacttaaatttaatttacagtttgtcttcctagctgggtgtctaagccagctttctgtgaactttagatcccacacaagaagcaacaggcttgctaccgacagattcgttgatgtaaatatagatgagtgtatagaaggaaatctcacccagagctggaaaatgttggaatgaaaactgcggcggcctccccttctctctccttccccttctgttgccctgtttgaaaatcgtgccttactttctttggtctcctggcatggtgaatgctgctggtatggactgtgtttctatatccccttgatccccacacccttaggaacgtacaggagagagaccctggagcatatcagcttagagatggaggggaatgggaaggagtgcgttcattcattcataaatgttgactgagcacctactgtatgctaggtgaatgggaggacgtgagggcagggaggtgacaaggttggcttattctgggctttgtgaactatggtgaggattttgtttttttccaaaggaaatggaataaccactccttttttccccccgatatacctaaactttttgattttcataacaaaaatgggcttccttttgtatatttgttttgagaccagccgtttttccaccaacactgatcacactgcagtgagcatcctggtagagaagtctttgcacacttctgtcactgtttccctaggacagattcctggaaatggtatggcaaggttgtatgtcaggcttttgggccaggttgcaagaaacaggaagtctgtgccctttcaaattccaaggtcccctttccctgacgacgtggcccaatcaggcttgccctcccttgattttacatcttcaccaatcagataagtgaaagtgaaatcctgttgtggtatcctgtgcatttctttggtgacttaagacatagagcattttccagatctctgtgggctgtttggatatcctttcctctgttttctcaggcacattctttaccgatgtctttgagggattgagcaagtttctgttgaaattgaggcatgtcatggctctgtgtggggcttgaggcagtccagtgtagtggagggagggaggctgtggagcctggctgcctaggttcaaataccaactctgcttatttccattcatatcattttaggcaaatcacttagccccctgggcctgcctttcctcatcagtaaaagtggtataacattagtgcctgcattgtggggtggttgtgaggaaagcagcactcaaaacagtacctgacacacagtgggtgccaaataagagtctgatgtattagtgttataggtatcggcctcctccctccccagtgcaatagtgtgtgtgcgcctctgtgtacctctgttggtgctgacaagccctttttaaaatttagaggtgaggtctcactctgtcccctaggctggagcacagtggtgcaatcatggctcactgcagcctcaaccgcctgggctcaagcaatcctcccagcttagcctcctgagtagttgggactatcggtgtgcaccaccacacctggcccttagacagcccctttatttcaaagcgaaatggcagccacaagatttagtgcaagctctccaagctttaggaccagctgcaactcctctaactgaccaaacaggatcccccatgtccccaacccccaaaacctgatgaaaagcaaacagaccattttccacattcatgacggaaaggcccttttcttggctcctgcccttgctcatgtcaggatttcactccatccctgataaagaggaagcaccatgtcccaggaggacatggaaactctctgctttgtggtgaatagttacagtaacagtagctcctctctgtggggagcttatgagcccctaagctttatagaactgccctggcagtttatgagaacttcatcccagcccccagagctcatggcacttatttttgcccccagtttgcagatgtgcacactgagactcagagagctaacactgcttgccaaggtcacacatctagcaaatggagaaactttatgagacaggtgaaggcacagcaaggataaaaacccagagggaaaaatactcaagttttctccgggaaaccatttgcattccagagaggttggtgtgcgagtgggcaagagatgtcgcgggacgatggttaagggacagagtctgagctcaactaggactaggtttcttcctttccttccttccttcctttcttccttccttcttcctttcctttgtctttctctccctcccttccttcttcctttccttcctttcctttctctttccctccctccctcccttccttcttccttccttactcctttccttccttcctcctttccttcctttcctttctctttccctccttccctccctcccttcttccttcctttctttccttccttcctttttcctttctctttcctttctttcctttccttccttcctctcttcttccttcttttctttctttcttttctctttctttctttctttctttctttctttctttctttctttcctttctttctctctctctctctttctttccttctttctccttccttccttccttcttttcttttcttttcctttcttttcttttgttttttgagatggagtctcgctctgttgcccaggctggagtgcaatggcacaatctcagctcactgcaacctctgcctcccggttcaagcaattttcctgccttggcctcccaagtggctgggactacaggcacgcgccaccacacccagctaatttttgcatttttagtagagatggagtttcaccatgttggccaagctggtctcgacctcttgacctcgtgatcctcctgcctcagcctcccaaagtgctggcattacaggcgtgagctaccacgcctgggctaggactaggtttctatcggtggtgtggcttttgggaagctacctaatcttaaccactctgtttcgtcatctataagataagcagtgtagcattttcttgcaggaatgttgcaaggattaagtggatggtgactgtaaaacatcatgcgtggcacatagtaaattctcagcaggtagtcattgctggtcatttacttttctctaatgaccagcaagctcttaatttcctccttggcatgggcactgggacgtagatggacaaaacacagagagaaataaacacacggacaaaaatccccgccctggtgtggctgatattctgggtggggagagagagggagtccaaggaccagataaacaggtaaaggatagtttgagtgtggtaagtactaaggctcaaaaataaagatctcccaggtgatcttagctgcatttggaggtgacaggagatacaactgagaaactgagataggaggaaacccaaggggagatgtgggcttgatttagggtgatctgaggagtaggagaagtcaggggctggtgtggggaggctctgatggttctctctggggagtgaagcagggattcgttggggagacccaaggggacaggtgaaggcccctgaacaggtggccagtgctgagaaaggaaaggtggaggacccaagtgagttcctaatttcttcattgctcccctaaggtgtttgtctcacccttggccatagtcttggatcacttacagatgcagaccaggctgggctcaatggcttgtgcctgtaatcccagcactttgagaggctgaacccaggagtttgagagcaggctgggcaacatggtgaaaccccgtctctacaaaaaaatacaaaaattggccgagggtgttggcacatgcctgtagtcccagctacttgggaggctgaggtaggaggatctcttgagcccgggagacctatgctgccaaataaggtaggcagtagccacacatggctattgcaattttagaaattaattacaggccacatgtggtggctcacacctgtaatcccaacactttgggaggccgaggcgggcagatcatgaggtcaggagatcgagatcatcctggccaacatggtgaaaccccatctctactaaaaatacaaaaattagctgggcatggtggtgcacacccgcagtcccagctactcgggagactgaggcaggagaattgcttgaacccaggaggcagaggctgcagtgagctgagattgcaccactgcactccagcctgggcaacagagagagactccgtctcaaaaaaaaaaaaaaaaaaaaaaaaaagaaaagaaaagaaattaattacaataaaaacagtccctgagtttcactggccacatttgaagtgcccgatgaccctgtgtggcttagtgaccactgtgctgaatagtgcagatctagagcatcctactggacatgttgccagggtccctgaaccaacagaattagcatctcctgggagcttgttggaaatgcagaatctcatcccctaccccagacctgctcaatcccaatctgctcttcagtgagattcctcaggtgatcttgactgcaccttctaatcacttggaagctttaaaaatgctgaggctgggcacggtggctcacgtgtgtaatcccagcactttaagaggccaaggcgggtggatcacctgaggtcagaagtttgagaccagcctggccaacatggtgaaactccatctctactaaaaattacaaaaattacccaggtgtggtggcacacacctgtagtcccagctacttgggaggctgaggcaggagaactgcttgaacctgggaggtggaggttgcagtaagctgagatggcactgctgcactccagcctgggtgacagagtgggactctgtctcaaaaaaaaaaaaaaaaaaaaaaaaaagaaaagaaaaaggaaaatgctgatgccccaagctccacccccacagatgctggagagatttgtccagggcttcccctggagtggggaatgtttgaaaactccccaagggtttctaaagttcagccagagttagcagaaagcccattaggtggctaagcaggtagactgaagttggagctgtgtgaccttgggcaagccacttaccctctctgaaccacaagctcccttctctctaaaactagagacctgctggcacctccctcccagggctgtgagaagtaaatgatgggatgattcaaagtgctgagtagggtcagatgcagtggctcacacctataatcctagcactttgggacgctgaaatgggaggattgcttgaagccaggagtttgagaccagcctgggcaacatttaaacattacccaggtgtagtggtgcatgcctgtagtcctagctgcttgggaggccgaggtggggggatcccttgagcccaggagttcaaggctgcagtgaacaatgatggtgccactgcactccagcctgggggacaagagtgagaccctatttctaaaaaagaaagaaacccaaaatgctgagcgagtgccttggattgatagtaagcagtgcctgtgtaataagcatgaattttaaaaaatgaggtcagcagccttagagctaatggttaatgggtttgggtgtgggatttttttttttttaatttttaaaacattgagataaaattcccataacataaaattgaccattaaccattttaaagtgtacagtttggtggcatttaatacactcagtgttgtgcaaccatcacctctctgtagttcaaagaccccaaaaaggagaccccgtactcactgagcgctcactccctgtctctccccgctcccccagcccctggcaactactaatcttctgtctgtatagattgacctattctgattttgggggtttttgaactcgccttccctggctgacaacctctcgccatccaggtgagactgtgtgaaagcccagctccctgcatttctgggtcttcctctccccactgggggctgcccccacctgtttccccctctgggcaccctggttctactcatcagcctggcttaatcccagcagcaggtccatgttctgctctcctgtggctgccacaaatgagaggtttcatctcagctgggtttctcctagttaaatatttaataaataagacctacaacttgtgatgctgggagtgtttgatagtgaaattaatgatggggagagagtggcaggcggcccacaggtccatgctggagctgggatgaggcgccctgggcaggcgtccgtgccactgatgcttgggaaccacggtgggccatgccatcccatttcccccagccagggcctcttttttagcactgtgtccagcacagggtagccacctgataaataagtgttaaaagaaagagaggctgcgtgtgtagggaagaaggaagagacagaggagacaaagaggagacacagagagagagagagagatgagagagaaagaaaagtggaaggtgagaaagagacagagatggaaggggagagaaggacctggatggaggaagtgcaaggaaggcaatggtgagggaaaagagagagagacaaagatggaagggatgaaggagagggagagatatggaggtagagaaagagagacagaaagaagagagagaatattgcttcttgtatcttccccttctcctgttatccttgaccatcttattatttttttcttttttctgtctctccagttctcatttccttaccctcgccgtcttgccaactcgtcatctcttttcatttcctgtgtctatgttatcttttaattttctgtctgggtattttccccttttctctttctcagcataaactgttggttggtgtatgtgtcttctttcttttttagtctttaactgacgtgtgtgtgtatgtgtgtgtgtgagagagagagagacagacagacagagagagagagagagagacagaacaaacctagagagcagtgtaggaacatagatgaacattttaaagaccaaaccatgaagcgtacacccattttacccaggtcaagagccacagggccaccatcagattctccctcatgctcatcctcaatcacagccactccttccctcctggaggaaccactattggagattgtatgggaaccattcgcttgctttcttgtgtggttgtaccacctaagtacgcatcctgaagcaatatagtcagatattatgtggttttgagttttatatgaataaaatcatgtgagaggagttgttttgtattttgcttcattggtttgcagttacctttgtgagatttcatcctcattgtggtcactgcagctccttcatgatcttgtttattcattgatgatgagcatgtgactttgttctcttttgggcactggcataagcagctttgttggttgtttatggattctgctgctcgcttgcaggggtctctctggagcacatcgctctgtgtgaaattgttggatactaagatttgtacattttcaccttgactaaacactgccaaacaattttccaaagtgcttgtgctaatttacactcctgccggtggtgggtgagcattcaagatgcttcacaaccttgccaacacttggtattgtcaggtttttaagttatagcctttctcatggtgatttctcattgtgattttagtttgcatcccccgattgcaaattagagtgaacatagtttaaaatatttattgactattcaagcttgcttttttgtgaagtgcctctacatgctctgtccatttttgattaggtcacttttaaaaaaaaaatattgatttgtgggtgatccttacatagcctggaaactgattcttcatcattatatgttgtgcaatattttctcttggcttggcttttgatcttttttataatgtcttttgatcaccaacagttcttaattttgatgtggttgattttagaaatcttttcctttatagtttgtgggctttgtatcttatttaagaaaatcatttctaccctgaggccatggatatattttatgttatttctgaaagttttacagttgtgttcactgtatgtctttaatcagcttgggattgatttttatatgtggtggtaggtaggggtccaatttcctttttattccataagaattgtcccagcatcatttattaaaaagcccattcttgccccaatgatctgcaagacaacctcttgactgtttaacttttaccttctttcatctggtctgtttttatactcaacctttgaagccacaaatatttattgagtgccaactgtgtgccaggcactgagttacagtgacggatatgacagatgcaatcatggctttcatggagtttacagtctggcaaggatgacatgtaaatagttattactacttataatttaaaatgttataggccttgcaaaaagggacaagtctggcttgctctaaaagaaacatgtgaaacaacatcttccagggaagtgctgataaactgagtctttagtgggcctctgctattgtaggggtgggaatggtggaaaagatgttttggccacagggaacagcatgtgcaaaggtcctgtggaaggtgcttaggagtttgatatttatcctaaaggcactgtcaggctactgaagcagtaatacaatgattttatgtctgtgaatagttccactggttgctgcatggagaatgtattggaatacagcaagaataaaaagccatgagaccaattaggaaatgatttcactcattcagggaagtgtgccttgggctggcatggtggctgtggagatggaaatcattgatcagattaaaagaaattttgagctggcatgatttttcccctctctcccctctctctatctctgtttcttttctggttgtgttttctgggtgagaaaagcagtttgtgatcctgccaagggtatgtgctctggaggatgtatttgccacagatggtctttggaattctggccaagagagtcactggacagcccctggcccccagggtttctggagccaattcaacaatgactgtttattaacaacagcaaggatgagttgctagcctttccttcagagcaccttttaactgttaccttactttgttacccaaaccgacactatggaattggtgggggagaagtggaagggtttttatctccattttttatagaacgggggaagttaattggcactcttgaaatcatacaaaagatgttggtttcaggattggtttctggactttcagcccaatcccaattactcaagctcacacacccaatccccaaacatactcttttgcaaataatttccctactgaggtgctcctggccaatttaaaaggtccccatttccttgcctataaaatgggaattaaagtaaaaatatctacctgttgacttgctgtgaggtcagtgggcctgacacatggtgtggactcattatatttacctatgtgaatcccttagttccctttacttggaagaggtggaaaactcaaaggggcttaaacaagaagtggggattgtattggctcatgagactgaagagtctcaggagtgtccagcttcaggcttgtttggatctagggatcagataacaccattaggcctctgtttctgtttcttggctctactttttgcagctggctccattatccatgacttagctgcacttccagccctccagtctgcccaagaccatattcagagagagattcttctctctttttcagctatcttcccggaattttcagcaaatgctttcttgcttttgattggctgttgctgaggtcgtgtgctcatgccagaaccaatcactgtggggaaatgggaggtggagaacggggtgctctgattggcttaggcttgggtcacatgactttatggagttggggtggagccaacttctccaagtggggaagagcagtcttcttaaaggtgtattaggatatgcttgctgctgtaacaagcaacccccaagtctgcagtagcttaaggcaatacgaatgtacttctcactcaccctaaatccaatcagataatcagcaagtggcattccatgtggtgatttcaggacccggctctttccatctgtggctccaccatcccctaagatcagaaagtccttcacttccggcctgtaggaaaagagtatgaaggctcacacaggaagttttgggaggccacatatagaagtagtgaaccttacttctgcctgcattctgtggactggaatttcatcccatggtgtatgagagagggtcccagtaggaaacggaagacacagaccaagaatcaaattaagagatagcttaagaatcaaattaagagatagcttacaaaggtgtgggcccttactgaaatagagaaggaggaagagaggaaggaggcagagacagagagagactgagactcacaaagacacacacacacacacacacacacacacacacacacacacacacacaagttgagagaaagaaggggggagagaaagagagagagggagcatttcctaacaggaagctggcagaataaatgtcccccattgtccaaagccagagggctgggagcccagtgagcccatccacacaggtcagccccccatgtgacagtcctagaagggtaaagaaggaaggagagtggatttggggtaatggaagacagccaatacccatggtccatctgactgcagggggaactgagaaattcagtccatggagaagaaggtttagtggacacgtcactttgtctttttcacaaagtgaaactaggttctcaggtggaaaaaagaaaaagaaggtttgccttgctgctattctttttttttttttgagacggagtctcactctgtcacccaagcgggagtgcagtggcacgatctcggctcactggaagctctgcctcctgggttcacgccattctcctgcctcagcctcccgagtagctgggactacaggcacccaccaccacgcccggctagtttttttgtattttagtagagacggggtttcactgctagccaggatggtctcgatctcctgacctcgtgatccgcccgcctcagcctcccaaaatgctgggattacagacgtgagccaccgcacccggcctccttactgctattcttattattggtggtagcagtggtggtgatggttattggttcttagttccctctacatgccagtatctgctctcttctttttttctcccttacttctttccttgttctgcaaattctttccctttaagtgaaaatctttccgtgttctccaagggagataaattctatgccaagcttgagtgtggggtcctctgcttggatagctgtcttctccaggagatgaggtagaactgagatagtgggggtctctgcaggcagtctgtgcccctggcaagcccctcaccttaacctgaggctgggtggggaaagatgccttgatggagtcagaacagaaagcaagtgatcgctgcctgaaccaagcagtcactttcctggaggtgaaacctagaaacggtccctcaggctgggtccagggaggtggacttgggtcccaggggcaggaagcaacctgcccctcacctgctcctacctctttgtagcctatcttggcaaccagaagtaggtatacaagtgacgttgaagctgggcatgttaacaatggtgtgagcccgcctgactccaatctggtccagctgtactggccgtgcatcctcatctccagcccccagggtcagcccagcggctgtaacaatggtctgtcccctccccgccccacccacttctttgaactcctccaaggatctgtgatgatagggctgtcactgtcttagcttccaccattcaagcttaaccggccttcttcccctccatggagaacggaagagcaacccctcattgcctctggcagctgaccagcaggtccctgccttctgcccactcccaggtctaggacaatgaggtgagaggtagacaggaccaagttccccagtgctgtcttctaggtccacctatcatgagagccgtgattcctagtttttatcaccctctccccaactttgccagctctccacttctggcagtggtggctgcccatgacttcaccttcccgtgcctcagtttcctcatctgtaaaataaggacagccatggtaatgagagttctggtcaatatgccaggcacctcgcttgcatcaatttagctcatcctttcagtgccctgaggggtgggtactgttatcatcccgtgtaacaaaaagagaaaaccgaaacagagagagagactcactatctgaggtcttgcacccctcaagcaacaaaagtgggatttcagcctaggctatctagattcggagtccacggtctcaatgaataataacaacaataataatattgtcctaatctgatgagtttttgatcagattcaatacaagagcataggcagaaaagcttagcccagtgcccagcacatggtaagaactcagcatgttatttataatagtaataaaccattttatgttatgtaattatatattcatagataaatatagttgactcttgaacaacataggggttggggcaatgacctcctgtgcagtcaaaaatgtgtgtgtaactttttttctctattttttagaaattttaaaattagagacaaggtctcgcttttgttgctcaggttgatctcgaactcctgggctcaagtgatcctcctgcctcagcctctcaaagtgctaggattacaggtgtgagcccccgcacccagcctgtgtataacttctgactcccccaaagcttaactactaacagtctattcttgaccagaagccttaccagtaacataaacagtcgatgaagacagattttatatgttatatgcattatatactgtattcttacaataaagtaagctagggaggagaaagtattattttaagaaaatcataaggaagagaaaatatatttactattcattaattggaaagggatcattataaaggtcttcatcctcattgtcttcacattaagtaggctgaagaagaggaggagttggtcttgttgtctcaggggtggcagaggtggaggtggaaggggaggccagaaagacaagcacgcttggtgtaactgttattggaaacaaatctacataagtggacccataaaattcaaacctgagttgttcaggggtcaactatatatgctacaaatacgtaatatgctaatatagttgtatgttattgttatagtacggggatcagaaaatgttttctgcaaaggattagctagaaaatgtctagtaaatactgtctctttgggaccactctactctgccattatagcaaaggcagctacaggcaatacgtaaatgaatgggcatggccatttgccaataaaactttgtttacacaaacaagccatgggccagagtttgtcaacggctggtatagtatatgttattatatattagctttactttttctgttgctttgtttatgttcttctttgcccttcctttcttaaaggccagcctttctttctctctgttggtctgtcttttaggacagcatggcaggccactgggacatgggctctcctgactccaggcttgtttgtctgataagacatgaagagtgaaggtggcaggactctgagctcaggcctgtcctcctcctcttccctctcttcgttttttctttcctctttcctcttttcttcccaagctccagaagttgccattttcctttcccattgctgattttctctgccttgggagaaagcccgagaagatcacttggaaaagcccacgagcatctctggcctcactcacccagctcctgccattgtctttactcttcctcagacacaccaggcacagtcctacctcagggcctttgcactggctgtttcctctgtctgcattgttcttctctcaggtgacctcatggcttctccctcctctccttcaggacttcactcaaaggccaccttctcagcatttgcctcccgcccttctgccttattttcccctttggaacttttcaccttcttacttactcatctgtctgctatctgtcaccctacatcactatgatctccacaagggaaggtgattttattcgttttttgttctgttttgttgaagatgaggttttgctcttgttacccaggctggagtgtggtggcacgatctgggctcactgcaacctccacctcccggattcaagtgagtctcctgcctcagcctcctgagtagctgggattacaggcacccaccaccatgcctggctaatttttgtatttttagtacagatggggtttcaccatgttggccaggctgatctcaaactcctgacctcaggtgatccacccacctcagccttccaaagtgctgggattactgtgagccaccacacctgatcttttggttttacccaccaatgtggactagaacagcctagatcagcaggtggcatgcagtaagcagttgataaatatgtgttggatgagtgagcactgtggcttctgtcattctgttgctcaatagcattcatctggaaataaccacagtttgtttatccatttacctgttgattggcatttctgttgattctcgtttgggccattatgaacaaagctgctgtgaaatacttatacctttgcccaattcttcacttggtgaacccttataaatcctttaggccaggtgtggtagctcacgcttgtaaccccagcactttgggaagccgaggtaggaggatcgctggaggccaggagttcaaaaccagcctgggtaacatagcaagacccgtctctacaaaaaaataaaaaattggctggacgtggcaatgcatgcctgtagttccagctacttaggaggctgaggtgggaagagtgcctgagcccaggagttcaagaccgcagtgagtgatcgcgtcctgcactccaggctgggcgatagagtgagaccctgtctgtaaaaatgacagcaacaacaacaataataaaacctttaggtttcctcttaaaaggaacatccttagagcttttcctgacccagcaactcaccccaagtctgaattagacttcaccccatttctttcataacatttatcacaatgacatgtttattttgtgggggcgggtggcattctggccagaactgtcgacttccagagtgaaaatacggaagaaccaaataaaacacaacacacacatttgcacagcagctcgagggaggtgcttagttctttgagtttccaagaacagagagacgaagatttgtctggggaggaaaaatcagggactgcttcttggaggaggtggactgttgctgccccatccacccacacatttgcagatgtggtgatgagaagatgactgtcacgaggtctctgagcccagggggcccatggttgagtgcaaagatagtggggttgacaaataatcgtcgtataacaaaagaaaagccaccacagttgcataatggaaaggcggcttctatagaacattcagatcatagttgaaggcatgtcacactgtgttactcagaggccactgtcagagccaaaagtgagagtggatgagagtttgggcaggaaacaactgaaccagatacagcatcacctccatgagggctcagctttatctattttgtcttctgttgcatccccagcccttagaacactgcctggtccatctttgctgtgtgaataataataaggaacgatcgctgtgttgagtttgggctgtgaattcagacagtttgctgctgcatacctgattatgagtctcagttttcctcctccataaaatgggcaaaacagtccttgcctcatggggctgtgcatttgtttagcaaacactgaaggagtatacatggtggccaaggcactcttcaagacacaggaagcagacaaaagtccctgccctctgggagcttacatgctcatggggagagatgtatgataagaaacaaaaatagtaggtaagttgcatagtactttagaagattataagggtaatgggaagagaacagcagagaaagggctggggaggcagttgctgtattagatagagctttatcgaggcgatggcattggagccaagacttgaggaagctgtgaggatgtctagagaaagaaggaacagctggtgcaaaggccctgaggtaggggtatatgtgacatgtgtgacagtgaggaggcagatgtggctgaagccagtgagcaagagagagggaaggtgcaaggataaggacagagaggtgacgggacaggttttggagggccttatgggctgcggggaggactttggcttttgctctgagggagctgggagccacggagggcttttgagcagaggagggacgtgacctgactcagatattcataggctcctctggctgctgtgaaaagaacagactttgaaggttgggggcaggcagggcagaagctggggaattaggaaggaggtgacagtgttggtcctggcaggtaatagtgggggtggaaccaggttgttgtctgtggagataataatgagtggctggattctggttataatttttaagtttttttattgtgataaaatgaatttttttattgtgataaaatgaaatttaccactttgaggtgtgcaattccacagcacttactacagtcaccctgttatgcaacagtcacctctatttaatctcagaacatttcatcccccctaaaggaaaccctgcacccattagtagttacttccagtttctcccttcccccagcttctggaaactactaattctggatataagttgaaagttgaccagtaggatttctaggcagacaggtggtgagggctcaatgcattcatgcacagaaagtactcaggtggcatatcataggtgctcaaaactgaaatggtgatgatgagttggcaatgatggtgagtccttccagaatccctgctctagtgctaaactgacctacctggctgtgtagaattctcacctgctggccgggagggtggcagaaccaggatcccttcttacttccagtctggcttgggttagggataggggaggaatgatcagaagaaccaagctagcaccatctgttctggaacatcatccaactcttgtccagatttcccagaactgagcaggaaaatgtccagggaggaacagtgcagctgatggaagtcctggtaagccctggccccagcttcctgagctgctgttgcaccaactagcatttgttggaccttcagtctgagccaagatggcagcttcagaggaagaacaagaagtgtacaagtttctttcatggttgtgtccccgcctccttatatagcctcatataaacccctgcactatcccgttactgtttgcctctccctgaaaagagtgtaaaactcccccactttttccctacttttcacaatgtgttttggtttctaaagatgaaactcctttaattatgttctggttgtaattttctggctccttttatttctcccttacttgatgtattattttcccttgttccttctgccccctgcctccattgatgtttctcttcactgctatctagatttaattctcaactcctgccaagttcagggtgatagtgcaaaaagacatggaccatttagtcttgaattcaggtcccacttctgacaccttcaaagctgctttactttgggcaagtcatatgatcttcctgagggggtatcctttaccttgttcagctaacatttcttgtttttctctgggcacagagtagagtgtcattttccccacctccctgaagttaggtatggctgtgtgatttggtttcatcaatgaaatgtgaggggaagtgacgtgagtccttccggacagaagccttaagggtgagcatgggattcaccatgtttcctttttcctgcctccactgtcatggatgcacaaagatggaccctctctcaaagtaagtgctggagagaggatgacatagatcagtccccatcccacttcatagcatgagtagaaaaatagacctggggtgtgttcaaccactgagatctggggattgtttgttactgcagcaggacatagactaggctgactgtatacctcattatctgcattttggggctgatatctaatcacagtgtctccaggaagattatgttgatgtatgttttagggatggatattcatattttcctataagggctcaataggtttggaaatgtcacatgcatgtaaacttctgattaacaaatatttcttgctttccaatttcttcctatagtgcttctaattttcctgtttttcaatcttgaataaaatgtgagaagtgtttgacttctccttcgaggagattaatggtttctaaagcctggggcattgatttagtcattctcaacctccttgtttctatgacctttttttctccttctctggtcacttagtgtctgctaaggggtgaaggaatgtctgttttaactcattgcattttttttttttttgagacggagtctccctctgttgcccaggctggagtgcagtggtgtgatgttggctcactgcaacctctgcctcctgggttcaagtgattctcctgcctcagcatcccaagtagctgggactacaggtgtctgccaccactcccggctaatttttgtatttttagtagagacggggtttcaccatattggccaggctggtctcgaactcctgaccttgtgatccgcccgccttggcctcccaaagtgctgggattacaggcgtaagccaccacacctggcaaactctttgcatttttaactcttgacatcttcatcttctttttcccacctcccctttgcctgttcctcccctgctcaccccaccagggagtttataatcaggttctagaacctgcaatgtttttctgttgttgtcttccatcttccttgagtcttatgggaatcggccatagtcgcaaattaacaaatagctctgaagcgcctcaagcttggaggcatttccttttgctcacctaagcaagatcctggagctgttgcaaatatcctgccccctactgtaaatctgtcttcatggttgtaagagattcagtcggggtcagtgaagacccgagcaggagatcttggccgaggctccttgatgttctgtctgcgctgggtgttgtcatattgattaagctcctgggactgctgccagcagcctctaggattaaatcaatagagtttgcaaaagtaaaagcttcttttggagacacagaatatgtgggtttattttttaatgataaagcttcaaggagaatcttcatggatggcagaaccagtgatggaaaaggcgaggcagacccaaatatttggggaagtgcagtggggagcaagtgagggaggtttcattgggaggccggggctttccagaaaatctgtttaactggagttgctaatgcaacagctcagagttagaagtgaaggtggaagatgcaagaaggactgccgctgagatgtaaagagaaatgaaggagaggtggatccatttgctcattcaataaacattttgggaggcaggggggtgggggggagcctgccatgtgcctggaactgggatgtacatggtggggacatgacagtgggcaggacagatgtggttcctcctggccctcctggaacttgtaacaggaaaagaaggcataaaataaggaataggcaaatacagacataattactaattgtggtaagtgtttgggagaaaaccagcagggtcctgtgtttgtttcctagggctgccaggacaaattgccatgaactatatggcttaaaacaacataaatatattgtcacccagttctgaaggctggaagaccaaaatcaaggcatcagcagtgctgagctcccttggacggctctagagaagaatgcttccttgattcttccagtttctggtagttgttagcatacattggcttgattggcttgtggctgcatcactgcagtctctgcctctgtcttcacatggccttctccttcatgtcagtgtcttctcttcctcttctctctctctcttttttttttttttgtcagggcctcactctgtcaccctgtacaagagtacagcagtgcaattatagctcactgcaactgctgcttcccagcatcaaacaatcctcccacctcagcctcctgagcagctgggacttacaggcgtgcaccaccatactcagctaatttttaaatttttgatagagatgggatctcactatattgcccagactggtcttgaacttctgggctcaagtgatcctccctcctcagcctcccgaagtgctgggattacaggtgtgagccactgcacctggcctcttctgtctcttataaggatctttgtcgatggattttgagcccgtcagataatccaggacaatctcatcttgagatctctaatttaattatacttgcagaggccgttttactaaataaggtcatggccagaggctccagaggctaaagcatgggtatgattgcaccactgcactttaggctgggtgacagagcaaggccccatctctgaaaaataaaataaaataagtaacctactacaggccctttgcgtagaggataattagaagtacaggggtaccacgtaagtgaagacctgaaggttgttaagcacagagcagagtgtgaacagaatgagacagagggaggaagagaatcccaggcagagggaacagcatgtgcaaaggccctggggaaggaacaagttcatcatgttaaaaatgagccagtgtagctagagtctgatgagcaaagggactcacaggtgggaagacacccaagaagttggcagagacaggtcacacaagaccttctaggtcaagttccggaggtgaactttattctacatgcaatgagaagtcctcagagaagcttaagtgggatgggacagaactgctttactttaaatatatatacatatatacaaacatataatattacatatataaagcatatatatgtatacatatatacatatctatctacctgtctatatattttttagctgggcatggtggctcacacctgtgatcctagcactttgggaggctgaggtgggaggatcacttgagcccaggagttcaagaccagcctgggcaacatagggagaccccatcactacaaataaaaataaaaattaaaaattagctgggtgtgatagtgtgcacctgtagtcccagctacccgggaggctgaggtaggaggattgctggagccccaaaggttgaggctccagtaagccgtgattgtgcccctgcactctagcttgagcaacagagtgagatcctgtctcaataaaataatttttgtattgaggtgaaattcatgcaacataagttaaccattttaaaatgagcaattcagtggcattcagcgcattcacaatattgtacaacctccacctctttctagtgctgaaatattttcatcaccacccctccagaaaaccctgtatccatgaggcagttgctcctcatcctcccctcccggtatccccccaacccccaccactcctggtaactacaaatttgttttctgtttctatggatttacctatactggctctttcatataaatgaattcaggcactgtgtgacctttcgtgtctggcttctttcacttagcataatgccctggcttctctctggagaatgaaatggatagaccactttggagtctactgagattatagatatttctgtgggaagggacagtggcttgaccttgggtggtgctgaagaggcaatgctgagcaggaggattcaaagtctaatttcggaagtagaattggtggggtctgatgatacatcagctgtagggggaggaagatgtaggaactgggaaggtctcttagggtaaccttacctgattgagctccttactaggcagctggtggtacaattcataacaaaggttaatagagaaagagacatgggattagggagggaatggaagagtttgggccttggacactgtagtggtttgaatcctgtccaccaaaaattcagatgcatttggaacttcagaacctgagacctcatttgaaagtaggatctttgcagatgtcattgagtcagggattgagatgaggtcatcctggattacagtggactcgagattccatggtaagtgcttttatatgagaaggtacaggggagaaagtcatgtggcaatagaagcagagaatggagtgctgcagccacaagccaaaagacatgtagaggcaccaaaagcgggaagaggcaaggaaggatcctcccctagagcctttgaagggaaaccccctaatttcagaaccttgcctccaggatgacgagagaataaatttctgttgttttaagccacccaatctgtggcaatttgtcatgactgccctaggagactaatatagacactcctatgagatgctctaagaagacacagagtggtatagctattgctaagaccacacactgtagcagggaggaaatcaaatggagaaatgccccaactccccctcctctctgatctcttgctggtgcctcccgttggccaagccaacccagaaggcagaagatgtggtggagggcagcgttgcagggcttggatgatgcagtcacagaagtcagccctgcctctaccaggatgccaaacagggcaatgagtggatattttagggagaaagggcaacaagagaatggcaaaatacatcgaaatgcatgcaagctctagaaagaggatagagatagataaagggtgattacctaggattaagccccagggaagaccaacatttagagattggatagaaaaagaggagcaaaaagggaagattgagaagtagagaccaggaggataggaggaaaactagaacaacattaagaagggcatggtcaagtaatctgggcacagaaaaatggccctgggatttggcagcctgggggtctttggtgatcctctttggaagagttttggttgagtgatgggggctagaaaccagcctggggagggtaggagaagaatgtgcagtgaggaagtggcaggaacacgtgaaggcaactcttcatgaaggggagtagagaaattggttggtggctgaaggaaaattttcagtcaagggtggaggttttaatgatggaagaatattgatttctgtaaattgggtcattcccatccattataccaatatgcacgggtgtcttctctgatataggatgctgggattctcaaatgcccatttgagtttagcatcatgaatttaatgtcaccagcccagatagttgatctcattcaggaatgctccactgcccaggtatggggaaggcaactagttgagttcatgcagggatggattttttccaggagagaaacaggaggcaagaaagtgcgatataatcaacctatgtaaggttgacaaggcaggagagggtcctgagaaatggcggggtcagtgggttgcagggctcgatgggatggacgttggtttgcatttaagggagttagtgagctgggaggtggttaaagaggaggtggttcagccgggcgcggtggcccacacctgtaatcgcagcactttggggagccgaggcgggcggatcacaaggtcaggcgatcgagaccatcctggctaacacggtgaaaccctgtctctactaaaaatacaaaaaaaaaaaaaaaaattagccaggcgtggtggcgggcgcctgtagtcccagctactcaggagcctgaggcaggagaatggcgtgaacccgggaggcggagctgctgtactccagcctgggcgacagggcgagactccgtctcaaaaaaaaaaaaaaaaaaaaaaaaaaaagaggtggttcaagacaaggatgctggaaacaggtgttttggaggtggctggtgtagcttctgagcatgcatagctggagtggcttggaggagacattggttattgatgaagaggtagggacatcctccagtgatcaaggaagcaggggaccagcatggacaatggtctctccacagggaaattggaggtcatcaaatgttaacaggttccgtcggagtcttagctcccagcttctgttttcctgtggatctcaggatcttggctgctggtgctacctctgactttggacttcccattgagcccagcagcactgggagggaccttcatggcattggctggtttaaggaagacttccttggctttgctgactttcttgggggccttcttggctacacctgcttttgagggagccctcctcacctcacctgacttcttgggggcaccttttccaccttatctgagttgggaaggtctttctttgattctcttgctttcttggggcccttctcactggtttttctgggggccatgatggtggacatattccagagctgagctttccttttgttcttaggaactaatttgaggctgccagtggccccaccttggtcttagagttgatggtctgcagggaatttccaggttaaaggttttttatttgtttgtttaattttgagacagagtcttgctctgtcacccaggttggagtgcagcggcacgatcttggctcactgcagcctccgcctcctgggttcaaacagttttcctgcctcagcctcctaagtagctgggattacaagcacgcaccaccatgcccagctaacttttgtatttttagtggagacagggtttcaccatgttgaccaagctggtctcaaactcctgatctgaagtgatccggccaccttggcctcccaaagtgctgggattacaggtgtgagccactgcgcctgacctccaggtttaagtttaaaccatgaagtagatggactgtgtagagagagaccagggaaatggaggattttactgaccactgaacagggatgtcactattgccagagaggaaaaggattcccccttggtagagtgaacatataagggaaagtggttgaaaattgaatcaggagacagagacctcacaccactcagaggtccctagagaactttactgacctagaaaaaaagataaacagggagaaggtcttcagttcttgtttggaatctgacactgaagcatcctcactcctcactctcttcccgaccccgagagtctgaaattgattaatactttttgtttaaaacttggcttgttgttttgttttttctttctgttttcatcaagggatctttattttacttttgtgtatttgtgtgttttccatgagtcatgttaattcttccatgtttaaactttttggcccagaggaatttatacatttaaattatggatttaatttcagaaggtacatacacacacacacacacacactcactcatctcactttttaaaaactgtaaaatatagccctgtaaatatccagaaaatatctaatgtgggccgggtatggtggctcatgcctgtaatctcagcactttgggaggccgaggtgggtggatcacctgaggtcaggagttcgagactagcctggccaacgtggtgaaaccctatcctcactaaaaataaaaaaattagctgggcatggtggcaggtgcctgtaatcccagctactcgggaggatgagacaggagaatcacttgaacccaggaggcagaggctgcagtgagccgagatcaccccactgcgccccagcctgggcgacagactgagactctgtctcacaaaaaaaaaaaaagaaaagaaaaagtcagtgtgcatcccctctgacatccagcaacttcacatcttggaatttatgctgcaggaaaattatcacaagtgcacaaggatgtatggtgagatagttattattatcattttaaaagatagggtctcactgtgtcacccaggctggagtgcagtgaagtgatcacagctcactgcagccttgaccttctgggctcgagtgatcctcgtgcctcagcctccccagtagctgggattacaggtgtgagccaccatgcctggcatccccctttttttaaaaaaaggttttaattatgaaaagaatatgggcttgttgttttgtgtggttttttaaaagcttaaaaaatgtgtagtgtgtcatttagaaggtgaaaagcccttaccccatcccacctcccagagataacctctgctagcaatttcgtgtttgtctttcaaattttttcccacacacattctttgtactggctgcttcccctcctgggttactcttctcccagacagaaacagggctcattcccttgcctcctccagcttttattaaaacattaacttccctgtagctggatgcagtggctcacgcctgtaatcccagtgttttgggaggtggggaggcaggaggatagcttgagcccaggagtttgagactagcctgggcaacatagcgagacccatctctacaaataaataaataaataaataaataaataaataaataatggaaatttaaaagagagagggaaggactcttgaaaaccgtccatatcatgcttctctaaatggttgagggctcagaggaaaaaaaatcagcaatttcacatcacggaatttattctgcagaaaaattctcacaagtgcacaaggatgcgtggtcagatgatgatgatgatgattattattattattattgaagaaagtagcagcagcagcagcagtattttaaaagacagagtctcggatgggcatggtggctcacgcctgtaatcccagcactttgggaggttgaggtgggcagatcacttgaggtcaggagttcgagaccagtctggccaacatggtgaaaccccaactctactaaaaatgcaaaaattagccaggtatggtggtgggtgcctgcagtcccagctaccagggaggctgaggcacgagaatagcttgaacccaggaaatggaggctgcagtgagccaagatcgtgccactgcactccatgcactccagcctgggtgctgacccaggttaggtgcaagactccgtcttaaaaaaaaagaaaaggaaaaaaaaaaaaaaaggacagagcctcactgtgtcgcccagggtaaagtgcaatgagtaaaggcccatgatgggaaccctgaggagagagtcaaggggaaagaaaaaaaaaaaagcaaaaccaaaatggaatttaaaaaaaatcaggtgcaatttgcataacagaaaattaaccattttaaagtgaacggctctgtggcatttactgcactccaactgttatgtaactaccacctctgtctagctccagaacattttcaccacccctaaaggagaccttgtacccattaagcagtctctctccttctcccctccccaccaccttcctccagcctctggcaaccacccatctgcattctgtctctatggatttacctattctaggtagtcaacaggatgagatatcccaaaagtccatccatggatgaacagataaaccaagtgtgatatgccttcctcagatattagtctgccttaaaaaggaatgaaatactaatctttgctacaacatagatgaacctcaaaaatatgatgtggctggacacagtggcttacacctgtaatcccagaactttgggaggctgaggtgggcggatcgcttgagcccaggtgttcaagaccaccctgggtaacatagcaaaactccatctctacaaaacaatttacaaaaaactagccaggtgtggtgacatgtgcctgtagtcccagctattcaggagactgaggcgagaggatcgattgagcccaggaggccgaggctgcagtgagccatgatcataccactgcactccagcctaggcaacagagtgagaccctatctcaaaaaacaaaacaaaacaaaacaaaaaagttgatgctgagtgaaagaagccagacacaaaaggcaacatcgtgtttaattccatttacatgaaatgtccaatgaagattttttttggcaacatttattttgagtataatattcagtgagtggaccacacatatgcatgcactgcagtatgttcttggaaacatttcagatttgagaggtctgttcagctatgatgacggtaggtattgtcccttccctccctccttgaagaaaaggaactaaggctggacgcggtggctcatgcctgtaatcccagtactttgggaggctgaggtgggcagatcacttgaggtcaggagttcaagactagcctggccaacatggtgaaaccatgtctctactaaaaaatacaaaaaattagccaggtatggtgctgcacgcctgtagtcccagctactcgggaggctgaggcaggagaattgctcgcacccaggaggtggaggctgcagtcaaccgagattgcaccattgcactccagcctgggtggcagagcaagactctgtctcaaaaagaaaagagaagagaagagaaaagaaaagaaaccaaaagaaaaggaaagaaaagaaaaggaaccaagacctagaagggcaaaaataggaaaagttggccgggcgcagtggctcacgcctgtaatcccagcactttgggaggccaaggtgggcagatcacaaggtcaggagatcgagaccaccctggctaacacggtgaaaccccgtctctactaaaaatactaaaaattagccgggcgcggtggcaggcgcctgtaatcccagctactcgggaggctgaggcaggagaatggcgtgaacctgggaggcggagcttgcagtgagccgagatagcaccactgcagtctggcctgggcgaaagagcaagactcggtctctaaaaaaaaaaaaaaaaaaaaaattggaaaagttatttactattagcagcaattgtcataaagtaatgaacatttattgcatgattacaatgagataaattgtatcctgtttttataagcatattaagttttcttttttaaaaaaatgtatgtatttatttattttaagagatagggtcttgctctgttgcccagactggagtgccatggtatgatcatagctcaatgcagcctcaaattcccaggttcaagcaatcttcttgcctcagtctctcgagtagctaggactacaggcatgtgccaacatgcctggctagttttcttatttttaaatgtatttttgtagagacaggatcttgctgtgtcgcccaggctgtcctcaaactcctggcctcaagcgatcctctgccttggcctcccaaagggctgagatgataggcatctacctctgcatttggcccacattaaattttctagtcatcatgggaaccaaaataaacaatataaaacactcacattccttgagcacttactatatgcagggccctgtaatagattattgtgtgtatcagctcattccattctcacacaacctatgaggttgatgctattttctaccttttatatatgaggaaactgaggctcagagaaggaaactgccttgcccaaggtcaaggccacgtctgatccccaaatcctttcaactcctctgcactactattttttagtgcagatattgccagttttctaagcagaagcatgatttagcagccctgagtagacttctcatttcagaaccaaagtgttggacattgttggataatatgaaaaacaaatgacacacaaacctatttgatactgtttttaattttctcttcatttgattttcctgatgacatgattaatcttttttgcctctaccctgtatgtgaaatgtaggtctttgcagatgtctcagagagtgttaatagttgctgctggttttgttttctctccccggggattcccatccctgggtgcaagtgaaattaaacttgtgcctctttgccgctggccgtggtgctgaaaacatcccgggcagcgctagggttgcccttgttagcatgccatccctgctaagagtcttaggctgatcagcgagtggagagatcttttccaggcttcattttggttagaactgtgtgttgaagattttaaagcccatgtctgggaactggagactgtttggattgtttgaagttgaaatagtcatgaataattcctacttgagatgggcttatgagggcgtggactagcatgcaatggttggcctttactaaactgtggccattggttgggacttgggtgaggtgtaacccatttggtctaatccatatggttagggccccaagtgcacctgcattctatttttttttttttttaaataaaggcaaacccatctatcttctaaccaggatagctcctgagtggtctttggggaccaccagcttaaaagcatagactgtgggctgggcacagtggctcatacctgtaatcccagcactttgaaaggccaaggtgagaggatcgcttgagcccaggagttcaagaccagcctaggcaacatggtgagaccctcatctctacaaaaatgttaaaagttagccaggtgtgttggcatgcacctatagtcccagctactcaggaggctgaagtgggtggatcgcttgagcctgggaggtcaaggctacagtgagctgtgatcgtgccactgtatttcaccctgggcaacagagcaagaccctaactcaaacaaacaaacaaaaaaaggcatagactgtggagttgggcagacctgggtgtgagccccagctctgccagtacctcctatgtgaccttgaaaatttgtttaatctctctgagcctggattttcttgtgtggaaaatgaggcttaccacagaacccaccttgtagaaatgttgcaaggaattaactgaaacaaagtgcttaccacggtatctgcccaaagaagcagttggaaacaaggcagctgtaattatggtcgctgtgcttgttaatggccccataatagttgatcatattgcagagtgaaattggggtatgtgtttaatggaccaaggaatatgtcttaaacccatatatctagggttctggtaccctctactctttttcctggtgattgtgatgagcatggaacttacatgaaaatgaggtctgtttggcttcttcacacaagctcaatgacctggctaactgctacaagtatctgtttccttagaacccacccatcagcagtccccatagtggagacaaggtcacaaagagttgacaaacctgatttgatttccgcaccaaccacaggaggcttgaaatgagatgagggtgaagggcaccacagagggatgcaaggattacttggacactgcaaggtcttgctaagggatgggaaccatcagccacgcccactttgagaattttccttcatgttctgaatctgaagagcaaggtcctgttctcagatgcaagccctccttcttccctacgcagagtcaaacttggtcttttccagggtcacatacagcctctctctggggcctctgcaggtcctgatcaatttcattgtgtatagagctctgtgtctcctcacctgcctgcagggctgtctgctatcctgacttccgagagccatttcggaagccagcttttcctcccatcagggatgcttctcttctttcagcccccgccccgctttggcctcctaggatggctgatttttctggatcccgctgacacaggtgctttctctccgagccaatcagggagcagaaaggctcagctcagctaacagaggcattgctcaccgcagctgtgagttagaactcaggctttctaaatcgggaggatcaggcatgacttgaggttgggctgagaaagcctcgcctgccccccagctcgactacccagtgaaacctttggcttctgcctcgggcgaggcatctcttaccatgccaagaactcagcagcccatctttctttcatctgggcaccaagtacatcattgcatatttcagggggtttcattgtgtccttaacatgctcatggagacttggcttgagatgaagtcggggtttctaggcagcaggacccatgtccccttccttcatttcctccaccggtgatttttgttttgttttgttttgttttgttttgttttgttttgtttttgagacggagtctcgttctgttgtccaggctggagtgcagtggcgttatctcggctcactgcaaactctgcttcccgggttcaggtgattctcctgcctcagcctcccaagtagctgagattacaggcgtctgccactatgcccagctaatttttgtatttttagtagagacggggtttcaccatgttggccaggctggtctcgaactcctgacctctggtgatccacccgcctcggcctcccaaagtgctgggattacaggtgtgagccaccgcaccaggcccttccactggtgttttttgagcatctactatatagagaatgctctcctgggcacagaggatgaagcagtgaacaaagtagacaaaaaatccccacgtgcatagagtgtgcagtctcgtgggagagacagggaacaagataaagaaggaaaaaaatagcagatgcttgactggggacggggactaaagaaagaaaaaaataagcaggctaagggggttgatggatgtgacctttgagtaaaggcctaaaggaagtgagggagggagtcatgtggatgtctggggaaagactattccaggagaatgaacagcaggtacaaaggcccctgggtacaaatgtgcctggggagtttggggaataaaagggaggccggcgttgctgtagctgagtgactaagggagagaatagaggagatgaggggagggaggtaatgggagcaggtcatgcaccttgctggtgctggaaggactttgtttttgcttttgagtgagatgggatccatgggaaggctttgaatacttccacatgcattaggctgaaattttcttttctgcttttgtcgcattccaacattgcttttatttcatcaaaatcttcggtttcttctcaggctctttacccaagtgggagcagaaggctggtacccagggctgttcagttctccccctggggtcagaacgtggaggagaaagcttggaggagaaacaggaacccccacctctttctggatgactcaaaaccgcaattacctgagctcctcctcctatccctgaaatagaggcacttagcacttcctaaacttcccggtgcacacaaatcccctggcgatctttttaaatgcaggttctgactcagcaggtggatgcaaggtctaaggctgcattcctaaccggtgctggttctgggaccacactttgagtagcaagggtctgaggtcattgttgcagatgtccatctggggcatgtctgtggacacttgcgggggtgcgggtgagcagagggaggggggatgatgttggaaaagcagtgtgagtatctgtgtttgataagaagtaagaaaatgaagcaaggtgggagagtagaacctctttatttttgcctacgtgctaaggttttattgccatacccagagagccctgggtctgaaatccaggcaacactggccagttgaaaccctgatattgcagcccataaaagtgctgcatgctgcatggtggacttctgggactcttcctggaaccttcagtgccagagccggtccaaaggaagtcacatccctgccattgaggggcaggagaccagggaaccggaggagtgggatggcagaagcgcgtgtaaggaggctgagttggcagggagagaaagcgaagtcagcttcaaatcatagcgagaggagaccagggaagggcttggcgttgctgctctgtgtacaaatattgtctcttattttccaggctgcagggtgaggcagagtggagtatttgtgcaacacagcccagctttgttctctgggctcctaatgcctgtcagctcagaggcagaaagccaatcagagatgatcgtcggcaaggccggcttttgttggctccccaaattgccctgagtctcggattttgcttttcagagtgtgctttcagctggaggcaaaggctgaagctggtgacaaaaggaagcctggttttcctggctttccgagacttttactgagggggtttctatttcagactccgttttcccacctggaaagcaggttccactctccctccggcctggaagggatggttttatggtgcttccaaaatgccaaacctaactccagggcagaagaggagactgaaaccaattaattttccaaaggttagagctacgaggaggggagaggtttagcatggtcaagttccccaagacatactaattgatctctctacagaatgcgggatttcagtgcccccaggggacactcagcaatgtttagagaccacttgaggttgtcatcactggacaggaggggctgctactggcatctagcacacacaggccagggatactgttgaacatgctgcagtgcccagacagccccaccaaggagaatgatccacccctaaacctagtgctgaggttgggaaatcctgctccggagtaaccaacaccctatggctttttcactcaagcagccgcttctccagcgcttacacctcctcagagattgccagatccatatgcagagcctgttggcgtgggacacttctgaggggtgtggcagggagacagcggacattcccatttaccagctgatcagcaggttaggagctaatatgaaatgaacaagatagaccctccccacctgccctgcagatcctctggtgggacactagggagggaggcctcctaaacccaaatgacagttcccaggatgcagggaggagtttacctatgcaaactggagagaatgcaaatggggcatctagagatacttactggacgacccctcccctgcctcgggtcttggaagaacagattctcagaggtctgccctgatcactgtaattttttttttattgaggtaaaattaatataacacaattaaccattttaaagtgacatttagggctgggcacagtggctcatgcctgtaatccccgcactttgggaggctgaggaagaaaggtcgcccaggagttcaagaccaccctgggcaacaaagtaagactctgtctcttacaaaaaaaaaattaggcacacatggtgttgtgcacctgtagtcccagctactcaggaggctgaggcaggaggatcgtttgagcctaggaattcaaggctgcggtgagctatgatcatgccactgcactccagcctgggtgacagagcaaaattgtgtttctttaaaaaaataaaagtaaaaataaataagaaaagaaaggagaggggaggggagaggcgtttagtacactcacaatgttgtgtaactgtcaccttcatctagttctaaaacattaagcagccactcccatttcccttgccattccccaggaacaacaaatctgctgtctgtctctggatttgcctgttcgggatatttcatatacatggaatcatacaatatggggtattttatgtctgcttctttcgcttggcataatgttttcaaggttcattcctgttctatcatgtatcagtacttcattccttttttttttttttttttgaaacggagttttgcttttgttgcccaggctggagtgcaatggcacaatcttggctcactgcaacctccgcctcccgggttcaagcaatcctcctgcctcagcctcctgagtagctgggattacaggcatgcgccaccacacccagctaattttgtactttttttagtagagatggggtttctccatgttggtcatgctggtcttgaactcccaacctcaggtgatctgcctgcctcggccttccaaagtgctgggattacaggcgtgagccactgcacccggcctacttcattcctttttatggctgaatactattccattctatgagtagaccacattttgtttatccattcacccactggtgaaatttaggttgtttccatcttttggctgttgtgaatagtgctgctgtgaatatttgtgtatgagtgttcgttggaatacctgtcttacgatccttttgtgtttataccttggagtggagttactgtgtgtcacatggtaactctgtgattaactttttgaggaaccaaggaatggttttctatggcagttgcactggtgtttttttgttgttgttgtttttgttgttgttgttttgagacagggtctcactcccattgcccaggctggagtgcagtggtgcagtcatggttcactgcagcctcaacctcctggggctcaagcaatcctctctcctcagcctcccaagtagctggcactacaggcctgcgccactatgcccggctaatttttcatattttttgtagagatagagtctcagtttgttgcctaggctggtctcggactcctgtgctcaagtaatcctcctacctcggcctcccaaagtgctgggattacaggcatgagccaccgcatctggccagctacaccattttatattcccaccagcatgagggtttcaatttcttcacatcttcaccaacacttgttttctgtttgtttgtttgtttttaatagctatcctagtggatgtgaagcagtatcccgttggggtttgatttgcacttccctgatcactaataccctcatgtacatattggccatttgactgtcttctttggagaaatgtctattccagcctcctgtccatttttcaattggattatctttttgttgttgtgttgtaaatgttctctctttattttttatttttttgagacagagtctcgctctgtcgcccaggctggagtgcagtggcacgatcttggctcactgcaagctccgcctcccaggttcacgccattctcctgcctcagcctcccgagtagctgggactacagatgcccgctaccacgcccggctaattttttgtatttttttagtagagatagggtttcaccgtgttagccaggatggtctcgatctcctgacctcatgatccacccgccttggcctcccaaagttctgggattacaggcgtgagccaccacacctggccgtaaatgttctttatatagtactagacccttatcagatacatgatttgcaaatagcttctcctattctgttacttgccttttaactttcttgataacgtcctttgatgcacaaaaggtttaaattttgataaagcccagcatatctgttttttcttctgtggatcatgcattaggtgtcaaatctgatcataatgttttatttatttatttacttatttatttattattttatttatttttgagatggagtcttgctctgttgcccaggctagagtgcagtggcatgatctcggctcactgcaacctccacctcccaggttcaagcgattctcctgccccggcctcccaagtagctgggactacaggtgtgtaccaccacgcctggctaatttttgtatttttagtagagacagggtttcaccatgttggccaggctggtctcaaagtcctgaccgcaagtgatccacccaccgcagcctctatctatttttaatttatctctttttttttttttttttttgagacagggcctccttctgtcacccaggctggagtgcagtggtatagtcattgtacactgcagcctctacctcctcggctcaagcaattctctcgcctcagcctcccaagtacctgggaccacaggtgcctgccatcatgctggccctgccaccatatttgaaattgcagccctgaccccttccactgtctatagtcttcaccatcttactacataacatagcatatatgatgtactgtataacatggtatatgcagtgtactgtatagcatagtatacatgatgtagtcatctcatttatttgcttctcctctgggaagcaggaggaagcttctcctcttgtctgctttgctctcaactgtgtccctagcccagaacagagtctggcacacagcaggtactgaatgaatatgtgttcagtgaatattgtgggtgagatagaaggtgaatatccacatttccctttagaagtcacctgatctgggtttgagatctgcagggatctactccagacaggagaacgaataattccacctgtgctgatgagttggaaggatctagagggcttgagatctttccactggggtcagtgggggtgggtgcacctccaacacccttcttttctttgaacaagatttttccttaattccccaatactccctttgaatatatgattttagccaccatcatagcgaattgcatcgtcctcgcactggagcagcatctgcctgatgatgacaagaccccgatgtctgaacggctggtgagtgatgtcttttctcagggtcttctccttggctttagcaggacattaatttttgggggagtggagcagggcacagaggaggctctcagtcctggagcccagagccagatcatgggaagcctaaatttccttttcattttttcttgaaccagagtctcgctctgtcacccaggctggagtgcagtggttcagtcatagctcactgcagcctccacctcctgggctcaagccatcctcccactgcagcctcctgagtagcagggactacaggtgccaccatgcccagttaattttcttatttttatctttttttgtagagatggggatctcactaggttgcttaggctggtctcaaactgcccactttggcatctgacataatttcaggcagtatactcaaatgaacattgttaatgttaataattatgtcttggccagacactgtagctcatgcctgtaatcccagcagtttgggaggccaaggcaggtagatcacttgaggtcaagagttcgagaccatcctgaccaacatggtgaaagcccgtctctactaaaaaaatacaaaattagctggatatggtggtgcacacctgtaatcccagctacttgggaggctgaggcaggagaatcgcttgaacccgggaggcagaggttgcagtaagccaagatcgcaccattgcactccagtctgggcaacaggagtgaaactccatcttggtgggggggaggcgaaaaaaaagaaacaagaatattacaaaggatacagatgaagagatgcaaagggtgagatataggagaagggtgtggctggcagcttctaggtagcttcaggagggggactggtcaccagaaagaccaaggcatgattcgagggttgcgactttcagccccaccccccaacctctgggagggcagaggggctgaaaatcaagttgatcaccaacggtcaatgatttaaatccaaacctctaatcatgccttggttttcccggtgaccaacccccatcctgaagctacctagaagctgccagccatcagtcaatccttagcctgcaaaaagacatccctttggagatcccaagggttttaggagctgtacaccaggaaacagtgtcaaagaccaaacatacatttcacaatgtcacagtcttctaaaaactataactagcctagcaaacctatgatttctagatctttgcattttcacttaaaataaagctaaataaaaagcgtccattgaaagactggtaagcaagtagaagtaccagtggcaagctaatgtggaaaaaaaaaatcattcaggcagagtgaaaatgattgtagctcgagaaacgttgctgtaacagatgggaaaacattcacattggggctctgatggagaagagcttgtagcttaatttcaaatatgatagattagcagctggaagccagaaccagccggaggttctgcagaggaactggaggtgaggatactggccacttatcagccagtacagaagtcctattccaaacctttaacaatctacatgccagctgagaaccatcctaaggggtcagatttaggagtgaggtcaatgcacaagctctagcctcaaataccttgaacgctgcatgtgacaagtaaattctctaaaccaatgctttccattagaactttctgcagtcacagaaatgatctccatctgccctgtccaataggattgtcacttgaaatgtagccagtgtgactgcagaactgtgttttttattttattgcatttaaattaattttaattgaaatagccacatgtggcctgtgactgtcgtattgaataagacaggtgcaaacaaataattctgtttagctgagtgatatgtgaggttggcccaaaaggaatgaaggaggaaggtgccttctctaggcattggctttgctcgcaaaaggctttggacaagagaactctgcaagaggcagtgaggggtggtgagtgcaggagggtcaggggaagtgagagggtgataggtactgatttctaggtgggctggttccctgatcttgtcaacatctgcccagcccaagacgctgaccttgccttctctcccttccaggatgacacagaaccatacttcattggaattttttgtttcgaggctggaattaaaatcattgcccttgggtttgccttccacaaaggctcctacttgaggaatggctggaatgtcatggactttgtggtggtgctaacggggtaagtggcgcgtgctatacgctttggatttaactagctgaaggattacgaggcttttggttggtgtggtccgggccaggctcaggaaggctgagcccttgtgttctccctccccttgttatgcgcctgcctcctttctgccaacaccccacctccatgtctcagctgtatattacagcagatgctttctgttacaattaaaataatagctcattattgttggctgcttccagagtgctttatgcccattctctaatttaatccttgcaacaacccactgaattaggaaatattaatattcccatctgaccactgaggaatcagaaactcagagtgtaacttgcttaaggccacccagcaagtaagtgatggaactgggagatgaacagaagattatgcattccagaactcaaggttttaagtgttgtacgtgcatgggtctcttgatttgcttgaggatatcttgcttttatttcaacttggtgaatgttttttgagaatgtctgggtgcaagggattgtgattatgacaaaggagaaaagcaagctaaataaggtacagttactgtcttcaaggagttttcagatccatatatgatgaactgtggttgaaatgtgtatatgctttcctctaagcaccctgtatgaggtagcacttgctggtataacaaaagatccaaagctaggaaatgacttaaacacggcagaagtttatttgtcactcatagaaaattcaaaattgagctgggtgtggtggtgcatgcctgtaatctcagcactttgggaggctgaggtgggaggatcacttgagctcaggagttcaagaccagcttgggcaacacagtgagaccacccccccatctgtaaaacataaaataaaataaaaattaaccaggcatggtggtacatgcctgggagaattgcttgagctcaggagttggagggcacagtgagctatgatcatccaaccgtgctccagcctgggcaacagagcaagaccccatctcgaaaaaaaaaagtccaaaataattgttcctagttgacaggctcatctcctccaatgactgacggaccctgacccttgccatattgtggctcttcattgtcagcccacatcatccaataactccatgcttgtctgtatcaaaccaggaaggagaagtgagcatagaaggtgatacttggaaaggtttatgagtttggaaggggtgtgacccatacctgttccattcatatcctattggctagaactcggtcacatgaccacacatcactgcaagggaagctgggaagtatcagattgtgcttagaagaaaagggaaatggatttggagaatgacctactagtctgtcagggaccttaaaaacttttattagattccagtagggacattagtatctggtaccaatggctggttcctcctcttcccactctctactctcctctcagctaagtctgggctcttctattctaagacccttcttcactggacacctttttcatagtaatcatttacaggatcatagctttccatgttttgttgctgctccaggttctgtctctcttggcggatgtgatgggttgcagcacccacactgtgctggccgggctctcacaatgcagatttgtttcagagcaatgttgcctctcacagaaggagctgtggcctattgggctgtttctgtagaggccttcagatgtcagcagtctgttgtaaggactctgggctagctctcatgggcttgggtgttcacagagggatctttgttggctgtgctcacagttcggtggcttgggaccttggtgggttccaagggcatattatggtactgggcacttttctcttagtctactaggaaactcatctagaaacagcctagtggctaacttttttattgtttaaaaaatgtaaagctgggcagggtggctcatgcctgtatcccagcacattgggaggccaaggtgggaggattgcttgggcccaggagtttgagacgagcctgagcaacatagcaagaccacatctccacaaaataaaaattaaaagtgtataaagctgggtacagtggcacatgcctgtaaccccaattactcaggaggctggagagagaggattgcttgagcctaactagtttgagaccagcttgggtaacctagcaagatcccatgcaaaactaagtagagaataatagagcaaacacctgtgtatacattcatttattcaatgactatttattgaacacttctgtgtgccaggtcctgttctaggctctgggacacagcagtaaacaaaatagaaaaatcccctgtcctcatggagctgagagtctactgatggagatggacacaattgatgaatgaatctagtgtgtcagatggcggtgaggggtacagaggaaaaataaagcaggggagggatgggatgtgtggcaggcaggggtgaggggtgctggaagccagggaagacttcactgggcatgtgacatctgaatgaaaacctaagggaggtgagtgagtgagccatgaggagagctggaacagagtgtcaggcaaagggaacagccagtgcaaaggctctgaggctggactgtatctgacatgtttgatcaacagtaagaagacccacatggctagagaaggtgaccagaagaatggggagaattggggatagagaagtaatggagtaacctgctatcaaaacacaacctttctctttttttttttttttttttttttgacaagagtctccctctgtcacccaggctggagtgcagtggtacaatctcagctcactgcagcctctgcctcccagtttcaagtgattctcctgcctcagcctcccaagtagcttggattacaggcgtgtaccacaacatctagctaatttttgtatttttagtagagacgggtttacgccatgttggccaggctggtcttgaactcctgacctcaagtgatccacctggcatggcctcccaaagtgctgggattacaggcgtaagccactgtgcccagcaaaacaaaacctttctaacctttctaatccctgttttctccctccctagacccattcctttctctcccccatccaggggcactttcctgaattttatgtttattatttgcatttatgtattcacactttggctgcctaagtatataagaaatatatgctacctatttttacacttcaaaatattttttaaatagcatcagagtgagaatagtttacactttgactacatgcatagataagaaatatgtgggctgggaatggtggctcacacctgtaatcctagcaattttggaggcaaagatggaaggattactttaggccagaagtttgagaccagcctggccaatgtagtgaaaccctgtctctacaaaatgaaataaaatgtaataaaatattcagctgggcatggtggtgtgctcctgtggtcccagctactcaggaggccaaggcgggaggatcacttaagcccataaggtcgacgctgtagtgagctatgactgcactccagcttgggcaacagagcaagaccctgtccctaaaaaatgttttttgttgttgttgttgttttttgtttttttgtttttttaataaaggccaggtgtgatggctcacacttgtaagcctagcactttgagaggccagggcaggaagactgcttgagtccaggagtttaagaccagcctgggcaacatggtgaaaccccatctataaaaaaaatgcaaaaaattagccaggcatgatgacgcacgcctgtagtcccagctactcaggaggctgaggtgggaggatcacgtgagcccaggaggtcgaggctgcagtgatccgtgattgcaccactgcactccaggctgggcaacaaagtaagaccttgtctcaaaaaaataaaataaaataaaaaataaaaaaaagaaaagagaaagaaaaaaagagatatgtggtactgtttttcaaacttcacatttctctaacctgacttttgtgttcaacatgagataaatctgattaataaaaatagtttccatgcatccattttcatgactgcatagtattctgtggtaggagtatgctgccgtgtatttatctatttggattgtttccagctttgggctattttgacccaaagtgtccctgctttctcccaagtgagtttctctagggcacgtacccaggagtggaactgctgagttgtatactgtgtgcatcctcagccccactaggtattgccaaattgctctgcaaagtggttgtgccaattcatgctccctgggggctggcttctgctggctgaggctggcttgaccttgctggcaggaaggagccttaaaaatccctgtgtggttttttttgttttacttttattttaagtttaggggtacaagtgcagatctattacatgggtaaacttgtgtcttgggggtttgttgtacaggttatttcatcacccacgtattaagcctagtacccattagttatttttcttgatcatcttcctcctcccgccctccaccctccaaaaggccccagtgcgtgttgttcacctctgtatgtccatgtgttatcatcatttagcccccacttagaacacgcagtatttggttttctgtttctgcattagtttgctaaggataatggcctccagctccgtccgtgttcctgcaaaggacatgatcttgttctttttcttggctgcatagtattccatggtgtatatgtaccacattttctttatccagtctatcattgatgggcttttgcagccctgtttttttttttttttcataataacacggttatgggaacacttagggaagctcatatattattgagcagtgtgatggttaatattgagcatcaacttgatcagcttgaaggatgcaaagtcttgttcctgggtgtgtctgtgagggtgttgccaaaggagattaacatttgagccggtgaactaggagaggcagactcacccccaatctgtgtgggcaccatctaatcagctgccagtgtggccagaataaaagcaggcagaagaagttggaaagagtagacttgctgagtcttctggccttcatctttgtcctgtgctgaatgcttcctgccctctaaaatcagattccaagttcttcagcttttggactcatggacttacaccaatggttagccaggagctctcaggcctttggccacagactgaaggctgcactgtcagcttccctacttttgaggtttgaggactctgacggatccaccactggcttccttgctcttcatccttcagatgggctatcgtgggactttaccttgtgattgtgtgagtcaattctccttataaactccctttcatatatacatctatcctgttagttttgtccctctgaagaaccttgactaatacagacacctagtgggtcccaataagtgatcattaaactgaaggcagtcattcagtaggtcagtttgtcacttgtgtttgtatctccctgcttacaacaaggtggcctttcttctagtttcctgtcatctgatggaagagattctagactcattcctctagaggagaaatacttcatctagaacagataggtcctaagggtgagagctcatcgttgggatgaatgaacccactgaaattttatgcaagaagaaaattgtgtatatgtatatttttttttctggtctgtagtttttattagattctcagggaatcctgatcctatcatgaagaccttctattctagattgggttcctttcacatccccttctcctttcttgttgaattctccatgcatttctttcacttgcttttcttgctcttatttctctggtagtcagttatcctttttgtctggtggttctatctccttcaaatgaggcacattgctcaaattttattactccaaattccaaggtgctgtttagtgtcctgttgggttgtaagctaggaacagggaggggaaagtaaaacattctgcatgagctgggtgcagcgggcaagcacctggaattccagctactggaagctgaggtgggaggattccctgagcccaagggtttaaggccagcctgggcaacaaagtgagattttgtcttaaaaaaaaaaaaaatcccagctgggctctgtggctcatacctgtaatcccagcactttgggaggcagaggcgggcagatcgcttgaagtcaggagttccagaccagcctggccaacgtggtgaaaccccatctgtactaaaaatacaaaaaaaaaaaaaaaaaagcctggcatggtggtgtggtgtgcactggtaatcccagttatttgggaggctgaggcagcagaatcacttgaatccaggaggcagaggttgcagtgagctgagattgtgccactgcactccatcctggatgacagagtgagactctgtctcaaaaaaaaaaaaaaaaagaaagaaaaaacacgcgcgcacacacacacacatcatgcagacctagccttctgccaatgtcaatggtagagaaacacagtagacacttaattctatgtttcagagaggaggggactcaaatatattaatttgacattgagacagtgatgactttaatgagtactttctttcctttttttttttttttttttcgggacagagtgcagtggtgggattttggctcactgtagcctccacctcctgggttccagcagttctcctgcctcagcctcctgagtagctgggactacaggcatgcactgctgtgcctggctaatttttgtatttttagtagagacggggtttcacactatcagccagactggtctcgaactccggacctcaggtgatctgcccacctcggcctcccaaagtgctgggattacaggcatgagccaccgtgcccggcctaatgagtactttctgattaacctgttgccctctcagattcctgaagcaaaccacagcgttaaaacgtgattcattttgtgtggaccaccacggtgtttaccttcttcttgggtgaagtttggtggaaaagatcttaccccggacatctgtttgttctttgtaactcagagcctcagagaaatcctaactttataatgttgtcaaacccttgtaaggcatgtttttattgtatttgtgttctgatcatgaaactgaaaatgtgtaagaggaagatttcagaagcttggctgtatgtctgagatgacagttcttttactgtcattctcaaatatatataaatattgaagagatcaaataacacaaatcgtgcatgttaagaaaagagactgtgaacctcaccagagaggggtgagcacaattttttttcttttttattcacagggttagcactgtccctttcacataataaatgctcagtaaaataaatggttgttaagccggaaaagggtaacacttctgataatgagtgtcctgggaaatttactaagctgtttagaagatgggaccaacacactgatagaaatagtcagatagtccagaagtctatggcagatgccctgaacatcagatgagatataagacagagaagctctgggtctttgccagctctgacattttatgactctatgaaacggaaggttcctttttagaagggtctataaactgtctcaggctttgggccattttgttgaagatcagaggcaaggaaaagacacaactacacaggaaccatcagggaaagatgttgttttttggtcttgaagcatcattgaatttttttttttttttttgagacggagtttttctcttgttgcccaggctagagtgcaatggcatgatctcggctcactgcaacctccgcctcccaggttcaagtgattctcctgcctcagccttctgagtagctgggattacaggcatgtaccaccaagcccgggtaatttttttgtatgtttagtagagacgaggtttctccatgttggtcaggctagtctccaagtcctgccctcaggtggtccgcccacctctgtctcccaaagtgctgagattacaagcgtgagccaccgcaccgggccgcatcattggattttaaggctccatggattctggcaggtccagcccttctgttttactcacaaacaagtggtttgtccaaagtcacacagagatggtggcaagagatctagaataagaaggtgtcttcaagtcatggagccaggaaccctggctttttgggcaatggaagtggtataaatgtttaatatcacccctcaggttctgccactagagcccagctctctcttccttcctcttgccccctgactagcctatggcctctttccagagaataagaaagggatcctcagagaataatcccagttcctcgctttttattatatagttgaggaaaccaagtctcagaggggtcagtgtcttgaccatacacctctcatgtcctctctcctttttgattaattgaataaatacatgtagttgcttcttacctcctttctttcttcacccctgccccatgcacctgctcttagttgccttcacatgtaaacagcattccaacaacaacaacaaaacacaaccagcattctaactcatgagaccagcaacagttcctataaataccagcagcattttattttaatgtctctctgcagtagtttctcccctccatggatcagtcatccttggtaccaaaaggattccccactgtgacacaaatgctttttgtcattctcagtgagttataccattgagagagcatcgatctttttattgttcaaagcttttggttgtcatgatatttgctggaccatgtttcaccaggaaccacatcacttcctagcagcaggagctattttcttccatcttctaacaacaccagcagtgacagtgataataatgatgttagctgccatggtcgttattcttatcatttattgagtacttactatgtgccagggactacattaagagttttatgtgtattatcacattgagcctcgctagcctttgtacagatgaatctgaggctcagagaggttaagctgctcacaagggagtcacacagctggtaaggggtggatcaggatctcagcctctctgctaggacacttctctaaacctagaataatactgggcctgtgttaagttcagcaaagagctgtattcaacccagtgtccttaggaatgtaatgcctgttattaacaacagtggcaacattgataagctgaaacttatgaggtgcttacaatatgatatactatatattatatacatacataggcacccacctataatctcagcactttaggaggccaagtcaggaggatcacttgagcccaggagttcgagaccagcctgagcagcatagcaagatcctgtctctgtaaaaagtttattttttcagttggccaggtatgttggtacatgcctatagtcccagctaatgaggaggctgaggcaggaggattgcttgagcccaggaatttgaggctgcagtgaactatgatcacaccactgcactccagcctgggtgacagagcaagactgtctctaaaaataaaaataaaaataaaattatttcaactctcaaggttaaataaatactattattattcccatttacagatggagcaactgaggctcaaagacattaaatgcttactgtcttagtctgttttctgttgcttatagcagaacacctgaaactgagtaatttataaagaaaaagcaatttatttcttacagttatggagactggaaagtttaagatcaaggctgcatgagctataatgcacacacactattgcactccaggctgggtgacagggtgagaccccgtgtcaataaataataatataaaataaataaaacaaatttcaacatgagttttggaaggtttgaaatattcaagccagagcatctgtctcataagtggtggacccaggatttgaactaaggcagatctggatctagaacccattttcttgaatcctacgctatttctctaaggtcaagtttgccaaggaaaataaacttgagaatttgaatagagctctctgacatgggaagtcagggtgatccttccttcccctccctgatcttgggttccactatggctgggggaaaacaggagcagaagagatttcaagaaatgagagattggcctagcgccatggttaagacctggacttcagagtcagaggaagctcctccctctatgacagtgagaatgtgggttgaactcactgaacctcagttttctcacctggaaaaagggagtaaaactagtgcctagctcctagggtttgcatcacacacgaaagttggtgaactgaaggaaaaaaacttaaattcttgtgggggagcatgtgatagatgctacaaattctccatgccttatttacctagcttacgtctaagttcacctgcagcttcctcttggtacactcccatctctctacatctctgttggagggcagtctctggcatcacagagtttgctgagccagatgcttaacaacctcggtagcatccctcaaccagtgagctagggagtcagtgtataaataccctggcttccccattgctcagtgggaaaacactgaaatatgttatacagcatcatagaggtgcctcagtaaaattgaatcctagttgttcacataaaacccattcactagtgtaccctttaccaatctctctcttcctcattcctcacttgtaattccttgcattacctcccaaattaaccattggaccctagtttttgccttggggtctactcggcgctaactcaaggagcggaagttggaagcttagcgggttacaggtttcagcaccctggacagctcccagcacaccgtattgtgctaaaatgttctcttccctccctctgcctccagctggggtggagagggactgagtaaaggccagatggccaggtgaccttgttccatactgagcttcttggccattttccctgtggggctggagaagaccttgccatccatctctccgcaggtttgggggccgactgaggtcttgttttctcgaattgctatgacaaatgccagcctgcctccaaggggcatctgtcccactgcctctacagtttgcatgcctaatgactcctctcctctcaccagggcagggaggtggctgcctggtgggccgcttgaagccgggagaccaagatcatgccactggactcgcaacaaaccgagactcttttttttttttttttttcctcgagacagggtcttgctctgttgcccaggctggagtgcagtggcgcgatcttggctcactgcagcctccgcctcccaggttcaagcactcccacctcagcctcccaagtagctgggattacaggcgcacaccaccatgcctggctaatttttgcatttttagtagagagggggtttcaccatgttggccaggctgatctcgaacttctcccctcaggtgatccactcgccttggcctctcaaagtgctgggattgcagctgtgagccaccatgcctggccaacagaataggactctgtctcaaaaaataattttttttaaacattgctttgcaacccagctgcttcttgtgcaggcatctctaaatgaggacagccagtctacatagacacgtaaggaagcatagtggttaagacctggtctttggggttagagtggattcccaacctgactccactgtttccaagctgtgtgaccttgggcaagttactgtacctccctgaatcttccatttcttcatctggaaaatgagagtagtagcatcccctgacttggtggggcatggtggctgatgcttgtaatccaaacactttgggaagccaaggtgggtgaatcgcttaaacttgggagttcaaggccattctgggcaacatggtgaaactccatctctacaaaaacaaaacaaagcaaaaattatctgggtgtgatagtgtgtgcctgtaattccagctactcaggaggctgaggtgggagaatcacttgagcccaggaggtcaagtctgcagtgagccgtgcttgcaccactgcagtccaacagagcgagaccttgtctcaaacaaacaaaacaaaacacaaaacaacaacaaaatactaccaccttatggagttgttttcaaggttcaatgagttaatgtctgacccatgctgggctgggtttatggatgttacttgcccagggacagtctgaagaaagagaaagtgatatagtccattgggcctcagcttcctcatctgtggaatgggaataataattgcacctacctcaaaaggtaaaagtcagtgagatacatataaggcattcagaacaaaaactggcacagaataagtgctcaattatattagctattgtaagactaataactatcattataatgatgataataattattactacttccccaggcccagttccatagaccagttagttaactgtagggaacgtttgctattattagttgggttcccaatatctgacctccctttccaatttagggagaatcctcccctttctataaagtactgctggtctatgggatcccaccctcactaataagttgaaggtgaaagggattcattgtcaccccatcacctggtagtcagggcatgtgatttaaacaaccagggccaggcgcagtggctcacgcctgtaatcccagcactttgggacgccaaggcaggaggatagcttgagccaagcccaggagtttgagaccagactgggcaacatagtgagacccctatctcttaaaaattttttaattagctgggggtggtagcacaggcttgtagtccccgctactcaggaggctgaggcaggaggattgcttgagcccaggaggtcaaggctgcagtgagccgtgatagtgccactacactccagcccagcctgggcaacagggcaagatcctgtctcaaaaaacaaactaataaaaaactcaaccagtcacgttttcctacccaggaatttgaaaatggaccaagtgatccaaacatgatggtttggactctttcatggcctcctgctacaggagaaggtcaggctggctacattgttcctgctgatttcccaaatcccctcttctggccccctgttgattatctgagtttcctaaaaatcccttttatgcctaagatagccggtcagtgtttggttttgcaatcaagaacccagactgggccaggcacggtggcccacgcctgtaatcccagcactttgggaggccgaggcgggcagatcatgagatcaggagatcgagaccatcctggctaacgtggtgaaaccccgtctctactaaaaatacaaaacaaaaaaaaaaaaattagccaggcatgatggcggtcacctgtagtcccagctactggggaggctgaggcaggagaatggcgtgaacccgggaggcggagcttgcagtgagctgagatggcaccactgcactccagcctgggcgacagaacgagactccgtcaaaaaaaaaaaaagaaaaaagaagaacccagaacccagactgatcctgagacaaagatttgagggcaacgaatcacgaggtcaggaaatcgagaccatcctggctaacatggtgaaaccccgtctttattaaaaatacaacaaattagctgagcgtggtggtgggcgcctgtagtcccagctactcgggaggctgaggaaggagaatggcgtgaacctgggaggcggagcttgcaataagccaagatcgcaccactgcactccagcctgggtgacagagcaagactccatctcaaaaaaaaaaaaaaaaaatttgaggacaagtggtttgtttggcaataccaggaaacaggggaacaggatagtcagaaaagaaagagaaagctgggcatggtggctcactcctgtaatctcagcactttgggaggccaaggcaggtggatcacctgaggtcaggagtttgagaccagcctggccaacatggtgaaatcccgtctctgctaaaaatataaaaattagtcgggtgtggtggcgtgcacctataatcaaaataaaataaaatcaggatattttattttaaaactctgtcttagtgtaactcatatttacctcttctgtatgctcctttgcatcagttatatattgccataatacggctgtgtaacaaacaatccccaagacccagtggcttataatgacaagcatttatttagctcatgattctgaagggtggcagtttaggctgggcccagttgggtgctttatctggtctcagttgagctcattcatgcatctttggtcagctgcgggtcagctgggtggctcttctgtttggctgttagctggctgcagactggtccaggatgacctcggctggaatgactgtgctccactccctatggtctttcaccctccagcaggctagcctgagctagttcacatggcagcttttcatcctccagcaggctagcctgagctagttcacgtggcagcaatgggattctaagagaaagaggaagtgttcagccttcttaagggctagtcccaggaatggcacaacatcgtgttggccactgttgtccaaagcaagcaatgaagctggtccagattcaaggaatggggcaacagagcccatctggtatttacctggggccactggggccccattcctgttccctggggccttttgccctgacttctgtgggccctcagagcatattttcagattcctttccatccctgaccctcagcaatcaatgtagatgacgtgtcattactgtgtcacttgcacagagaaaaggaggaaaaaatgtcagcaaaaactctgctgagagcagagggcccatcatacagcaagctggaaagaaaagtgggaatgattacacagcctcctcagatgcttccagcttttatcaaatctcactgtgatatctgagttctgaaccctcacaggtggttggcgtgcaagggaagagatttcttgtctgccatgctgacatgcacagacacgcaacctggctccctctgtccactggggctttggattttgtttgttgaaatgttacccactcctgatcagagctggatggaaacctggctctgattccattggctcaggggctcaggtgggggcagaggccaggctggttgggtgtctatgtggagaccttaactcttctccctcccgccccaactctttttgtttctttttttttttttttttttttttgagatggggtttcactcttgttgcccaggctggagtgcagtggcgtgatcttggctcactgcaacttctgcctcctgggttcaagcaattctcccacctcagcctcctgagtagctgggattacaggagcacgccaccatacctggctaatttttgtatttttagtagagacagggtttcgccatgttggccaggctggtcttgaactcctgacctcaggtgatccaccctcctcagcctcccaaaatgctgggattagaggcgtgagccaccacacctggcccttttcttttcttagctgcctccacctctcttcccttctgcagtgttaggtttatggaaaccgaggccggcgtagagatcaacttcagagagcatgaactgagcatctgctgggtcttagatcctttacatagcttatcatcttcaaaccttctcacagttctgtgtggctagagccaggatttggacacagctctgccccactgtagaaccaggcttccttctgtccactgtcaaattttagagggagaaaatagggaaagggacaccagccttctccacgagcagcttctgcccactcaccccagggactttgcacatgctgtgtgcctgtgtctgagatatgctccctcctctgtatctgcttaattcttacccagacatgatacataaagtatttaacatccaggtggcagggacaccagctaacctgaaaagaggttcccctgttgtgccacatgtgtactcattgtttgctgcattgtgggggcagtccaggggccttgaagaggggccaaggtgccaaaggggcactctcaggcctcaaggaagtacatgtttactgatatgatactgtctcttcctccaggaaggaagccttccctgatctccccactgcatgcccactatgataccagtttaggtcccctctttatggccatctgtggcatcagtgtgaatcctcttaatgttgtctatttggttaatcatctgtctccttcctctggggggtaaagacagaaccacagagcctcgtgtagaacttgagaatggggttcagtaaaaatctgttgaatgcataaatgggtgattgagtgaatgaatgaatgagtgaatgaatgagtgagtggatgaatgaatgagtgaatgaatgagtgagtgaatgaatgaatgagtgaattaatgaatgaattcatagctgataatacaggcttcatggcttttgttaggcttgcccagacattgctaggggatggacagaaggaagaagagctatacttaattccagtcctgttgttctgtagcaggaggagaaaaacagggactgcccagcctgctctgggtggattcaggagcagctgaggttcctctcttatttgcaaacagggaattcaaaaagccccaacctcagaatcacactcgcctcagcagctgtaccagccaaggggacaatgtgggaagccttgggcaccaggaatgctgagtgcttcgaaaaagcgaaggctcagggaacaatccctgatttttcattcccttgtcctttctgaagaaacaggcaaaggcaggccaggcacggtggctcacacctgtaatcccaacactttaggaggccgaggctggtgaatcacttgaggtcaggagttcaagaccagcgtagccaacatcatgaaatcccatctctactaaaaatacaaaaattagctgggtttggtggtgcatccctgtaatctcagctactcgggaggctgaggcatgagaatcacctgaactggggaggtggaggttgcagtgagctgagtctgcgccactgcactccagcctggatgacagagtgagactccatcttaaaacaaaacaaaacaaaaacaagtaaagccttgtgtgtttttaaattgtaggttcagcagcaaagctctgtaataaggagctggaccctgcagtcagacagtcatgggcttctccagtgcccagccgagtgacccgagggagttatgataaacaccaacattcatccacaatttgtacctagtgctattctcaatatcttgagtaaattatctcatttaatcctccaggcacatctttcttggtaggtgccgtcattgtccccagtgtacatctgggaaaatgaggacaggctggcagagcacccttcctgctcacctctgctgctctgctgacctctggcaagactgttgtctctctgagcctcagtttccccatctgaaaattggggcctgtattagcccgttctcacattgctataacgagatgcttggctggggctgggcgtgatggcttatgcttgtaatcccagcactttgggaggctgagttgggcagattgggagtgtgagaccagcttgggcaatatagcaagaccccatctcttctaaaaaaaaaaaaaaattagccaggcatggtgatatgcacctgtaattccagctacccaggaggctgaggcaggagaattgcttgaacccaggaggcagaggttgcagtgagccaagattgcgccactgcactccagcctgggagacagagtgagactccatctcaaaaaacaaattatttttaaaaaattaaaaaaaaaaatgcctggctgggcacagtggctcacacccataatcccagtactttgggaggccaaggtgggaagattgcttgagcccaggagttccagaccagcctgggcaacacagtgaaatcctgtctctactaaaagtacaaaaattagccaggtgtggtggcacgcgcctgtggtcccagctactcaggagggtgaggtgggaggattgcttaagcctgggaggtcaaggctgcagtgagcaatgattatgccactgcactccagcctgggcgacagagtgagaccttgtaaaaataataataataataataaataaataaaaaccctgagactggggtaatttataaagaaaagaggtttaattgactcacgattctgcaggctctacagaaagcatggcagcatctgctcagcttctgggaaggcctcaggaaacttacaatcatggcagaaggtaaagctggagcaggtgtcctcacatggccagaacaggaggaagagagagagtggggagatgctacacacctttaaatgtccaatctcacaagaactcactcacgatctcgagaatagcaccaaggcggaaatctgcccccatgatccaattaccttccaccaggccccacctccaacattggggattacaattcgccataagatttggttgcggacagacacagatccaaagtacattaaaagtaatggcaaaaaccacaattacttttgcaccaacctaatatctcaggggctcattgtacctatttcacaggacaaatgaaggtatcagtaataacagtagcctgtagtcccagctattcaggaggccgagacaggaggatcacttgaacccaggaggtcgaggctgcagtgagctatgatcacgccactgcactgcaccctgggtgacagggcgaaaacttatctctaaaaataataataacaacaacaatagtgaacacagatataacatgtgtgtggccaggctgtgcccttagggctttgcagggattatttcattcactctcaatctccccattttacagatgagaaaactgacgttcagaaaagctagaggacttgccccaagccacacggctaggaagtggtggaattggggtttaaatgaggaagcttgacttcagtgtcgaagctcttaactgccacactcaatacatggagtagaggttgctgattctgtgattatctgattctggaaagtaaagaccctgtttccagacgtttgctgcttgacttagttcccaggggatggccactggatgatgcagtgttgcccaggagaggttagctagacacactgcaaccattccattgctaatacttatacttgctcttgttctgctgggtgctatgcagggaagggctgtctgagccctttgcaagaattctcccattggtgcctcccagagattctgaggttggggctttttgcatcccttattagcagatgagacaccaaagcccaggtcaataatctgacctgcatcccccgcctaccagccagaccaaggtcacttccccacaatgcaggccctgatccaaggctctgggtgcaaaccagtttccatgtccctgggggtccatcttcttcagctgactttttttttttttttttttttttgagacagcgtcttgctttgttgccgaggctggagtgcagtggtgtgatcatggcttattgcagccttgacctcccaggctcaagcaatcctcccacgtcagcctcctgagtagctaggactatgggcacacgccatgatgcctgggtaatttttttttttttttttttgagacagagtctcgcactgtagcccaggctggagtgcagtggcgcaatctcggctcactgcaagccccatctcccaggttcatgccattctcctgcctcagcctctcgagtagctgggattacaggtgcctgctacctcgcctggctaattttttgtatttttagtagagacggggtttcaccgtgttagccaggatggtctccatctcctgacttcgtgatccgcccacctcagcctcccaaagcgctgggattacaggcatgagccagatgcctggctaatttttaagtttttttataaaggcggggtcttgctatgttgcccaagctggtctcaaactcctggcctcaaaaagtcttcctgcctcagcctcccaaagtgctaggattacagacatgagccactgcacccagcctgactttttttctaactgaaaaattaattatatatattcatggagtacaatgggatgttctgatatatgtttacatttttgaatgattaaatcaagccaattaacatatccactacatcgcatacttattttttgtggtgagaacgcttaaaatctactcttttagcaattttgaaatatacaataccttatgttgtatattacattatgttgtatagtacgttgaaacatacactacaatacgttatcattaattgtggtcaccatgctgtgcaaaagatctctaaaacgtattcctcctgtctgactgaaactttgtatcctttgcctaatatctccccaatccctccaccaccagcccctggtaaccaccattctctctgcttccatgggttcaaattttttattttttgaaatttttaatttttatttatttatttatttatttatttatttatttttgagatggagtctcgctctgtcacccagtctggagtgcaatggtgccatcttggctcactgcaacctccgcctcctgggttcaagcgattctccagcctcagcctcccgagtagctggggttacaggtgcttgccaccaggcccggctaatttttgtatttttagtagagacggggtttcaccatgttggctaggctggtctggaactcctgacctccagtgatccacccacctcggcctcccaaagtgctgagattacaagcgttgagccactgcacctggcctaaaatttttttttttttttttttttttgagacggagtctcactctcttgctaggctggagtgcagtggcatgatctcagcccactgcaacctcagcctcccgggttcaagcgattctcctgcctcagcctcctgagtagctgggactagaggtgtgcaccaccacgcccagctaatttttgtatttttagtagggacagggtttcaccatgttggccaggatggtgtcaatctcttgatctcgtgatctgcctgcctcgggcttccaaagtgatgggattatgggccaccacgcccggcctcaaattttttagagctcacatataagcgagattgtgtactatttgcgtttctgtgtctggcttgtttcatcttagtataatgtcctccaggttcatgcacgttgtcgcaaaagatggaatttgctcctttttaaagactgaatagtacttcattgtgtacatatacacgccatattttcttcatccattcctttactgatggacatttgggttgtacctgcatcttggctattgtgaagagtgctgtcatgaacatgggtgtgcagctgactctgaggtgttagagggattacagctcctccaaaagaccaccgtcacccaaacctgctcctcctgccctattttctgtttaggtaaaggcggctttaaccccctgcagtgctctggcctcagacctccagatcttcctctatgcctctatgcctctttttctccaccccctgcatccaatctgttagcacatcttattggctctaccttcagaatctacccagaatccaccacccacctctcaccaccttcacagccccaccccggtccagcccccatctttgctggcctggactaaaccagttgcccctccaccccaatctggtctcttaacttcagtccttgccccacccccaggactgttccccacacagcagccagagggcacctgtgagccactgagtcaggacctggctcctctttgctcacaacctcacttggagaaaaagcccaaattctcctcacagggacccacaaactctgcccctgtgatcccccatccccctctattcccactctcctctccactcactcggcttcagctacacaagttccctgctgtcccttacacaccaagcactccccagcctcagggcctttgcacaggctgttccctctgcctggaacactcttcccccagatatctgcttggctcccccctcacttcctttgggtctttgctcaagtgtccttctaacatgtaactgcctcacctgcactgtgccaccccactccccgcctctaggcttaatttccctctacacccctgaagagcatctgccaagctatatttacttgtttattggttattgccaatcccctgcccccactagaatgccagctccatgagggcagggacttctgtctgttttgttcactgctattcccccagagcctagaacacagcctggcacatagtaagtattcactaaataatttgtaatatgaattgtgccagtaaaatcttccaggggcatcaagcccctgccatgactaggtggtaacatcctcaccccctgtccatgtgctatctcctcctgacctgcttgtctcattgttctaatggtggctcacgcctgtaatcccagcacttggggaggccgaggcgggcagatacctgagttcaggagtttgagaccagcctggccaacatgatgaaaccctgtctctactaaaaatacaaaaattagctgggcgtggcattgcacgcctgtagtcctagctactcgagaggctgaggcaggagaatcgcttgaacccgggaggtggaggttgcagtgagctgagatcatgccattgcaatccagcctgggccacaagagcgaaactctgtctcaaaaaatatatatatatatttcattgtggtaacatatgcataacataaaatgtaccattttttaagtgtttagttgagcggcgttaagtacattcatattgttgtgcaaccaggaccgccatccatctccagaacttttgcatcttgcaaaactgaagctctgcccccaggaaactctcactccccgctcccccttcccctctccccgactcccccttcccccctccccactccccccaccctactccacactccccactcccccagcccctggcacccgccgttctagtttctatctctgtgaatttggctactttgggtcccccctgtgagtagaatcatacagtatttgtctttttgtgactggtttgtttcgtggagcataatgtcctccagtctcatccatattgtagcatgagtcagaatttccttcttttccaggccgaatcgtattccattgtgtggatggaccacactttgcttatctgttcatccagatgggcacttggcttccaccttttggctattgtaaataatgctgctgtaaacctgtgtgtacaaatagctgagtccctgctttcaattcttttggatatagacccagaagtggaattttttttaaatcaagatttgacccactggggcccttagaggtctcattggctctgaagcttttttttttttttttttttggacgctttgaaactaaaaataggagtgaggggcacagtgaggggggcacacatctctcgtgtcagcgttttttaaaaacaccccgggaggaagatgtgtgaaatccctcccttccccccgctcccaccccctccaagatctcaaaatacctcttgttttaggaagcggctgtgacatcaggcaggcagcgtgtggcatctgagacacaatatcgcaagtggctgggagcccagagaaaccaggacaggcgtgctggggatgtggactagagatggagctaattttagtggctgaagaggctgcaagaagagagagaaagaggggtgtgtgtgtgtgtgtgtgtgtgtgtgtgtgtgtgtgtgtacgcacagtgatagaggctggagggggagaaatgacagataaatcagcttgggcaaagaaagctaatgggcagaggagcgagacccagctcagaaggtggtcagcaaatctaaagatgtgtgcccgagggtcaaggtggtggggggattcataggcaagtggtagagaggctattccatttgcagaggctctctctgtttgaggcgtgattcacctgtgccgtcctcaaggccattctgagaacaccactgttgttttcctccttttatgagtagggaaactgaggcattgaactgcttctattcttcagtaagaagcagggggaacatatggtagaagcaaagaaatacaaacatgagggctctcggggtctacgtgattggctgtgacatccatgagagcggatcgcaggttgaaggaaacactggtggcagaaagtagctgaacatttggatttgggaatcccagtggacgtggcgaaaattctggcttttcccttcacaggctgcggggccactctgacctgcggtttccttatctgtgaaatggaacgatgccacctgtctcagcgttgttttgaggatgcgaggagatgatccgtgtaatatgcccactagggggcctgctccagggtagattctcagcaaatggtagtcatggtttttgttacatttggggatattggcaggtaaaaaggaaatacttcattcattccaaaattgctcactgaggttctactatgtgctaggccctgatgacacatcggtcaacaagacaggcctgctttctgcccttgtaaaacttcagttcaactgcattgcactcatcagcctaataatccaggtaaattgtgatgagaataacaactagcatttactatgagccctttacaaatattaacccatttaatcttctaaagagcctataagataagagctcttgccctgcgcagtggctcacgcctataatcccagcacgtcgtgaggccaaggcaggtggatcacctgaggtcaggagttcaagaatagcctgaccaacagggtgaaaccctgtctctgctaataatacaaaaattagccaggcatggtggcaggtgcctgtaatcccagctacttggctgaggtaggagaatcgcttgaacccaggaggcggaggttgcagtgagtcgagatcactccactgcactccaagagtgaaactctgtcacacacacaaaaaaaaacaacctgttattatccacattttacctatgaggaaaccgatgcccagagaggttaagtaactgtccaaaggtcacacagctacggagtggtagagctgggattcagacccaggagtgtgatcccagagtgtgtgtgtatgtttgtttgtttgtttgtttgtttgtttgtttttaccactgtgttttcctgcttctgcaatagaagtaatcaccagtaacactgagcagttgttatgtgccatgcccttaacacacatctccttggatctttggaaagaatcctaaaagggttgtttttcatgatccacattttatggagagagagagatcaaagcatagagagaggaagtaacttgcccaagatcctgcagctgaagactctagggttgcaaatttgggacggccctggaccctgcattccagcttctagcagctcatagggggaactctttatttatttatttatttatttatttatttatttatttattttgagatggagtttcgctcttcttgcccagcctggaatgcaatggcatgatctcggctcactgcaacctccgcctcctgggttcaagtgattctcctgcctcagcctcctgagtagctgagattacaggcatatgccaccacgcctggctaatttaattttttttagtagagacggggtttctccatgttggtcaggctggtctcgaactcctgacctcaggtgatccgcccatctcggccccccaaagtgctaggaatacaggcctgagccaccacgcatgccctgggggggaccacttttatcggtgcatttcttccattttccctgtgtctgtgtaaagataaacacccccaagccccttgactatgaactgtgggccataattagttaatggaaggtaaatgttttagagacggaaattgctgtgccatttttccccgctaggcattgttgcctgcatgctaatgcaacacaatgtgcctttcttctgtcaggcatttttagacaaattctattttccctaaaatattttgccaaagaaaatagcaaatggggaagacattcagaggctcaggcagagagaggacaccattcccttgggtttaaacagaatggcagagtggataacagcacagatcttgagttaggtggatgccaatttgtgatttatttcccagcaaaccaagatgctggctctctgtgtgcctcagtttacttatttgtcaaatgaggagaataatggtacctgtctctcaccagcttaccagttgcctctttagctatgtctaatctgctattaaccacgcccactatgtctttaattccaagtattagaattgttttcttcctacaagctgtctgatcttttttaatcctgcttcatcttttgcagtattgttttcctacagcaggatttctcaaccttggcacaattgacattttgggctaggtaattcttggccgtgagctaccaccctgtgctaagatacttagagcatccctggcctctcaccctactaaatgccagtagcagcccctccccagttgtggcagccaaaaatggctcagacattgccaaacgaaatgtcccatggagggtagaaacgcccccacttgagaattgttctataggtattttcaagcatgtcttacatttctttaagtataatatgcaaaagaaaaggctaaatctaaaaaaagcccataatatgcgaagaatttttataatcagtgtccaataacttaagtatctaaaattgttatggctttttttctgctgtctcttgtttcctgtgattcctcattctggtgccttgttttcttgaatgtcttgttatctttggttgtgtgaagctcattttccatgggacactattttttgttttgttttgttttgagacagagtctcgcttggttgcccaggctggagtgcagtggtgcaatatcagttcactacaacctcagcctcccaggcccaaatgattctcctgcctcagcctcctgagtagctgggattacaggcgtgtgccaccacacccagctaatttttttgtatttttagtagaggcagggtttcaccacgttggccaggctggttttgaactcctgacctcaagtgatcaacccgcctcggccccccaaagtgctgggattacaggtgtgagccaccgtgcccggcatccatgggacactgttgaagggagttcattgaggcctgcgatgaaggcgaaccctccatggacaatttgcatttactttttccaggtgtctgggaaactcccagtctaggaccatcttagacttttagaccaacaatgtgttgagaatttaggtcaccagtgtctgcaaaagccagcttgtggttataatttctcaaaaacttttgtttttctccttttctgcaaagtgccaaagtaacttcctcaaaaatctctgggaatggaaagacgggagtaaattaacttcaggtttcttacctgaaagtgatagcctattggggccccatcctacttggggagtggtgtgtctcctttgagactttctaacacgtgtgtaccctggactttgccccacccctgctccctaggaggccataaaacttgaagcagcagttccatgggttagacagatgcccttggggcaaaagtggttttaatgctctggtagatgctcaggttacctctgggaaattcttgacttcacttatttatttggggctgataactactaattgtcaggcctttcttgtttcaacaacatggacttcagattttatgcaggatttgtcatcgttttcagcaagagagtcagtcttattacccagcttactgcattagaaatagatgtctgggccaggcgcagtggctcacacctgtaatcccagctgtttgggaggctaaggtgggcggatcatgaggtcaggagttcgagaccagcctggccaacatggtaaaaccccatctatactaaagatagaaaaaattagctgggtgtggtggtgcgtgcctgtaatcccagctacttgggaggctgaggcaggagaattgcttgaacccgggaggcagaggttgcagtgagccaagatcgcaccactgcactccagcctgggtgacaggacgagactctgtctcaaaaaaagaaatagatgtctgttgtgtggattatttaaaagagtagatggccaagaactatgacttatgcctgtcatctcagcactttgagaggctaaggtggagggatcacttgaggccatgagttagagaccagcctgggaaacatagcaagacccccatctctgcaaaagtaaaataaaataagttagtgtgcatgatggtgcaggcatacctctagtcctagctactcaggaggctgaggcaggaggatcacttgagcctaggagtttgaggctacagtgatctatgatcatgccactgcactccagcctgggtgacagatcaagaccctgcctctaaaacataaaaataaatacaaattaagttaaaaaataaaataaataagtaatagaacatccagcacagttcttggcatgcattgactgttgttgtttgtttgtttgtttgtttgtgacggagtctcactcttgttgcccaggctggagtgcaatggcatgatcttggctcatcataacttccacctcccaggttcaggtgattctcctacttcagcctcctgagtagctgggattacaggcacgtgccaccactcctagctgttttgttttgtttgtttgtttgttttgtatttttagtagagatggggtttctccaagttggtcaggctggtctcaaactcctgacctcaggcgatctgccagcctcggcctcccaaagtgctgagattacagacgtaagccaccacgcctggccagctgttttgattgttaaatgaaggtggtatgaaagggaaggaagaacagtgacatttgcaagggacactccctggagggcagggcaagggggctgtggaggggagaagtcagagagtatgatacaggttgccttgggtgatgttttagattttagccaacattggcaaagagcctcatttatctctcagagtagctctggctactggaaatgctgcacaacttcaggcggactttctagaagaaaactcttggccaggtgcagtgactcacacctgtaatcccaacactttgggaggctgaggcaggtggatcacttgagctcaagagtttgagaccagactgggcaacgtggcaaaacctcatctctacaaaaaaaaatacaaaaattaaccaggcgtggtggtgcatgcctgtatcccagctacttgggaggctgaggtgggaggattgcttgagcctggggaggtggaggtggtagtgagccaagattgcaccactgcactcccatttgagtgacagagcaagaccttgtctcaaaaaagaaaaaaagaaaagaaaagaaaagaaaattctctctgggattcaatcctggcccacacagcattggcttcacttcacctccttctcccctgagatacacagcaccattcccccaagcttcatcaacttaatctctgatctgggtgctgtgacttgtccccattcctggccagaatttaaggtagggatgaacccactagccctccatcacgcactctgccataaaagcacaccacgtgctgattgctgtctttggtctcctttctgccttgccctctagactctgagctgcttggagacagaggccagttttgtccatctccaaatcccctaaagtcctgtggccagcaagcaggtaggacatctgaaagttcgtcagagagggaattgcttttctcttgagatgcaactagaacaagaatcttattgacctggagtagcttcaaggttgtaagagtatgtgtcagggttctccaagaccactctcaggtttgaaggtttgctaaaagggctcacgggacccagaaaagctgtgaaattcagttatggtttattacagtggaagaatacagataatacagattaaaatctgcaaagcaaaagatgcacaaggcaatgtccaggggagatcaggcatgagcttccagctgttcactcccagtggagttatgcaaacagtgctcaattctcccagcaatggtgtgtgacaatgtacagtgtaccgccaaccagagaagctcacctgagccttggtgtccagggtttttattggggctcagttacattgacatggagcacccatgtgactgactttaactgctgggtctccagcacactccaagatcaaactgataccgtgtgtcccagggccccagctgaacacaaacaggcagtcaccatagatcccattgtgagcataagctaccaggcatggcccaaagccctagatatacagatattctttccaggagccagccaagggccagtccttcctttggaatatgcagagtttgaactccccaaccccaaggagttaactctttactacacagaatataaatctcaccaagtctttcttcttgtcaagtcctctcaaggtgacccattgcttttagcagtgtctttgagaccctgcgtcatctggccttgacccatatcacctgtgttatctctccactctagctacattgaacttttcttttttgagatgtggtctcactccatcacccaggctgaagtgcagtggtacagtcacagctcactgcagcctcaaactcctgggctcaagtgatcctcccacctcagcctcctgagtagctgagcccacaggtgcatgccattacacccagctaatatttttatttttagtaaagatgggttctcactatgtttcccaggttggtctcaaactcctgggctcaagcagtcctcccatcttggcctcccaaagtattggcattacaggggttagccaccacatccagcccattgaactttttaaggatcccctagcatcctatactttctgtcactggatagccttggaattatttttccttctttttgaaatactcttcttctttccaccctttgctgtcaagtctcagaataggcattatttcctccaaaaaccctctcctgaccctccaaatctggatgaggacacttcctttgcccagagagcacctgttttaatcctctcaggtggctataataaaataccttaaactgggtggcttatacacctcagaaatttattttccacagttctggaggctgggaagatcaaggcactgacagatttggtgtctgatgaggggccatttcttgtttcgtagaaggggtcttcctactgcatctttccatggtgaaaagagttgaggcagctctctgaaacctctttcatgagagcatgaatccctctgtcttcatgatctaatcacctcccaaaggccccacttcctaatatcttcacattggtgactaggtttcaacatatgaatttgagaaagacacagacattcagaccatagcagtgctcttccaccaggttttttatccccctgtattataattgaggtttaaattatctgctttccttcccttagattgtaagctccatgagagcagggccctacccatccagtcattgtcctatcccccatgactacaacttcctgggtacataattaatatttattatattatgtagcaaaggtatgctgccatactaagagacccaaaaggccaccggattaaaaccttaaagaaaaaaaaataatttctctcctataatagctgcaaggttagccatgcaggttggcagggaagctcacttccacaaagtcactcagggattcaggctcctgttgccctcttcttttctaccaccaaatgatcttcagcaccatttgcacaatcaaaacttaactggtcttgaataggcagaccttgaatttctgaagtctcagacccaaaagtggcagctgtcacttccactgacatatcactgatggaaacttaatcatgtgatcataccaaactgctagggatgctgggaaatgtagttttgttgggaactccatgacttggctaaaattccattactgtagaagatggtgggggatgggggagtggtggacatccagtggttgctaccatatttattgaatcaaattgtcaaacaggacctatctgataaggggttcttttccagaattaactgaagtattaaatcaggggcaaaggcatgtcacctcatctttctctccctatattggctttctagggctgttataacagagtaacatgaacttggcggcttaaaacaacagaaatttattttctcttagttctggaggctagaagcctaaaatcaaggtgtcagcagagccaccttgacaactgctctaggaaagaattcttccttgcctcttctggtggctcctggcaacccttggtattctttgtctggcatccacttcaatctctgcctccatcttcatttgccttttttctctgtgtgtctatgtcctttcctcttcttagaaggataccagtcattgaatttagggcttactctaaatccaggatgatctcacctcaagatccttaattagttacatctgcaaagagcttatttcaaaacaagattgcattctgaggtttcggtaaacacgaatttgggggaaatagtattcaactcaattcactgctttacttaagaaaagagaccatgaagtgagcctccttctgcttgagagagagagcgagcctttctgtgcaataggtcaatgaatggatgcagctgaattccacataactttataaaaatagatggccagcccatggggtttgctgacccctgcccaaaaattccaaagtcaacagcagtctcttttttaatcatttctctattttttaatttatttttatttttatgttgagatagagtcccgctctgtcgcccaggctggagtgtagtagtctcggctcactgcaacctctaccttccagatacaagtgattctcctgcctcagtctcctgagtggctaggagtacaggtgtccgccaccatacccagctaatttttgtatttttaatagaaacagggtttcaccatgttggccaggctggtctcgaactcctgacctcaagtggtccacccacctcggcctcccaaagtgctgggattacaggcatgagccaccatgcccggccaggattttcttcattttaacagcattcttacttgtcccacatccattctatcctgggtctaattagataacaaaatctacagatcttgtttaactgacattgtcctgggggatactttttatcttttgagacaaggtctcactctgttacccaggctggagtgcagtggcctgataacagctcactgcagcctcgaccacctgggttcaagcgatcctcccacctcagcctccagagtagctggaaccacagatgcatgccaccacacctggctaatttttaaatttcttgtagaggtggggtctccctatgttaccaaaggctggtctcaaactcctgggctcaaaagagcctcccaccttaacctcccaaagtgctgggattacagatatgagccactgtttccagccttggaaatatagtctaagaactgagtcaataggcgattttgtcattgtgtggacatcatgtagagaacttaacacaaacctagatggtataaactactgcacacctcagttatggggcataccctattgcacctaggctgcaaacctgcacagcaggttactgtcttgaatactgtaggcagttgtaacacaatggtaagtatttgtgtatctaaacatatctaggccgggcacggtggctcacgcctgtaattccagatcacctgaggtcaggagttcgagcccagcctggccaacatggcgaaactccttctttactgaaaaatgcaaaaattagccaggtgtggtggcaggcacctgtaatcccagctattcgggaggctgaggcaggagaatcgcttgaacctgggaggtggaggttgcagtgagctgagatcatgccactgcactccagcctgggtgacagagcaaaactccatctcaaaaaaataaaaaataaaaaacatatctaaacagaaaaggtacagtaaaaatacagttataaccatatgggaccaccattgtataggcagtccgctgttgatcaaaacatatcaaaacatcgttatgtagcacatgactgtaccataaaccacacggcttcaaacaagggaaatgtattctctcactgttttggaggccataggtctgaaatcgaggtgtcaccagggtccctccaaaggatccgggggaggatccttccattggatttggagttgcttcactccagtctctgcctcagtggtgacagggcgttctcctcttccctctcaaagttccctcttctgctgtgtcataaggatacatatgactgcatttaggccccactcagaaaatccaggaataaactcttgccctcatattcttaactaaatcgtacctgcataccttattttttctaaataaggtagcattccagggattaggacatcaacataacttctggagggttcactgttcaacccactacagccagaatgcgctttgaattcaggttctgacatctgggactgcctcccacgtacacacaccactaccttgtactgaatgcctgaagggttctgcccccacctccactcccccaaatatttgctgtggacctgagaaagctgacttcatggaagcttcattccattgttctaaggacttttcatacattaacaaatgtcttctctctatggggaaaaccacagagaaatcaagacagagtggggttaagtaactcacctgaggaggaacagtaagtggcagagccaggattcaaaccaacatggttttgcacagttttgacatcatttgcaacacaaatattgtcacagatacctttttgagcatctactgtgctaaccgccaggaaggaaaagaacatggggccgggagagctcttgacaggggacagggctggccatggaggtctgtgtcttggtggaagatgctatggttctctttttttttttttttttttgagatggagtcttgctctgtcacccaggctggagtgcagtagtgcaatcttagctcacagcaacctccacctcccgggttcaagcgattctcctgcctcagcctcccaaatatctgggattataggcacacaccaccacgcccagctaatttttgtatttttagtagagatggggtttcaccatgtgggccaggctggtctcgatctcctgaccttgttgtgatccacccgcctcggtctcccaaagtgctgggattacaggcatgagccaccacactgggcaactatggttctcttttaactccttgtgctgaaattattgcagaagcccaggccagttcatccccagaaagtgaggcataaacaggcagagctctacagaaacagagaatccacgactggtttgatggaggctgcctcactacctacagaatgggctctgggtggattgttctatctggggagccagcccacccaccagtctcagcccttggcgactctttcctgctgtcacagcagctggacattcagaaaccgaaacatgacagccttccctccctgttcctgcccagtggagtggaaacccctcgggacccacataccgagcgtgcacagcagcacagagttgcacagttaacacagcgcttcttctccagccctccggatgcaagctgacagattggcagctggctgacttccaaggtccagtgagttcttggcagtcgctttctgacctggacgagtggctgccacctcctggaacatcaggctgcccccttggggagagggtgacggtctctctggaaagactgtgagctttgaggtggtcatcaaaagccattcttggaaacattctttgagctgtaccgtgcaattcggtcaccaattgcacgtatttggatattaatatccgtatgtggatattaaattggttttgggttttgttttgttttgattgtggcaaaatatacacaacaatcctcctgcctcagcctcccaagtagctacaggcatgcaccaccatacccagctaatttttggattttttaaatttgtttgtttgtttttgttttttgagatggagtgtagcactgttgcctgggctggagtgcagtggcgcgatctcagctcactgccacctccgcctcctggattcaagtgattctcttgcctcagcctcctgagtagctgggattacaggcgcccgccaacacgcccagctaattttttgtatttttagtagagatgaggttttaccatgtcggccaggcttgtctcgaactcctgaccttgtgatccacccgcctcagcctcccaaagtgctgggattacaggtgtgagccaccgcgcccggccgatttttgtagttttagtagagacagggtttcaccatgttggctaggctggtcccgaattcctgatctcaggtgatccaccgcctcggcctcccgaagtgctaggattacaggcatgagccaccgcacacagcctaaatgctgtgcctcacgcctgtaatcccaacactttggtaagctgaggccagaggattgcttgagcccaggagtttgagaccagcctgggcaacataggaagaccccatctctataaaaaataaaaataaattagccaggcgtggtggtgcaggcctgtggtcccagctactcgggaggatgaggcaggaggatcgcttgagcccaagaggtcaaggctgcagtgagctgtgattgtgccactgcactccagcatgggtgaaagagcaagaccttgtctcaaaaaaaattaagcgaaatttaaaattctgtttctcactcacacaggctgcacttcaagtgcttaatcatcccttgtgggtggtggctatcatattggacagcatggatagagaatatttttatcagcgtaggaagcttcatcagagaggaccgctcagaggcctgtggggaccagcacagtgcagtagaagacacaggccagctggtgagagactggtcttctgatcccagatctgtccctcacttgctaggtgaccttggacagctccctcagtccctctggagttttctcttcattgttaaatcaggaaattggcctcagtgaattctgaggccccatctacttttttttttttttttttttttttttttttaattgagacagagtctcgctctgttgaccaggctggagtgcagtggcatgatcttggctcactgtaacctccgcctcccaggttcaagcaattctctgcctcatcctccccagtagctgggactacaggcgtgcaccaccatgcctgggtaatttttgtgttttcagtagagaccgggttttgccatgttggccaggctggtctcaaactcccaaccttgagtgatcctcccgcctcggcctcccaaagtgctgggattacaggtgtgagccaccacgcctggcctcatctagttctaaatgttatgacccactcagctctgaagacaagggaggaacatcctctcagtctagctctgacatgcagaagcctctcaccctgtcccccaggtcataaaggcaggcgtgttgtgaagagcacagaatgggctgagaaaaatatgcagggattgcgtctatctcccttccttccgcacgtttccttgtcggcaccacctgcctctattccgcgccgcacacacacccgccttctctctgtctcggaggaagacaggatcttccatcccccaaatcctgccctgattcctactctgaagcctctgccctgactcctttaagctccctgggaatacagcccatctcctatgccctcctcatcccagtagttcctaccttccccaaaatcgctttgggaaagtcccccaatgagtaaccagctgtcctacatgggcatctcagaacttctcttctgttgttgttgttgtttgttttgcttttgttttgagacaggatctctctttttcacccaggctcgagtgcagaggtgtgatctcagctcactgtagccttgacctcccaggctcaggcgatcctcccccctcagcctctggaatagctgggactacaggcacacgccaccacacccgggcaaattttttttaggacttttggtagaaatggagtttcgccgtgttgcccaggctggtctctaactcctgggctcaagcgatccgcccactttggtctctcaaagtgctgggactacagacatgagccaccacacccggcagagcttctatttcttgagtgtgttctcagccatgctaagacattttctcttctcagcctgatgatgcttttggcttgtgtttctttgtttttaattaccccttcccagtcgctgtcatgggatcatgagggtcttctgtccatctagatgacacctttcttgtgccacgtgtctccaacattccctggtttttaaacccttattgctttcaagatactatccaagctccttaatgtggcacattgtccttcgctgctatctgcctgctttttttttgagacagagcctcgctctattgcctaggctggagtgcagtggcgcaatcacagcttactctgcagcctcgacttcttgggctcaagcaatcctcctgcctcagccttctgagtagctgggaccacaggcatgcaccatcatgcttggctaatttatttttatttatttttatagagaaggagtctccctatgttgcccaggctggtctcaaactcccggactcaaagttcattgcagtttcaattttttccttggctcaaggatcctcccacttcagcctcctgagtagctgggactacagacgggcaccaacacacctggctaatttttgtattttttgtagagatggggtcccactatgttgcccaggcttctatctgcttttatctcaccttccactcttccatccttcctttcttttcttttatttcctttcccttcccttgccttccttttctttctttctttctttctttctttctttctttctttctttctttctttttctttctttctttcttgacagagtctggctctgtcacccagactgaagtgcaatggcaagatcttagctcactgcaacctccacctcctgggttcaagcaattctcctgtctcagcctcccgagtagctgagattacaggtacctggcaccacacccggcaattttttttttttttttagtagagacggggtttcgctatgttggccgggctggtcttgaactcctgacctcaggtgatcctcccacctcagcctcccaaagtgttgggattaacaggtgtgagccactgtgcctggccttttttttttttttttttttttttaagacaggaccttgctctgtcactcaggccagagtgcagtggcactataatcactttctgcagccgtgacctcctgggctcaagggatcctcttgccttggcctccctagtagctgggactacaggcatgtgccaccacactggctaatttttaaaactttttgtaggccgggcacggtggctcacacctgtaatcccagcactttgggaggccaaggcgggcggatcacgaggtcaggagattgagaccatcctggctaacacagtgaaaccccatctctactgaaaatacaaaaaattagccaggtatggtggcgggcgcctgtagtcccagctactcgggaggctgaggcaggagaatggtgtgaacctgggaggcggagcttgcagtgagctgagatcacgccactgcactccagcctgggcgacagagcgcgagacaccatctaaaaaaaaaacaaaaaaaaaaaacaaaaaactttttgtagagatggattcttgctaggttgcccaggctggtctcaagcttctaggctcaagcagtcctcttgcctgtgcctcccaaagccttgggattacaggcgtgagcccccacacctggtcctaacccactttctgaacttccaaccacaccattttgtcctaatatttaagtcacaccataacatgtcccacttcagaaatgcctaccaaagtagtcttcaaatctttttaaatcagtggaccctttctaccaaacaaatgttattttttaaatatttattttagagtaatttagacttttagaaaggttgtagctgggcgcagtggctaacgcctgtaatcccagcactttgggaggccgagacaggtagatcacctgaggttgggcgtttgagaccagcctgggcaacatggtgaaaccccgtctctactgaaaatacgaaattagtcaggtatggtggcacgcgcctgtagtctcagctactcgggaggctgaggcaggagaattgcttgaacccaggaggcggaggttgcagtgagctgagatcgcgccactgcactccagcctgggtgacagagtgagactccatctcaaaaaaaaaaaagaaaagaaaaaaaagaaaggttataaatatattataaagagttcccacatacccttcacccagtttctcctgttgtttgtatcttatattatcaccatatgcttgtcaatgctaaggaattgctgggtgcagagtggcacatggctgcagtcccagatactcaggaggccaaggcaggaggatatcgcttgagcccaggagttcaagtctagcctgggcaacacagtgagacctcttttctgcaaaagaaaacaaataaaacatctaaaaaagaatacactggaggcggcgtggaaacaaggatctcatttgggagttgtctgcaatgttctgagcaagcagtaacggaggcctcaagtcagggctgtggtcatggaggtggggaggggtggttggtttcactatctgtgttgacttaattttagatttgcagactcaactgagtatgaactttaagagaaagagagaggccaggcacggtgggtcacacctgtaatcccagcactttaggaggccaagtggggaaggccgcttgagcccaggagtttgacaccagcctgggcaacatagtgagacccctgtctctacaaaaaaaaatttttaaattagccaggcagggtgatgtgtccctgtaatcccagctactcaggacagtgaagcaggaggatcatttgagcccagaaagttgaggctgtagtgagctgtagttgcaccattgtgcttcagcctgggagacaaagtgagaccctgtctcaaaaaggagaatggggagagagagagagagagagaaggagaaagagagagaaagagagagagggaagtcaaggagaaccccacattttttgacatggtgtattagtctcttctcacactgctaataaagacatacctgagactgggtaatttataaaggaaagaggtttaatgcactcacagttccacatggctggggaggcctcacaaccatggcagaaggcaaaggagaagtaaaggcatgtcttacatggcagcaggcaagagagcttgtgccatttataaaaccatcagatctcatgagacttattcactaccacaagaacagtatgggggaaactgcccccatgattcagttatctccacctggcgccgcccttgacacgtggggattattacaattcaagttgagatttgggtgggaacacagccaaaccctatcacatgggcaagtgaaaggatgggtttgccatcaaataaaatggggaaggagactgactaggtgggcagattaggaactcagctttctatgaagtgcctactgatggatagagatattgtgttggccatctattaggttggtgcaaaagtaattgcggttttgccattaaaagtaatggcaaaggaaataacctttgcaccagcctaataggaattggagtctaaaattcaaaaaaggtaagtcagagctggagatccaaaggcaggagtcagcctcctgtggaggctatttaaggaactgaataagggcatagatgcaggagagcacccaggactgagcccagggcttactctccatcattaaagaggttggggaagatgaggaggagccagcagagaagactgaattggagcaaatcagaagaatgtgggtgctggctgtcatgcaaggaaagtgctaagccatttcaagtatgagggaatgatcaatgatgtccactgatgctgatgtgttgactcaaatgaaaaatgagaatcaaccattggatgtagtggcatggagatctttcgtgacctgagccagagctgcttaggtgaagaggtgaaggcaagaggctactggaaggattactactagctcttttaaagagttctgctgtgaagggtagaggaagagagatggggcatgtgttagctggtgggggaagtggatttcagaggtttgtttcccttaaaaaaaaaaaaaaaaagaaaaaagaataaagaaaaaaaaaaggccaggcacaatgactcacacctgtaatcccagcattttgggaggctgagacctcgggaatttgagactagcctggacaacatagtgagaccccatctctacaaaaaaaatttttttttaattagctgggcatggtggtgcatgcctgtggtcctagctacttgggaggctgaggtgagaggatctcttgagcctgggaggtcgaggctgcagtgagctatgatcacaccactgcactccaggctggacaacagagcaagaccctgtctcaaaaaaaaaagatgggagacctaacagcagattttatgctgataggaataacctattaggggagaaaaacatgaggatgctggaggaagaagagtgtcaggaggacatctcttggtggacgagaggggatggcatttggtgtacaggtggaaggtttcactttagatgacagcacacacagttatctatagaaacaggagaaaatgcactatatgggcatacatgctgggaggtagagagtaaataatagtggtggttgcttgtggaaattctcttctaatgtttttatatttttatggtttatcaaggacaatttatatttttacagtttactgcaaacaacaagttctaatttattcaataattatttgtgggtagaccgagtgcagtggtgcatgcctgtaatcctagcactttgggaagccaaggtgggaggattgcttgaactcctgattcacttctgagcttgaatcaggagttcgagatcagcctaagcaacatggcaaaacactgtctctacacaaaatacaaaaactagccaggtatagtggcatgcacgtagtcccagctattcgggaggctaaaacgggaggatcatttgagccctgaaggtggaggttgcagtgagccaagagcgagccactgcactccagcctgggtgatagaataagaccctgcctcaaaaagaaattcttattcttcttcttcttattattatttgaggagacatttactttgtaccaggcgctgtgctagatgctggagatacagacatcaacaatgacaaggctaagtgcctggcgtatttgtactttgagtctaataaaagacatcacacagacacacaacacacacacacacacacacaggattgtcaaaggatcaaccatttcacatgtcaagatcaggaatgatattggtctactactgccttaccatatctcctaccatgacctcatcttcctcttgccagattttaagtctttatacctcaactcccagaactctcttcgcctcacaccctatcacaatgtcatccgtaccccacggccaatactccatcattcgggaaagcaaagttccaaagcgtcaagattgtatcaatggacctgtctctatggcaacagtcctgaatgagccaagcaaggtaaccctggagatggcgtgaatgagaaagtggcctgttgccacggagacgtgctgaatgggaaggcccccacgagccaggctatgtcacgaagccgaaacagtcagcatgaagtcggtatgtctattttcaactcggaattacaaaaatacattttaatagagctcatgacccatctccttcctcgtccctgcctcccaccccactcttcagccttcatcctacaacacaatcgagcctcaccaggaacccttcaaacccctcaaggacaccttactgttccttcagtacacagtccccttcctgggctgaggtggtattcctttgaccaactactgtctcccctttgggaccaacagtattctcaaaagccatgagcttatgggaagaacattaactacattctttggggcaagaacagttgctcacctgtgaaccagctcagcttgcatctgtgagaatgattgcaatgggtagaccagttctccatcaaagaatggccctagcaccccacacacagtggtataatctgatcatgctggtgtattgaacatataatgttagtgccacatgaaaggaatttgtaaaaggacttagtgcctagaaaggtacctttgaagatcttggaatctctgaaacttacccaggttccttataccctgctcaaagtattcctccatttatttcttcattcattagttcttttgtttcaccacatatatatttttgaaacggggtctcactctgttgcccaggctagagtgcagtggcaagatcgtggctcactgcagcctcaacctccccatctcaagcagtcctcccacctcagcttcctgagtagctgggacaccacaggtacaagccaccacgccaggctaattcttgtaatttttgtagagacggggttttgccatgttgcccagtgtattcgtttgttctcacattgctataaagaactacctgagactgagtagtttataaagaaaagaggtttaattgactcacggctccacaggctgtgcggaaggcatggctgaggaggccacaggaaacttgcaatcatggcggaaaatgaaggggaaacaagcacatcttcacatggtggcaggagagagagagtgagggggggagtgctacaaaaccaggtctcacgagaactcactcactgtcatgagaaaagcaagggggaaatctgctcccaggatccaatcacctcctaccaggtccctcccccaacattggggattacaattcaacatgagatctgggtggggacacagagccaaaccatatcacccaggctggtctctaactcctgagctcaagcaatctgcctgccttggcctcccaaagtgctaggattacagacgtgaaccatatttattaagcattgttacagcaaagagaagcattgttgcagcataacaattggaagactccattgatggacgtctccatcaacaagaactgtcggataaactatggtacacccatcccttagcgtgttatgaagtcattacaaaaagaagaagcagatctctgagtgtcaataagagctagtacttatagggtgtctactgtatacaagtgctgttagaaagtgagtattaactcatttaattcttgtaacaagcctgtgaggtggattctttcatatccccattttacagagaaggaaataggaatctctatatccaagatatgttatcaggtgacaaaagcagtttttgaatggtgccgccattttctcgtaagagcaaatctggaagattccatgagaaattaataattgtgtttgcctctgtagcggcaccctgaaagatttggaagtaggtgtggaaaggaaacttactttcttgtgtctttctgaattttgtactgtctacgcgttttgtctttcacaaaaccaaacagaaaatgaccatttggtgcattttgtgtgtcaggcattcttctagtctagagaagcacaggagagcaaaatattttactgacgagaaaaatgaggcatggagaagttaagtgacttgcccaggtagcagagctgggattccacatcatagggtttatacaggaaacaggtaaacagagctgtgcttgtgtgtgggtatgtgtgtacacatgcatacatgtgtgcatgtgtgtgtgtgtttgtgtgtgtgtgaatgtgcttgtgtgttgggagagggaaatggcaagagaagaacctacagaaggtcagcaggaaccaacccatgttttgaggagtttggactttatcctgaaggcacaagggagccatggaaggatttagacaaggggtggttgtgcttagctttttatttagaaggatgactctggctgaagggtgatggcccagaatacaggtatatgtgaaggactcctcctgccctagtaggaggatgcccacccaccctctctgcccagtgcagtatcaaagggcaaattgggtacagagaattctcaccaagctgggtagaatccactctgatgctggggagtggacactgaatgcaccagcctctcctcctgctcaatccctgaattgaagctgttccactaatgttagggatcagattcccttcatatatatatatatatatatatatatatatatatatatatatatataattttttttttgagacagagtctccctctgtcacccaggctgaagcccattgtcgcgatcttggctcactgcaacctccacctcccaggttcaagcaactcttgttcctcagactcccaagtagctgcgattacaggcacccgccaccacacctggctaattctatatttttagtagagacagggattcacctatgttggccaggctggtcttgagctcctgggctcaagtgatcagtctgcctcagcctcccaaagtgctagtattacaggcatgagccaccatgcccgtcctttttatattacctttttttatagagatgtggtttcactatgttgaccaggcaggtcttaaactcctggcctcaagcgatcctccctcctcagcctcccaaaatgctaggattacaggtgtgagccactgcatctgtccagactctgttctccataaagctggcatatggaaagagggaagaccatccaggcaatatcgaagtcccattggtgctgatgtggctgctgagaccacatgaatggatgcattctgactctgccacctctcagctatgtgaccctgggccagtcagcaagtccctctataactcagttttctcatctgtaaaatggcgtcaacagtagccaaccccagcaaatactgtgaaatatacagaacatcattataatggtgaggatgatagagatgctatgttatcagaatacctgggcttgaaccagctccccttcttgcaagctgtgtgacttggagctgatgcccaaacctctgtgggcctcatttgtttcatctgttcaatggggataataacactcttacttcatacagttatggaggatttattgaaataattgacatacagctcttagaacagtatccggctccttgtaagcgctcaagaaatattacagactgttgataataatgcaatactactaccaataatatggccaggagcaatggctcacacctgtaatcccagcactttaggaggcagaagcaggctgattgcttgagcacgggagttcgaggccagcctgggtaacatagggagactctgtctttacaaaaaataaaaataaaaatacaaataattagccaggtatggtggtgcatacctgtagttccagctacttgggaggctgaggtgggaggattgcttgagcccaggaagttgaggctacagtgagctgtgatcacaccactgcactccagccagggcaacagagtgagaccctatctcaaaaataataataatggccgggcgcgctggctcatacctgtaatcccagcactttgggaggccaaggcgggcagatcacttgaggtcaggagtttgagaccagcctggccaacatggtgaaaccccatctactaaaaacacaaaaattagccgggtgtggtggcggggtgcctgtaatcccagccactcaggaggctgaggcaggagaatcgcttgaacccgggaggtggaagttgcagtgagccgagatcacaccactgcactccagcctaggtgacacagtgagactccatctcaaataataatatgagtaataataataatatcatttttatcatcattcttactaacagtctctcactccttgccctgcagttttgcctgttttcttggaataacactcttccacacctttcccctcagggatggttcacgtttagcatcatgacccacccctggggattagttagctcatttctggaaagcactttggagctgtaggtgctttgcaggctggaaacatcacgggacttgtaccatatttaagcaatgccagattattctgcctggcagggggaggacacagaggatacggccctggtatcttttctccctgcctacctcagctttgctctgaaccattttctgtcctgttcagggcagcctgggccacttgccacttccagctttctcgggagaggatgccttcctgatggcacgcctcttaacacacacctggtgctgttgttgaaaaagcaacaattgactccagcgccagcactgagaggcttgtccttaaaattagcaggagctgttggaaggtcgctgttagctcttttgactggaacacactgttccccaggtggcatgaggctgaatacagtgcagggattggctctgctctcaggtggcctgctccacgctcctgagctccgggtggaagctgtgaccattatttccttaacagaaacatatatagcagcattaactatgaaccttattactgtgtgtgtgtgtgtgtatatgtgtatatatatatatgcacatatgtgcatatgtgtgcctatgaacctgttctgagcactttacaaatgtcaatgtattttatcctcccaacaacccattttataaataagacttgaggcacagagaggttacgttactgccccaagatcacacagctggagagtggtgaggccaagatttgaacatatgtaccattgtaccatatgtaccaactttttttttctttttgggatgcattcttgctctgtcacccaggctggagagcagtggcatgaccacggctcattacaacctcaacctccaggttcaagctatcctcccacctcagcctctcaagtagctaggaccacaggtgcataccaccatgcccagctaatttaaagtttttttttgtttgtttgtttgtttgtttgcagagatggggtctccttatattacccaggctggtctagaactcctaggttcaagcaatccccccacctcggccttccaacatgctgggattacaggcatgagccactgcacccaggtcctccctccttataaaggtcgccaagcacaatcttgtgagcctggccctatccacacccatacgcaacatggtgtgtatttttcaaacaaaaactgaatgaacacctctggtttgggttcccctcacacttgtcccgggtttgttgactctgtgttgtgggcctagacaaagcagtgtctggagctcctagacccagggaccagacagtctgggttcaaatcctggctcttccacttctgcctgagtgctctctctgaacctgtctttctttatctataaaatggagataatttttttaaactcatcacttggtcaaactgctttgagcatgcaaatgagttcatatgtataaacctcttagaatgtcccaggcaaagaacaacacttcactcagatcaacatttatttagcatctactgtgtacccatgactattctaggtgatgaggagaccctctggttcttatgaggtagtgaggtgggggagggtgagaaccctaaacattaacgatggtgtgttcgcaggtgggaaaatcagtaaagtcgggtaaagggaatttgggagtgctgtgctcaagtcctggccctgccactttctggggtgcaagatacagcattgaatagggtggtcagggtaggccttattgggaaagtgatatttgagcagacgatctagatgtcggcacatattgctactgtttgatggtactaatatgagtttgagtttcacttgcaagtatatatatatatatatatatatatatatatatatatatatatgtgtgtgtgtgtgtgtatatatatatgtgtatatatatgtatatatatgtgtgtatatatgtatatatatatgtgtgtatatatgtatatatatgtatatatatgtatatatatgtgtgtatatatatgtgtatatatatgtatatatatatatgaaatttggtccatttatttatgctgatcaattaattgatgttgaaattataattgaatgttttattaataaacagatacccacatactattttttcagaaattgttaggttttggggttttctttagattttgattatttttatttgcttaattttcttttttcttttttttaattttatttttccataagttattggggtacaggtggtatttggttgcatgagtaagttcttcagtggagatttgtgagaacctggtgcacccatcacccgggcagtatacactgcaccatatttgttgtctgttatccagtgctcacctcctactcttccccccaagtctctaaagtccattgtaccattattttactcacccacattctttggcctgagatgctgagtggtcatgactcccagatcccttcttgtttctgtatcaaagatctttactaagatcctggcctagggaacctattccctttcctcatccccaatgggagaaggggcttcttccccagcttatttgccaactcataggaaaggtatgaaggagaggactgtagttgtcttgaagctggtcagatgttgaagagatgataatatttgctgatcaagagagacaaagcaatgctggaagaagaggctgtgttagttaacaccagctgcaataaccaataaaaccaaaaatctctggcttaagagtatgcatgagtgagaaatcaacttctaaagtacaactggtggccggatgtggtggcttatgcctgtaattctagcactttgggaggctgtggtgggagggtcgcttgaccccagtagtttaacgccaacctgggcaacacagtgagacaccatctctactaaaaataaaaaataataaagtgaaactggtgaggggtgcaatgaggtggagtggtgggtgactcaaatatggctcgactccatgcagtcactcagggatccaggctgttggaggctctccctgcttaaacatgtggcttccaaggttgttctaagagcctacattgagacagcagctggggaaaagggaaagtggagtgggaggtacttatgagggttcctggaagtggtgaacaacacttctgcctgcattctattgggtggaatttagtcatgtggcccaggctagctgcatgggaggctgggaaatgtagtctctgattaggctgccatttcccagtcccacttgtgaatctttagtgggaagctcaccatgtttgcaccagggattcagtctacctcccactcatgcctcaactatgtatcaggcactgtcgtaagtactttacatatcagcctacctaatgcaaacaactactcagtgggtgctttattggtcacatgtattagtgagaacatggaaacccagagccgttaaatatcttgcccaaggtcacacagctaggaagtggcagagttggaatttgaatccaggaaatctggctgcagagccccacgcttagtataaattcattgtagtttagaaagaggcagaaggaccctaaaattggcataatccattttttggtccctaaggaactgactgaattgactacttgtaaaagtgagtcctggacaggcaacagtggctcaggtctgtaattccaggactttgggaggctgaggcgggcagatcacctgaggtcaggatttcaagaccagcctggccaacatggcaaaaccctgtctctaaaaaaatagaaaaattagctgggtgtggcggtgggtgcctgtaattccagctactcaggaggctgaggcaggagaatcgtttgaacctgggaggtggaggttgcagtgagcaaagatcacgccactttactccaacttgaatgacagagcaagactctgcctcaggaccgccatggccccctgggttctaggtcagagtttctccgccacagcactgatgactttgggggctgcattattagctccaaaatgggagctatcctgtgcactgcctcaacttacttgatgccagtagcgcccgcgccccagttgtgagaaccaaaaatgtctccacacattgccaaatgtcccctgggaggtgaaatcacccctggttgagagtcactgttctagattgttaaatattatcttacactctagcacaagtccaaggcaaactgacttagaaattaccaaccttgcaaaaaatagaagatttcttaaagtcagtgagcatgatggtggcaagctgctgaaatcacacccccagacattagcagatgggatctggacagtattcatctagttaaaaattgacaaggactgggacactgcaggctcttcaaaagagaatcatttgaataacaaggggtcaagacaggggtaattggtgaaagcccctgctcataatttgaaaatataaataggcatcatgaaaattcatcctgcaaaagtcaaaagtcgaatgtgcagtgttatacatgatcagttgatttgggaggggaaattgcatgcacacacatgagagcttgcacacccacacacacacacctgttcaagtgtgtgtgccagtgctcagtgaggaccatctccccaacctgtctgatcatcttgctttggggtgaccctatgggtgaggcagaaattcttggatcatagttttctaatgaatattataattgttaacttctgatgggtgctgactttttcatctttgcaacactgcgtaggtatttttactctccccattttacagatgagacaactgaggctcagaaagattgattagctctacacgaagccaggatccaggcttagcctggctccaggaatcatgttttgagttacgtagcttccctgattctgagggacctccccacttctgaaatcttctactgttactccccatggccctttcctattgaccggaggcaccccagctcctcactcgtcccttatcttatgaaacatgaccatgatgtctgaattcaaaggagagcctgggctttgtggggaaaacgaagcagaaaaagaaaggtggaggttggtggttgtttttggcatggtgaggagcctgtcgttgcttgaggaaagcaagaaaggagattgctggggcttggatccatctctgggtgcctgtgggtctgtctgtaaaaatgagaactggtcgtgctcattagaggatttgaccgttaggccttgggatagcgatttgggaacttttttctgctaagacaaagaataatatggttcaggttcattttgctcctgctttcccaagccctacatctcttctgggcttttttttttttccttttctctccttcttcttcttcttcttcttcttcttctcatttttggatctggacttctgctgactcatctctctgagcaaggaaggagggaggaagtcagaattgctcattaaccgttttctttagtgactcagctgtgattcacattttaattaatggaggagaaaaacctgatcagtcctaaggcatctgcccaatcacgcataactccaggctggtgataataataatacttgaaaaaagtggggtgtcctgaattaaactatggctcattccccacattagtcttgaggactccaccaggccctctaagttccaggtctcaatggggctccctgaaccagagcagctagtccaagccccgagcagcatttctgcagagttagtctgaggtcaggacaagaaacagaggctcaagccctcctgggatcgcaggaggatcatgggaatgtaatattgtttcctgagctggtctttggctataatcccaggctcaagcctggcctccctcccctcggggcctgaaatttgtcagagcctattgcaggggcagcttctgtgctttttgtttgcccagagaatgagaaaagtccagataatcatgaccgctacttcctgagcacttactatgcatcaggtggtgtgctcagcacttctcatgaatgatcacgttgaatcctcactctgtccacaaaaagaaagagcttttatataattctccaacctccctatgaggaaactgaggcttggcaattgcccaatgtagacaattagtaaataatcaggcaggatataaacccaaccctttcccacctgggagccagagcttgcatctactatacttctctgctttccagtcagctgcaaagaaaaattggaagctgatagctcattcaacaaacacttattgaacccttccacctgctcagccctgttctagacaccagagatccatcagtgaaccaaagaggcaaatccatggtctcatgaaactgacaatttacctgcccaagtgtattagttactgtttataagttcctattaagtgtattagatatgcttgcagctgtaacaaagaatcccaacatgcataagggctcaaaacaataaaaatttcgttcttgcacagataaagttcaaaaggtgtattctttttttttttttcttttgcgacggagttttgctcttatcctccaggcatgagtgcaatggcccagtctcggctcactgcaacctccacctcctgggttcaagcattctcctgactcagcctccccagtagctggaattacaggtgcccgccaccacacctggctaattttttgtatttttagtataggtggggtttcaccatgttggtcaggctggtcttaaactcctgacctcaggtgacccacctgcctcggcctcccaaagtgctgggattacagccgtgagccaccgtgcctggccaaaaaaaaaatgtattcttaaacagcaggcacctctcctctaagcagtaagtcaggggcccaggcttgttccatattgtagctcctcatcttcaacccatggcttccaaagtctccatgcttcttgatatcaagccacagaagggaaaagagcatgagaagggcacaggagaaatgtttctgggacagacccagaagtagtccatatgacttccatctacctcccactggctagagcttacatggcggcacccacttgcagagctgggaaatggagtctaactgagcatccaggaaggagagacagacatgagtctttgcgtgggtcctcactgagaatcaagctccacattttgatcgatgtcaccagagcgtacatggcggcgcccacttgcagagctgggaaacggagtctaactgagcatccaggaaggagagacagacatcagtctctgcgtgggtcctcactgagaatcaagcttcacattttgatctgtgtcacctccttgcaagccctaccttaggacaattttaagggacattcctatcttcttccacccttaggacagttttaagggacactcctgagttcttccacccacctcctctgtttcttgggcttccagctctcaggatttgcctttgccttacaatggggtgaagcaagaatctggaagaatgtctctccccacaatttgaagtcttatttgaaaaaaagcagtagagcatccctccctcttgaggtagggaaatctagaatcaaatcctgcttctccagactttgacctcagaaactggggggacttcaaggtcttcaggtgggcagctttcatgaaccattcattcctcccacctcataccaatcagggtcctaacaggaaaaagaattaacttctagatggttcaaaagaagaccatgccatgaagagactccttaaagagataggaacaggtgagagaaatagataacggctgtttgaggtcctcagagagaagccatcgcgagccctacatttcctggaacccagtggaggcagagctgtgcagaagggactactgtcagaaccagggagggagcagggaagcaatattccaatctctttccctcccctcatcttctgccagcgcttcccctcagccaaaccaaaccggaaacggagcaaagcattctgggagttgtagtcttcaagggtccgcctcgagggcacagagcccgctggagcattgacctagagggcacacagggaatgactagtttgcaccatcatgtgacggactgcacgccctcgattatgtaatccactctataattcaactgcagagctgcatggtacagcaggatagccactagccacacgaggctatttaaatataaatgtacattcattaaaatttaaccaaatgaaaattttagccactgagccccatttcaaatgctcattagccacacgtggctcttggctaccatattggacagatcagaatagaacatttccatcatcccagaaagttctaggggccggcgcagctgtggtgtaacctgagcccatgcatgttatggaatggagaagagagaaaacagcacaagaggcagttttgaagggagacagagagctgtggatcagtagggaggagactctctaggcaaaggagcagttgagaagcaagaaagttgagtgagctgctttgctgcgatggaggcttccctcacggggaagagtagagtcagaaagctttagttcaagttcagctctgaaatgaaccaatgagtgttctgacaagacacctggccttccggaaccttggttttgtagtggccaagggcttgaccctctgaaggttcactgaaaaaaatcaactcacaaggcatattaattggagaaaaggcaggcagatttatttaatgtgtttgcacgagagccttcagaatgaagacccaaagctgcaggggaaattgtccgttttttaagcttaggttcaacaaagtatggacagcggtgtagaaatatgattgaacaaaaagtgtacaatgtaaatgctaatagactgagtggggaaacccaaaaagggctgtcttgattctccttggtctctctgagcatgcatttcttccgggtatgggacaagaccctctctggaatggagggggggctctcttggttctccttggtctctctcagcatgcattccttccgggtatggggcaggaccctctctggaataagggggctgtcttgattcttcttggtctctcagagcatgcattccttctgggtatggggcaggaccctctctggaatgggatccttataacctacggtcaaataacgtaagttagataatttcttttttttttttttcttttttttgagacagagtctgattctgttgcccaggctagagtacagtggcacaatctcggctcactgcagcctctgccttctgggttcaaatgattctcctgcctcagcctcccaagtagctgggactacaggtaagcaccaccatgcccagctaatttttgtattttttagtagagacagggtttcaccatgttggccaggctggtctcaaactgctgacctcaagtgatccaccacctgggcctcccaaagtcctgggatttgtaatcccagcatgagccactgtgcccagccagatcatttctttttctttttctttttcttttctttttttttttttttttgagatggagtctcactctgttgcccaggctggagtgctgtggtgcaaactcagctcactgcagcctctgcctcctgggttcaagcaattctcctgcctcagccttccaagtagctgggactagaggtgcgcgccaccatgcccagctaatttttgtatttttagtagagacagtgttttgccatgttggccaggctggtcttaaactcctgacctcaagtgatccacccacgtcggcctcccaaagtcccgggatttgtaatcccagcatgagctaccacagctggccagataatttttttataactagtttttacaaagaaaggtggagggaaagttagagtaacatttttaggtgttagggctgactttggggaaaagaggtctggtttctacgacccgccttagggaagagggattctagtttttgtggctagccccaggggagaatgggactaagagatagaagggcaggagaaggtcagagaaaaacttttgcttctgtggctgcttcggagaacttcattttggggtattgttttctgagccccaacagtttgcttatcagtgaagtgggtataggcgcccacctcccacagtgacgatgctgtgaacagggctttggaagagtagaactatgaaatatttgttgttgccttgtggggaaatggtcgttaaagccaaaattgttcaagagaagaagcaggaagagttcctttctttcctgcaggtatcctcttaagctgagtcttcagaatcccctgacaacgtttaatcaacactttattaaattcaccccaaccctgcttcaaaccttcacctggtcctcgagatcttccaactgtttcttgatgaagttagcaggcaattgtatggcgggatcatcatctcatgttttgttttgtttttttcctttttaccctctgactttgagaaatccttgtccttttacttttccaaacctgagagcattgcagagaagttagaattgagcaggacatgggcttaagacccagcccagccatgtgctagctgtgtgaactcgaagcagtgaccccacctctctgacctggaaagtagagggaatgataggacccaccaccgccacacttgtagggtcatcatggggattgaataaaataatgcataagacttggcccacagcaagcactcaagaaatgttagctacttcctaaatatatttttaaccttttattgaatataacatacatacagaaaagcacatgtatcatacaagtagagcttgagtgattttcaaaaactgagcccagtcatgtaaccagcgcctagttcaagaaacagaacatagccgagtgaggctgaggcaggagaatcacttgaatctgggaggcagaggttgcagtgagcagagatcatgctatcgctccccagcgtgggcaatgggggcggaggggaagagagagagagagagagagagagagaggaaggagggagggaaggaaggaaggaaggagggagggagggagggaagggaaggaaggggagagagagaaaaggaaagaaaagaggaagacagaaagagagagagaaaggtaaagaaagaaaaggaaagaaagagaaagaaagaaaagaggaagacagagaaagaaagagaaagctaaagaaagaaaaaaaggaaggaaggaaaatagggagggaagaggaggaggaagaagaagaagaagggggggagggagggaacagctgcagcttcgaggaaggaaggagggagggaaggaaggaaggaaaggaaggaaggaaaaaaaaacagcaccaacgtttagaaacccccttgtgcctctgaggtcaccagtaactccatcctgacttcaaacagtctagattagttttgcttgtttttgaactttaagcacatggggtcatacagcatgcatgcattgacttctttcccttgacgttgtatgtgtgagattcatctgtgctgttgctgttcatttgttctcatcgctgtgtgtgctgaaccacctgttcatttactctactaatggtgggcagtttggtgctttctactttggggctattccagagaaagctactttgaacacactcagatatgtctgtgggtgaccactcttcatatttctatgggagatattcctaggaccggaacatctgagtcagagggaggaattggtttagctttggtaggaactgcctaacaattggccgggcacagtggctcatgcctgtaatcccagcactttgggaggctgaggggggcaaatcacttgagctcaggagttcgagaccagcctggccaatgtggcaaaacccctggccaacatggcaaaaccccgtctccgcaaaaaaatacaaagattagccgagcatggtggcgtgtgcctgtaatctcagctactcaggaaactgaggcaggagaattgcttgaacctgggaggcagaggttgcagtgagcagagattgcactactgtactccagcctgggtggcagaatacatgaaactccatctcaaaaagaagaaaggaaggaaggaagggaaggaaggaaaggaaactgcccaacagttttcccaagtgtttgggatggaaggaaggaaggaaggaaggaaaagaaactgcctaacagttttcccaagtggttggaccagttaaaactcccaccacctgtgaatgagagtttgtttttattttgctcctggagtgcctctcctgtagcaggttcccactgaatgtctgggaattcaaatgtaatgcacttgttcatttcctcaagagcttcactccatcaattggattcatccattggctctcccatctccactgacactatgttctcacctctatttggaagacatcctgcctccacctgcccaagtcacattatcttctcattccagcctctcaaggagagttttctctttcaccacctcctctagccctggtgattggcaaggtctcgcaacagtacccttcaaaacactcatgactgtgaatgcactggccttcactaagtttcccattcttctctttctttcttttttcttttcttttctttttttttgaacagagtttcactcttgttgaccaggctcgagtgcagtggcacaaacacagctcactgtagcctcaacctcctgagctcaaggtatcgtcctgcctcagcctccttagtagctgggaccacagacatgcaacgttgtgcccagctgattttcttttttttctttttttttttttttttgagacatggtctcaccctgtcaaccaagtgcagtagcatgatcacagctcactgcagccttgacctcccgggctcatgcgattctcccacctcagcctcccgagtagctggggctacaggcacaagccaccatgcctggctaatttttgtacttcttgtagagaccaggtttcaccatgttgcccaggctggtcttgaactcttgggctcaagcagtcctcctgcctcagcctcccaaaatgctgggattacaggtgtgagccagcacgcccggccatggctaatttcttcatttttggtaaagacaggtctcactttgttgcctaggctggtcttgaactcctggactcaagcaatcctcctgtctcagcctcccaaagtgctaggactaccgatgtgagccaccgcacccggcaatttccccttcttgacttctccagagctctcatccctctcgagctcctgtctcttctagaatcacttacctcaccaccttatggggtttttgcctctgttcctactcctctttatttaagaaaacactgtactttaagagggcttcagaaaccacccgaaatagaaacatgtccttttgttcaatcctttactttaaaagacaaataaaatgaagaattgctctccatgtagaaggttaaggagcttgggaggaccttctgtgagtggggagaactttacattaaaggaaaaaaaatgctggagaatagctgtgaacccaggaagggagaaggacttcctccactgaacttgtaaagcacaaactctaaggcaaaaaaagacatgattacatgaaaactaagatatttgttcaaataaagatgcaattggggccaggtgcggtggctcacgcctgtaatcccagcactttgggaggccgaggcaggcgaatcacgaggtcaggagatcgagaccatcttggtcaacatggtgaaaccccatctctactaaaatacaaaaaattagccaggaatggtgtcacgtgcctgtaatcccagctacttgggaggcttaggcaggggaattgcttgaaccagggaggtggaggttgcagtgagctgaaatcacgccactgcactccagtctagcgacaaagcaagactccgtccaaaaaaaaaagatgcaatagcaggtggttcgggaaccaaaccttacatccagatgctggttgtcccatttcctgtgaatccttgggtgagttatcaacctctctgagcctcagtttcctcgtcaataaaatggagaaaatagtatctacctatggaattgttgtgagttttgaatgagttaatatttataaatcatttagaataggaattagcacatggtaaatagtggatagaatcataaaaaaaaaattgatcaggggttaacttctaactgctgtttgttatagaggtccctagcactgtgtggtcattttaaatttagatgatttagaattaaatgaaatttaaaactcagttcttcattcacactagccacattttaagtgctcaaaacccacaggtgactagtggctaccatatttggcagcacagattgagaacagatttatcatccagaaagttctgtcagacagtgttgatcaaggctacatgagggtctgggtgcagtggctcacacctgtaatcccagtgctttggaaggccaaggtgggaggatcactggaggccaggggtttgagaccagcctgggaaacagagagacctcatctctaccaacattttaagaattagccaggcaaagtgttgcatgcctgtagtcccagctactcaggaggctgagacaggattgcttgagcccaggaatttgaggctgcagtgaactatgagcgcaccgctgcactccagtctgggtgacagagtgagacctgtctctaaacataaaaaataaaaatgtaggtggggcatagtggctcccgcctgtaatcccagcactttgggaagccgagatgggcagattgtgaggtcaggagatcgagaccaccctggctaacatggtaaaaccgcgtccgtactaaaaataaaaaaaaattagccaggcatggtggcgcatgcctgtagtcccagctactcgagaggctgaggcaggagaattgcttgaacctgggaagcagaggttgcagtgagctgagattgcgccactgcactccggcctgggcgacagagcgagactctgtctcaaaataaataaataaataaataataataaagtaaaaataaaaatgcaaagactacctgagggaatgtctgcaagtcaaccagaataacacagcaaccccaataggaaaacaggccgaaaatgtgaacaggcggatcagggaagtgaagtctgaaaagctaatcagcctatgacatggtactcaaagtcatttgtaaccagaaagatggaaatgaaagcagtatctctgtacacctttaatattggggaaaaaatatgtgaataagccaagggtttccagcgatgcgggcacagaggaaagtcttgcaccactcaaaggggtgtggcccagggaggccactctggagacatatcggtagtactcagtccagtgaggtccagcaccatcagcgcttatgtccccaggcatccatcccagggacattcttaccaggtctgttaggggcaggtacgagaatgcttactccagcaccatctatataaggggagctgaaggccacctggtgtccctcctggagaccaggaggcggcatgtgacagcggcacccatggagcaccagaatgagtgagagctccagaccgcatatccgacagatactacgggatggggcttttagaaatatggttgttgccgggcacggtggctcatgcgtgtcatcccagcactctggcaggccaaggcgggtggatcacctgaggtcaggagttcgagaccagcctggccaacatggtgaaaccctgtctctattaaagatacaaaaattagctggacgtggtggcgggtgcctgtaatcccaactactcgggaggctgaggcaagagaatcgcttgaacccaggaggcagaggttgcagtgagccgacatcgtgccactgcactccagcctgggtgacaagagcaaaactctgtctcaaaaaatttaaaaaacaaaaaataaaaatatggttctgggtgaaaacaggaaacaacagaatgtgtctaacttcatcctgcttatgtcagttaaaaatagacacactcaaaatatcgcacgtgtttttgcgagaatgcactcctataaggccaaattaaacattctctcagttgtctctgggagggagaagaatgaaagtagggtatagagagatataggggaattaatgcatgaatgaatgaaggtataaacaagagacaggcgtcatacagaccaaaggtaaagatatcccgtaacctgaggagagcaaagaacttgactctgcatttgaagattcagaaaatgaatttcagaaatagttttctcgccagggggtggctcacgcctgtaaccccaccactttgcgagggcgaggcaggtggatcacttaaggtcaggagttcgagaccagcctggccaacatgatgaaaccctgtctctactaaaaatacaaaaattagccaggcatggtggcatgtgcctgtaatcccagctactcaggaggctgaggcaggaaaatcacttgaacccgggaggcagaggttgcattgagctgagatcacaccattgcactccagcctgggtgacagagcaagactttgtctcaaaaaaaaaaaaaaaaaaaaaaaaaaaagaagaggaagaaatcgttttttcaagaaggggaaagctgggtgatttaagaatgaacttgaagaggatcactcagtcctcaacctaggagtggcaagaatatagactgtatgggaagtggttctgctccttggtacccatcttagaaatatttggcctgagtctgtaagaggcaggtactttatctaacctgaggttagggggccactacatccccatcccctcccctgctttctaaccatgctaacatcttctcactctcctgtctcctctccttctcactcccctaatctgcctattcacattttgggcctgttttcctattggggttgctgtgttattctcactgatttgcagacattcctctgtgtcatctttttaattttgttttaatttttagaggcaggatgtcattctgttgcactggctgtagtgacgtagctcactgcagcctcaaactcttgggctcaaactcctgtcctctgcctccacttctcaactggtaacctcacttctcttcatgaggtctctccagccccagggcctttgcacatgttcccctctcttctgagtggcatatggtagttgctcctctgtaaatatttattgacatcctgacttccaaccagcagagaattgacctccttcccatgctcaggctagtgaaggcatgagtttggctgaggtcccagtggggaaggtgagtggggtggcagagttaaccaggagcagcatggtagaatgggtaaaaccagacgtagcacgcaggcaccacatgttagctggacaagtagtttaaccccatgggtctcaatttccccatcaatgaaagggagaatagaacaagtccctggtaagcagcataaaatgagctctcagaatgtaaagtaacaagcacacaacctggaagagaatacatttagtgaatattggctcctttaatcagcaggttctgatatgacttagctacaattaagaaaataaaaatggaggccgggcgcagtggctcatgcctgtaatcccagcactttgggaggccaagacgggtggggtggatcacctgaggtcaggagtttgagaacaggctggccaacatggtgaaccccatctctactaaaaatacaaaaattagccaggcgtggtggcgcacgcctgtagtcccagctactcgggaggctgaggcaggagaaacatttgaacccaggaggtggaagttgcagtgagcccagattgcaccactgaactccagcctgggcgacagagtgagatttgtctcaaaaacaaaagaagtctggaggccaggaggttggttgcagggttggttccttggctcaacaatgtctccaaagagtccttccatctttccactctaacatcgtcactgtaaggactttttttaacatttaccactcacagccccaagacgactgcgtcagttctttctttttttccttcagacagagtcccgctctgtcgcccaggctggagtgcagtggcatgatctcggctcactgcaacctctgcctcctgggttcaagcgattctcctgtctcagcctcccgagtagctgggattacaggtgcctgccactgcatccggctaattttttgtattttttttagtagagatagggtttcaccatattggtcaggctggtctcaaactcctgacctcaggtgatgcacctgcctcggcctcccaaagggctgggattacaggcgtgagccactgtgcccggccgatgactgcctcagttctaaggtacttacccagccatccacgtagacagacacaaaagcatccggccaaagaagagggagaggaagggctgtctcttaccatgtgactcatctcacggggaaaaaatccttttccagaagcacccagcagatttttcacccagatcctgttaggcctacgaatgggtcatgtgacaagtgctcttattgcaaggaatcttgggaaaaagagactattaggcattttctgcctctttgatgggaggtgggctctgccagtaaggcgggtagtggtggtggctcttggatggacaactgtgtcttccattcttcttcttcttttttttttttttttaagagacaaggtctcactctgttgcccaggcagaaatgcagtggcacaatcacagctcactgctgcctcgacctgccaggctcaggtgatccgcccaccttagcctcacgagcagctggaggagtgtaccaccatggccggctaatttttatattttttgtagagatggggtctctttatgttgcccaggctggtcttgaactcctgagctcaaacaatcctcctgcctcagcctcccaaagtgctgggattacaggcataagccaccacgcctggactctcttctttaaatactgagccttccacctcttctagaatatactctgttaattatcaaccacacttttctacatttttgcttcattattcattcagtaaacatttattgagtgcctactgtatgccaggcacagctttaggtgctggagatgctatgaacaaaacagatgaaaatttctaaaaaataaaataaaaaataaaaataaattttgcaaagccaggcacagtggcttaggcctatagttccacctactcaggagtccaaggcagtaggatctcatgagactgggagtttgagtccagcctgggcagcatactaggactctgtctctaaaaaagaaaagaaggccgggcgcagtggctcacgcctgtaatcccagcactttgggaggccgaggcaggtgaatcgcaaggtcaggagtttgagatcagcctgaccaacatggtgaaaccccgtctctactaaaaatgtaaaaattagccaggcatggtggcaagtgcctgtaatcccagctacttgggaggctgaggcaggagaatcgcttgaacctgggaagcggaggatgcaataagccgagatcgtgccactgcactccagcctgggcaacagaatgagaccctgtctcaaaaaaaaaaaaaaaaagaaagaaagaatagaaaatatctgccctacggggatggacatgctagaacatcaaagtccaatggaactttctgcactgatgaagtatgtatgtatgcaccagccacatgtggcttgggagcacttaaaacgtgactggtacaagcgaatttttcatttaatttaaatgaatttaaatctgtatttaaatagccatgtgtggctagtggttactttattgggcggtgcagctctctaaaggccaagagatacatcatcaacttctctcccttgacccatattcagttctctcccaccctgaaaatctcctctcctacccaggctcacatttccagttcttctcctcttgttctccctcaaccatcagcccccgcaagactgacgtgaccctgatgccgtatgaaatgcattcttcatcctttactcttactcacctctgtgcggccctggagaccagtgacctctcctttctcaaaatactttatttctgtgtgtttttgttgttgctattgtttttggggggttttcttgagatggagtttcactctcatcacctaggctggagtgcagtggtgcgatctcagcttactgcaacctctgcctcccaggttcaagcgattctcctgcctcagcctcccaagtagctgggattacaggctcccgccaccacggctggctaattttcttgtatttttggtagagacggagttttgccatgttggccaggctgatctcgaactcctaacctcaggggatccacctgcctcggcctttcaaagtgctgagattacaggcatgagccaccgcacccagcctcaaaatgcttttgaacttgactgtcaggtatgccattctccacaccagtctcctcccatgtctgtgtcttctccctctccactggggacccttggctttttccacttcactcatctaccctgggttatctggtcttccataaccctgtcctctgccacacctcacttattcacccaccacaatatttattgagtactcactaggccatgaaagatgctatacaaaaaaagcccctgtcctcgtggagctgacattctagaagaaagcatgaataataaatacgacttaataaacagtacggccaggcatggtggctcacgcctatcatccaaacactaagagaccaagatgagaggatcacttgaatccaggagtttgagaccaccttgggaaacgtactgggaccctgtctctacaaaaaaaatattaaaaattagctggatagggtaatgcatgcctgtagttccagctacttgggaggacaaggtggaaggattgcttgagcctgagaggtcaagtccgcagtgagctgtgactgtgcactgcacgccagcctgggtgacagagtgagatcctgtcttaaaaataaataaataaacaaacaaacaaacaatataattccagagagtgaagaggcaggatctctttagctaggaagttgagggatgttctctctgagaaggcagaatctgagtttcaacctgaagaattcgaagaggccagctaggcaaaagatgagagttgaaggaatggggacggcagaggagacagccaatatagtaattctcaataaagcagaaagtgagcttttcctgctggcagaacagaaaggaagtcggagtggccagggtgttgtgggacaaggtggtcagcaggagtcacatcacgcaaggtcatgtggtcatggtagactttaaattttactccaagcctgatggaagccattggaagattttaactaaggagtgacggaaaactggcatctcaaactcaacatgtctacaacccagttcttgatctttgaaaccttcttcctccatcttccccatctccattgacagcaacttcatccttcagttagctcaggccaaaaccctggagtcacccttgatacctctctcctgctccacactcagtctttccattggaagccctaggggctgccatattgttctccatagcacttcacaccgtctgacatactatatcttttcccactattgctttgtccttggtagcatctttaggcactctctgaatatctggcacatagtacgtgctcactaaatccttgttgaataaatgaatgaacatcactccgtggtcctttcagaaccagagccattcttctctttcttcaccaccgttgcccctcaccccgcccaactagtcacaggagttgaaggatgacacagtagagaactgggattctggagtcctgtggctggtctggggttcgagttcttactcagtggtaggaacctccatgtgggattaacttatctggtctttagtttcctcctctgtaaaatgggcctcaaactgccaaccgctgggatgcagggaggatttgatgagcccaggcaggctccctggagcacagcaatcaatggcagctatatataaaccggggcctcttttgtactcccactgcctttgtcctagttccagccctcattacaccagcctgctcttgcggctccctcctaacttctgctccatcaccaccaatctgtcctttcagctgtcaggcttgtcttctgaacgccaaccctaatcacatcccttcctgctccaaaaccttacatgactctcactgtccacaggacaagacccagcctctagttgacagcctccactgtccagcttacccaacctctcccctaccacataccctgagtggagccttctgcctccatagggctttcttagccagagaagcctcccttatcttcctgttctcctcctaattccttcttatccttccagggaggaggctgtgaggtaatgcatcttgggagccagctgggattgcacagggtggtgagattatctgcatttccgaggcttgaacaagttaaggcaatgggaaaggtcacacaatgagaaaatgcagggccaggatttaacccgtctgagatgttctgactgtgctatgctgcctccccggacatgagctctgcgataatgctgtccccaggctgtaatcattccctctttcatccctgcctcctctatccctggggtcagagggacttgtagttgaatctctcactcactcattggtgtggtctctccctaaagcagggtggagtttgtcttagcgttatcactgcatccagcacaacctccctggtccaggcttatcagcgttcaactgcgtcaatgcagttgcctcctcctcaatctcccagcttccggccttgccccctagagagatcatattttaatacaagtcagattacatccctcctcccctcagaaccctccatggctcacaccttactcagagaaaaagccaaagtcctctccacaacccacaaagccctgcaccatccatcacctcactgccttcgtcccctcacaccctcccccttgctcgctctgcttcagccacaccaactcatctctgtttctcaaatacaccaggcatggcctagctattaaatgcacggtccagcctggtgcatttgaagaacacggatgaattggtgtggctggaacagagtgagtgagggggagagcgggaggaggacctttgcaccagctggacctttgcaccggctgttccatttgcctagagttttccctgacatattcatatggctcactctcttgcttcccttgctttctcccagtctttattcaaatgtctatttctctgcacttgtgctgtttgatacagtcaccgctggccacatgtggcctttgagcacttcagttgaaacacatgaaagtgtagaatattgaccagattccaaggaaaaccatgtgcaaaatatcttttatctcttaagatacagggtctcgctctgtcttccagcctggaatgcagtggcacgatcacagctcactgcagcctcaaaatcccaaactcaagtggtcctcccaccaacagcctcccgagtagctgggattacaggcacacaccacaatgccccgcccatttttttaattgttattattttttttaatagcgacaaggtcttgccatgttgctcaggctggtctggaactcctggcctcaagcgatcctcctgcctcagcctcccgagtagctgagattacaggcaggagcttttgtgcccagcaggtctacgatcttcttagaatgcttcaggctgggcatagtggctcatgcctcaaataccagcactttgggaggccaaagcaggcagattgcttgagctcaggagttcgagaccagcctgggcaatatggtaaaaccctgtctctccaaaaaaaatacaaaaattagctgggcttggtggctcccacctgtagtcccagctacttaggaggctgaggaaggaagatcacctgagcccaggaggcggaggttgcagtgagccaagattgagccactgcactccagcctagacaacagggagaccctgtctcaaaataaataaataaataaataaataaataaataaataaataaacaaacaaacaaacaaaccaataaatgaattttacctgtttctttttacttttttaatgtggctactagcaaattttaattttttttttttttttttttttttttgagacagagtcacgctctgtcacccaggctggagtgcagtggtgtgatcttggctcactgcaacctccacctcatgggttcaagcagttcgcctgcctctgcctctgagtagctgggattacagatgcccaccgccacgcccagctaattttttgcatttttagtagagatggagtttcgccatgttggccaggctggtctcgaactcctggcctcaagtgatctgcctgcgtcggcctcccaaagtgctgggattacaggcatgagccaccgcgcctggctataaaatttcataagtagctcttaatagatttctcctgggcagtgctggtctaaacactttttttttttttttttttttttgagacggcatcttgctctgtcaccaggctggagtgcagtggcgcgatctctgctcactgcatcctctgtcacccgggttcaagctattctcctgccttagcctcccaagtagctgggactacagacacccgccaccacgcccagctaatttttgtatttttagtagagacgggttttcaccatattggccaggctggtctcgaactcctgaccttgtgatccgccagccttggcctcccaaagtgctgggattacaggcatgagccaccgcacctggctataaaatttcataagtagctcttaatagatttctcctgggcagtgctggtctaaacactttttttttttttttttttttttgagacggcatcttgctctgtcaccaggctggagtgcagtggcgcgatctctgctcactgcatcctctgtcacccgggttcaagctattctcctgccttagcctcccaagtagctgggactacagacacccgccaccacgcccagctaatttttgtatttttagtagagacgggttttcaccatattggccaggctggtctcgaactcctgaccttgtgatccgccagccttggcctcccaaagtgttgggattacaggtgtgagccaccgcgcccggccctgtaacacttttaacactgaactgtttgccttccaggtggtaaagagcaggtgcctttactgatagaaatgtcaccactcccttcatcccgccagccccatgtcactgacgcgtcctttccccttgctctgtggtaactttctcctaagcactcatcgccctaacatctgtcatacaggtatacctcagagacactgctggtttggttccaggtcgccataacaaagcgaatattgcaataaagggagtcgtgccttttttggtttcccagtgcacataaaagttatgcttacactatagtctgttaagtgcatgatagcattatgtctaaaaaaaaatgtacataccttaattttaaaatccatcaaggctgagcacagtggcttgtaatcccaacactttgggaggccaaggcaggaggattgcttgagcccagggatttgaaaccaggcaacaaagtgagaccccgtttctacaaaaaaattctttttaaaaatagctgggtatggtgacgcatgcctgtggtcccagctacatgagaggctgaggtgggaggctcacttgagcctgagagattgagactgcagtgagctgtgatcacaccactgcactctagcctgggggacagagtgagaccgtatctctcaacaaaaattaaaaaaaaaaaaaaaaaaggctgggcacagtggctcatgcctgtaatcccaacagtttgtgaggccaaggtgggtggatcacttgaggtcaggagttcaaaaccagcccagccaacatggtgaaaccccgtctctatgaaaaatacaaaaaaatagccgggtgtggtggtgcacacctataagcccagctactcgggaggctgaggcacgagaattgcttgaacctgggaggcgggggggagattgcagtgagccgagattgcactgctgcactccagcctgggtgacagactgagactctgtctcaaaaaataaataaataaataaataaataaataaatgttttattactaaaaaagttaacaatcatctgagccttcagtgagtcctcatcttgctggtgaagggtcactggctcagtgttgatgggtgctgactgatcgtgggggtggttgctgaagattggggtgcctgtgacattttcttaaaataagacaagaaagttttccgcatccatcgactcttcctttcacgaaagatttctctagcatgagatgcttgttgacagcaattttacccacagtagaacttttttcaaaattggagtcagttctttcaaaccctgccactgctttgtcaactaagtttatgtcatattctaaatctcatgttgtcattttaacagtgttcacagaattttcaccaggagtagaatccatctcaagaaatcactttctttgctcttccataacaagtaacgcctcatgcattgaagtttgatcatgaggctgcagcaattcagtcacatcttcaggctccacttctaactctagttctcttgctagttccatcacttctgcagtgtcttcctccagtgaagtcttgaactcctcaaagtcatccatgaggatcggaattgacttcctcaaaattcctattaatgttgatattttgacctgttcccacgaatcacaaatgttctttttgttgtttgtttgttgtggattgtttttttatttttaattgagttgaggtctcactatgttgcccagactggtcttgaactcttggcctcaagtgatcctcctgccttgatctccctaagtgctgggattacaggcatgagccactggaacagccacaaatgttcctaatggtatctagaatggtgaatgcttttcagaaagttttcaatttcctttgcccagatgcatcaaaggaatttatctatggcagctatagccttatgaaatgtatcccttaaatcataagacttgaaatagagaattacttcttgatccatgggctacagaatgaatgttgtggctgggcatggtggctcacacctgtaatcccagcactttgggaggctgaggcaggtgggtaacttgaggtcaggagttcaagaccagcctggtcaatatggtgaaaccccatcactactaaaaatacaaaaattagctgggcatggtggcgtatgactgtaatcccagccacttgggaggctgaggcaggagaattgcttgaaccctcttgaagacagaggttgcagtgagccaagatcacaccactgcagcgacagagtgagactctgtctcaaaaaaaaaaaaaaatgttgtgttagaagtcataaaaacaacattcatcttcttgtacatgcccattagaggtcctggataaccagtgcattgtcagcagtaatattttgaaagaaatcttttttctggctgggtacagtggctcgcacctgtaatcccaccactttgggaggccgaggcgtgtggatcacctgaggtcgggagttcaagaccagcctggccaacatggtgaaaccccaactctactaaaaatacaaaaaaattagccaggcatggtagcaggtgcctgtaatcccagctaccctggaggctgaggcaggagaatcgcttgaacctgggagtcagaggttgcagtgagctgaggtcgtgccattgcactccagcctgggcaacaagagtgcgacttcatctaaaatacatatatatatataacatgttatatgtaatataaattatatatataacatatatgtaatataaattatatatcacatataacatatatcatgtgttatatatatcacatataacatatgtgttatatatcacatataacatgtgttatatatcacacataacatatattatgtgtatatatgtcacatatattatgtgttatatatgtcacatataacatattgtgttatatatatcatatataacatatattatgtgtagtgtatcatatgtaacatatattatgtgtagtgtatcatatataacatatattatgtgtagtgtatcatatataacatatgtgtagtgtgttatatataacatatattatgtgttatatatctcatatgttatatataacatatattatgtgttatatattatatatatatttttttctgagtagatctcaacagtgggcttaaaatatcagttatccatgctataaacagacgggctgtcattcagtcttcattgttccatttatagagcacaggcagagtagattcagcataattcttaagaccttaggactttaggaatggtaagtgagcattggtttcaacttaaagtcaccaggagcactagctcctaacaagagagtcagcctgtcctttgaagctttgaagccaggcattgacttctcctctctagctatgaaagtcctagatggcaacttcttccaatagggcatttcatctacattaaaaatctattattcagtgttgccagcttcattaataatctcagctagatcttctggataacttactgcagcttctccatcagcacttatcacttcaccttgcacttttatattatggggacaccttctttccttaaacctcatgaaccaagatcttctagcttcagatttttcttctgcacttccccacctctctcagtcttgctgtgggcttgctgtggattaggctttggcttaagggaatgttgtggctggtttgatcttctatccagaccactaaaactttctccatgtcagcaagaagcctgtcttactttcttatcattcatgtgtttactagagtagcccttttaatttccttcagtaatttttcctttgcattcacaacttggctaacctctagcttatggccttttgtttgtttgtttgttttgtttttgagacagggtctcactccgttgcccaggctggagtgcagtggtgcaatcaccgctcactgcagccttgacttcctgggaccaagtgatcctcccacctcagcctcctaagtagctgagaccacaggtgtgcaccaccacacccagctaatttttttattttctgtagagatagggtctccctattttgcccaagctagtctcaaactcctaggctcaagccatcctctcacctcagcctcccaaaatgctcggattacaggcatgagccaccatccctggccctatctcagcttttgacacgccttcctcactgtgtttaatcatttctagcttttaatttaaagtgagagacgtgcaactcttcttttcacttgagcacttaaaggccattgtacagttatacactgacctaatttcaatattgttatgtctcggggaataggaaggcccaaggaaagcgggagagatggggaaatggccagttggtagagcagtcagaacacacacaatatttatcgatcaagtttgccatcttctatggatgtggttcgtggcacccccaaacaatgactatagtcacatcaaagatcactgatcacagaccaccataacagatgtaataattatgtaaaagtttgaaataccgtaagaattaccagagtgtgacacagagacgcaaagtgagcacacgctgttggaaaaaaaatggccctgatagacctccttgacacagggttgccacaaatcttcaatttgtaagaaacacaatatctacaaattgcaataaagcaaagcacaatgaaatgaagtcttcctcggccggtgtggtggctcacgtccataatcccagcactttgggaggccaaggcaagaggatcccttgagcccaggagttggaggccagcctgggcaacacagggagactccatctctagaacaaaacaaaacaaagcctgcttatatttattgggtttactctcagtctcccccacacagagatagggcctggcttgttattagtgctcagttgatgtttgtgaagtgaaatactaaggacttaaccactgcctgttctttgctgttcatgccctgacagcttttatgtgccagcacagaagaaaacaaggtgcaagaagagaatagtgatctctaagtcagaatttgaggaacccaaattagtaccagaaagctgggaggagaagagaaaaataaagtaaatcaaattaaaagttgaatgggccaagtgcagtagctcatacctataatcccagcactttgggaggctgaggtgagaggatcacttgaggccaggagttctagaccagcctgggcaatatagcaagaccccatctctacaaaaaaaattttttaattttctgaatatgttgttgtacacctgtagtcccagctgcttaggaggcagaggtgggaggatcgcttgagcccaggaggttgaggctgcagtgagctgttgttgcaccactatactcaagcctgggtgacagaataagtccctgtctccaaaaataaaaataaataaattcattttttgtaaagttgtatgtcatggcccctgcctactctggcttcatgacttgctgcttgaacctcaccatccaaatcccagtggtgacaccatgtcatttcttgaatttgccaagccctctttcagtcccaagctctctgtcatggccactctcagcctggaaagttctttccccactggccagatttctccccctcatctatgggaacttgacttgaagtagggggtatcccaggccctggactagttaacacgacctgctgtgtgcccctcaaagccattgtcttcctagctgagaaggcatcacacctgcaacagattcactcattgtgtgcatgtttttcttaaccacttctcttctgcatcagctccatggggcagggatagtctcatatgtcactctacccagcacataggatacgctcagacgcccacttgtggatggtggaaaaggtcagcccaacctaatatgcccatctctcctctaggggtaatcttgagaaaaaaagttgggaacttgctttgtgttagtttaggatgacccagaatagatcctgaaacaagaatttagggcaatccttgtgcaagtagttcatctgagaggtgaccccagaagggttggagaaggagaggggaggtggggcaaggaagggtgagttgtcctgtaggcaactgagctccgtcctactgggagcccacgtggaactcacctcttaagtgatccagaatgaagggtgagggagctgcggtattgatccaccaactcccagcaatctttggttgagggctgctcccttaaagttcattccctgggcctgccccagatttggagacagccctaaggcaagaggtacagataccagttggccacagactgaagtgttaagacccaagcccctggataaaactgaaaaatcaagccagatgtggtggttcccacctgtaatcccagctactcagtaggctaaggcaggaggattgcttgagcccaggagttcaatgctgtagcgagctatgattgcaccactgcattccagcctgggcatcagagcaagaccccatgtctaaaataaaaataaactgaaaaatccccaagttatttgctgtgaccaaccttccattaaccacagaccctctggtattcagcatttcttgtccattatatgaagttctgatgacagtctcttttattgtattgtgccttgaccacgcactgtacatcacttagctctgaaatggacatgttcaggaaacagggccaggtgggaccctgtgtttcaacagcaatacttttacaaatgaggtctcatgacagggtcttgctcggagggtttctatggaagcctcatcccacctactgctatcatccttactaacttgcatttacaaaagggactctttttgaccagaggcttggggtctgtagctgccttctagccagctgatgctggctggtccacacaagcaggatcacacccatttttttgttttcttatttatttctgaataggttagcataccggtaacctgtgtgcctggcattgtgctgaccactttttgtcaacttactgaatcctcacaacccttggaggtattgatactattgttatccaggttatacaaaagggggaaactgaggcacagagcagggatgtcccttgcccaaggttacccaactggaaagtggcagatctgggatctgaacccatgcaggctgggctcttaacactgaactactttcctgccatttgttaaagagccacaaaccaggccaggcaccatggctcacgcctgtaatcccagcactttgggaggccgaggcgggtggatcacctgaggtcaggagttcaagaccagcctggccaacatggtgaaaccctgtctctacaaaaatacaaaaaaaagtacccgggcatgatggcgggtgcgtagtaatcccagctactcgggaggctgaggcaggagaatcccttgaacccgggaggcagaggttgcagtgagctgagatcacaccattggagatcgcactccagcctgggcaacagagtgagactctgtctcaaaaaaataaaataaaataaaataaagagccacaaaccccgaaaggtctgccattcccccagggccccaggccaccccacaatctattgtcattgtaggttgtgaaatatactgaatgtcaccccaaccttgagccatggggaagattccatttctctcattgcaacatttgtgcaacatgaaccatctgttgggggtcttcgtaaatcaccttttatcccgtgaggcaggtactgttaagaccattttacaggtgacaaaactgaggccagtggtgtcgagtcacctgcctgtggtcacccaaccaatacaggacagcttggaatcccaagcacccccgccctgctgtctgacccccaaaacccaccctctgttctccattctggcttctttctttcagcatcttggcgacagttgggacggagtttgacctacggacgctgagggcagttcgagtgctgcggccgctcaagctggtgtctggaatcccaagtgcgtgagtttccgaccctgacaaggggtttgctcacgggccccaggagccctcagtttcccctatgcagagcatctcaggaggccacatcctgccaccagcctgtgtgagggcagtctcttctttgggactccctatagggaaccccctaggaatatgactgtagctccccatgagctcctgaaagcaaactaggagccacacccatttattgagcacctactgtctatcgggagccatgctaagcaccacgtgtgatctcattcagtactcacagccctatgaagttgataggactgatgtctctattttatggagggggaaactgaggctcagagtggctgaaacattggagcagggttttgtggctgagaagtggcagaactaggagtgagcaagtgtgactccaagcctgggccgtaccactggtggcaatgaccattcccatttaatgagtgcctgctgcgtgcagggcactacagaaggactttacatgaattaccttatttcatcctcacagtcacccagcgaacacccattttacagatgagacggttgaggcttaaggaggttaaattactcacctgaattcttagagtggacagtaatgagctctaaaattcatactcattccttgctgctttctcattctccacagatacatctagtccccgtttaagggtggctgccatatgcagggtcaagattaagtgtaggttgagccaaaaaaaaatgtaaaaagcaaaaataaaacagggctgtcctttttctatcttcttgtcttggttaataataataatttagccaggcatggtggctcatgcctgtaattccagcactttgggaggatcacttgaggccacaagttcgagaccagcctgggcaacattgtgaggaacaccacccccacccccccgccaatatctacaaattttttttttttttttagaaattagccaggttgactgggcacagtggctcacacctggaatcccagcactttgggagaccgaagcgggcagatagagcgagctcaggagttttaagaccagcctgggcaacatggcgaaaccctgtctcaaaaaaaaaaaaaaattagcaggcatgatggtgcacacctgtagtcccagctacttaaaaggctgaggcaggaggatctgagcccaggaggtcaaggctgcagtgagctgtgatagcaccactgcactccagcctggacaacagagtgagaccttgtctcaaaaaaacagacaacaaaaagtttaaaaacaaacaatttataggctgggtgcagtggctcatgcctataatcctagcactttgggaggccaaggtggatgggtggatcacctgaggtcaggagttcgagacctgcctggccaaaatggggaaaccccgtctctactaaaaatacaaaacttagccgggcgtggtggcgggcatctataatcccagctactcgggaggctgaggcaggagaatcacttgaacccggggggcggaggttgcagtgagctgaaatcacgccactgcactccagcctggatgaaagagtgaaactccgtctcaaaaaaagaaaaaaaaaaattaaaaagcacttactatgtgccagacattattctaagtatttccatttttttaaagtcctttatcctcccaacaagcctgtgaagtagtctcttttattatcaccattttacattttattggcttcgttcttccggttcattgctacccaggtttaaagagtaagatttcccagaggatcaccagcaggatctttttgtagaaagaagacacttctatccaaggtctctgcaagatcccagcagatgcctgcatcatattaaattaagggccatcccaaatctaatagtcaaaagagccaggtgcagtggctcacacctgtaatcccagcactttgggaggccaaggcaggacgattgcctgaggctaggagttcaacaccagcctgggcaacaaagtgtgaccctgtctcaaaaaatatatgtatattataatagcagtagtaacaagagtctctgtttaatgaccacctatgacttaccaggtacttcactgtgtgtgaactctctcatctaatcgtatgagggaggtactattgcagtccccatttacagatggagaagctgaggtttggaattcactagtaagtggatgactaggtcaggttcccttgaagcggatacttaggtgggtgttcagatgcacctgctttattgggggacggctcttgggagagacagcaggagatcagcagggtggggctggggaatggatagagcagggacgcaatttcagctggagtgtgtgtgacaccagagttgtcctccaatgcatggcaaggatgccggccttttgtacttctatagtcagtcactgtggatgggaggtagagacgcagtagctcccaggtgagatagcttttgatcaccaagggcaattctactaagaagagaggcagctgggaggcattagcaaccaacatccatagcagctggagggcgggtacaccagaaagaaaatgggatcttggccagacaccaagagtatccagcaccttaaccactgcaccacactgcatctgttagcacccacattacattttttttttttttttttttttttgagacggagtctcgctctgtcgcccaggctggagtgcagtggcgagatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccagcacccacattacatttttaagcccttggagtggcatggcccctcgagctatcctgacagcttccctctcttactgtggtctccacccatcaagagccatgggaagttcctgcaatcaagaagcaaagcctcaggctatatgtttgaaccttcattttgatcatagactttcctagtagataccatagtggttacaaacataggatgttgtcatcgttcagacctgagttaatagcctcaagaaaaaaatggtagtggaaccaggtatggtgaagtgtgcctgtagtcccacctactcgggaggctgaggcaggaggctcgcttgtgcccaggaggtcaaggctgcagtgagccgtgatcatgccactgtattccagcctgggtgacagagcaagcccatctcaaaaaaaaaaaaaagccaatgataggcagagaaatactaactaaggctcttgctctgtcgccaggctggagtgcagtggtgcaatcacagctcagtacagcctcaacctccccagactcaagcaatcctaccatctcagcctcccaaatagctgggactccaggcacacagcaccatgcccagttaatttttttgtattttgtagagacagggtttcaccacgctgctcaggctggtctcaaactcctgagttcaagtgatccacccgcctcagcctcccaaagtgctgggattacaggtgtgagccaccacgcttggccagctattattattattaacattcttcgagtcttacaacagtggaacttttagtgcaggatgcgaatttcagtattaaccccttcctctcccaaaaggatttgaagcccagagtaattcagccgccatgaatgaaccatttgttagatgagaggctactggaggctgagcttggtaggataagagcttgcatggggtccctgattgatgacaatacccccagatttaggtcttcagatgcccagttgggtgtgtcttctgttccactgtgtcccttcggggactgttccctgccttctttctttttgagatggaatctcgcactttcacccaggctggagtgcaatggcgtgatctcagctcactgcaagctccacctcccgggttcacaccattctcctgcctcagcctcccgagtagccaggactacaggtgcccgccaccacgcccagctaatttttttgtatttttagtagagacggggtttcaccatattagccaggatggtctcgatctcctgacctcgtgatctgcccgcctcggcctcccaaagtgctgggattacaggcgtgagccaccacacctggccccctgccttcttattcaccaccatctttctgaattgggttgctcagaacagagaaagcaacatcagcacatgggcaaacatggggcttcatttcagatggacctgggttcaaatcctagttctgcctttttttttttttttttttttttttgagacagagtcttgctctgtcacccagactggagtacagtggcgtcatcttggctcactgcaacctctgcctcccaagttcaagcaattctccttcctcagcctcccaagtagctgggattacaggcgctggccaccatgcccagataattttttgtatttttagtagagatggggtttcaccatgttggccagacttgtcttgaactcctgacctcgttaatccgctggcctcggcttcccaaagtgctgggattagaggcgtgaaccgccgccgcgccctgcctagttctgccatttctcatgcattctctgggtgaatcacagcatctctgttagccttgcttcccacttctgtaaaatgagagtgactttacatgtatggccacctcaggggcttgtcactagaagccagtgaaataatgttgagtctggttccttggggttgaaattgggaccgccaaccgctttcctacccagagcagcaactagcctatatggcggccttttatgaatgaggaaaagacaccgcctcttggcagaaaaaaaaaattaagaaaatggctccctcttctgggtgcaagttgcccaacacccaggaatatggctccaaaagcaatggactcccacccctttcttgcccaaaagatcatcaaatggaacagcatgtcaaatacctttattaagtactttaaagttggctgggctctgtggctcatgcctgtaatcccagaactttgggaggcagaggctggaagatcgcttgaggtcaggagttcgagaccagcctggataacatagtgagaccctgtctctataaaatatatatatagatttatttgagacagcgtcttgctctgccactcaggctggggcgcagtggcacaatcatagctcactgcagccttaacgatcctcctgcctcagtccctagagtagctaggactacaggcatgcaccatcatgcctggctaattaaaataaataaataaataaatactttaaagttaaaagtgctttttaaaaaataataaggccaggcgtggagactcacgtctgtaatcccagaactttggaagaccgaggcgggtggatcacgaggtcaggagatcgagaccatcctggctaacacggtgaaaccctgtctccactaaaaatatgaaaaattagctgggcctactcgggaggctgaggcaggagaatggcgtaaacctgggaggcggagcttgcagtgagccgagatggcaccactgcactccagcctgggcgatataacaagactctgtctcaaaaaaaataaataaaataaataataataataataggggccaggtatggtggctcacacctataatcctagcactttaggaggctgaggagtttgagtccttggagaccaggggtttcaggccagcctgggcaacatagcaagaccccatctctacaaacaagttttaaaacttagccaggcatggtggtgcatgcctgtagtcctagctattgcagggactgaggcaggaggatcacctgagcccaggaggttgaggctgcagtgagctgtgattgtgccactgcactccagcctgggcagcagtgcaaaaccctgtctcaaaggaaaaaaaaaacctaggaagtgttgttcccatgataaggatcagcctccgtgtggtgcttccttcaccattgcccaatccccaggctcctgggtgcttaatgttccctcaggaacacacctgctttgtctgggagagacctgggcgtcttggtggcggggtttgggggtacttgctcatgggcttatggggcctctctctgtgtccccccaggtttacaagtcgtcctgaagtcgatcatgaaggcgatgatccctttgctgcagatcggcctcctcctattttttgcaatccttatttttgcaatcatagggttagaattttatatgggaaaatttcataccacctgctttgaagaggggacaggtaggtccacggagcatgatgcatctttccagttttctccttcagggacaagctcttgggaggattaggcaggggtgtgcttctttctcctggcagctgggaggaccgtctccttcagagagcactacaggagaggcagtgagtgaaatagcctctgagatcttagctgttgaaaggggtggggttccacagaaggtgacccagcagagaaagagtttatttgggaatgatcccaggaagcaccatcgggggaatgaggaagtgagcagagaaagaagggatcttttaaagagtgtgctatcaagcgggttaccacttaaaactgggactggatccccctgggcacctctgggagacagcaaagaacacacaactcagctggtcacggtggctcacgcctgtaatcccagcactttggggggccaaggcgggtggatcacctgagatcaggagtcagagaccatcctggccaacatggtgaaaccccatctgtactaaaaaatacaaaaattagctgggtgtggtggcaggcacctgtagtcccaattactcaggaggctgaggcaggagaatcacttgaacccgggaggcagaagttgcagtgagccaagatcacaccactgcactccagcctggcgaaagagtgagactccatctcaaataaataaataaataaaaatataaataaaaaaagaacacacacctcagagccgtcccagccaaggggcaagggagctggggtatttatacactggcttctttttgacattggtgaggactgctcctagagtgggaattaatgcctggcacatctggctgagtggaacaggtattctgggtgctttcagacctcgaccagtcctgacttctaaagcaagcaagaagtggggagagttgggccagaaaagggttattgcctcaatgcattgtgagtggtaccttgtggaaggtgagagacagagaagattccaggcacaggtgccatgctaaacgatagttctcatttattataggaacccatggatttattttgttctctgccctgagtgctgggtgagagtactggatgagtcctcctggtctcccccaacccccaggatgtaccagagataccccaattgggagtcctggcaccaaccaatcagaacctagcactcagcagcattctgcccctccctgactatgcccacattaacccttcagtggctgggtctgggggtagggtgagccccggaaaagccaggcagcgcagagacactctcccagggctcagctctgaaccagcagtgtggaagcagtgtgtccaccacgatccacactcaggaaccaaatagcccttggatacgttttcagttaaatctttgccatccaaactctagctgcttgctctctaaagctccagaatgaaatggaatcaagtaggaagggatgccttcagtatttcagtatttggaccactggccatctgggtgcagacagactgaatagcagttctggttctgatgatttgggtcaagggagctgtgaattgaaggagtggatagaaggaatcaagaagcccaaaggggaacccaggtgggcagagaaagaggtttcaggccccttatttgggaaaggcagccacagaagaagattctgtctgggagtggatttccacccaccctctccacccagtgacccccaagtggatccgcagaggcagcccctgagccctccctccccactcctccccacggggagggaaaacccactggggaaggtttatttgcaatggttggaggtttgggtttttttgtgggttttggtttgttggttttttttttcctctttttctcttgctcctcctgtctctttctctcctgggcttgtgaagtttgctcaatatggaatgtcctaattatttctttccccgatgaagaaggtgttaattgaggcagagctatttctgctcctggcctcgtcacccaggcggaaatgcgagagagagagagagagagagagagaatgaatatggggcagggcctcttggaaaaatcagccgtgagcagagaaaccaggactcctggatcctaggtttctgtgaagttttattttatgtttttctaccctagactagctaaaggagaagaggccatggggttggcttgggtccgagtggggttttgaggggacagatgtgggtggtgccaccagaggggaggaagcctcgatttaggagaaagactgaaaagctagctcacgattaaaaatataagacgtgtgagtaagagacagatatatacagacacccaggcagtgggttaattttaaaatgtatttataaccgaattcctcagacactctggacgcttgtttttctagaagcaacgctcagagtgtttcgtgtcggtggttggggggttgagggggattgcaaagctgctaaagatagacccgttttcagtagcattcctcagtgtcgggagcccagttcctgtgtgcccagcaccgtgccaatcgcttagaaggaagcaaagataaagtggaaggcttcctgctttctaagagcttccaaaatagttagaggaaacaagacccctcatttgcagccatttttaacagtgaaggctaatgtgtgattatacccacgcccccctaaatatgaaaattcagtagctattgtatgcctgaaaggggccaggtgcagtggctcacacctgtaatcccagcactttgagaggctgaggtgggagtatcccttgaggccgttagtttgagaccagcctaggcaacatagccagaccctgtctctgctaaaataaaaatttaaaaattggccgggtgcagtggctcacgcctgtaatcccagcactttgggaggccgaggcaggcggatcaaaaggtcaggagttcaagaccagcctggccaacatagtgaaaccccgtctctactaaaaatacaaaaaaaataaattagccgggcatggtggcgtgtgcctgtagtaccacatacttgagaggctgaggcaggagaatcacttgaacctgggacatagaggttacagtgagccgagatcacgctactgcactccagcttgggcaacagagtgagattttgtctcaaaataaaaaaatttaaaaattagccatgagtggtggtacatgcctatagtcctagctactcaggaggctgaggaagaaggatcacttgagcccaggaattggaggctgcaaggctgcagtaagctatgatggtgcccgcactccagcctgggtgacaaagtgagaccctgtctcaaaaaaaaaaaaaaaaagagagagaggaaggaaagaaggaaggaagggagggagggagggactggggctgtgttaactgggctacacaaagaggctacatggagggtgggaattgagccagacttggacatggcgtggagacagagaagattccaggcacaggtgccatgctaaacgatagttctcatttattataggaacccatggatttattttgttctctgccctgagccttatgtttaaaagatttttgccttccaacctgtatttatcaaataatagttcatgtaccaagtccagcataagtgaggaaggcgtttccaacaacttaagttcatggcgaggctagacttggagtttctattcagccagagcttgaaaggccaacaagattcattcattcagcattggtttatttccctctgctgtgtgctcagtcaagggagcagagaattggtgctgcgaagtctgtagcacatacattgagagatatttttgttgagtaggaagcttgagtttacacacactcagctgtttgttttcttgtccgacaatgccacggtcgtctttgaaaaccttcaaaagcatcgctcacagaataaggtcctctcagacccgctgtgctggtaaaatgaggacactcccagatgtgagctttcctgcctccctaccccatcaataccttaagatttggactgacctttagcgttcagcctgactgccacctccccaggaagctgtctttggtttccagcaaaaggggtgtctgttggcacgtttctctctccttgtggcattttcacagcctgcctcctgctatttggggagaaagctcagctcctgttccttacccttaggcaagggtaggaactgtgtgtactggtgtccctcacccccagaacagctccctgagcccagtacatcccaagaagaaaaaaatcagcaaggcttataggagaataacacaatgcgcttgacaaatttgtcctaatggatgtcggaagaaggctgcacttaccagctacaccatgcacacggcacatttactaaaactgactatattatggaccataaagtttgtctcaacagaggtcaaaaagctgaaaaaaatacaaatacaaaacatattttctgaccgtaatgcaattaagctggaaatcagtaacaaaaagagaactctaaaagtgtttgcagattaacagacatgcctctcatttatggatgaaatgatatgatgtctgagctttgctttaaaaatattctaggctgggtgcagtggctcacgcctgtaatcccagcactttggaggccgaggcgggcggatcacttgaggtcaggagttcgagaccagcctggccaacatggtgaaaccccatctccactaaaaatacaaagattatccaggtgtggtggtggccacctataatcccagctacttgggagcctgaggcaggagaatcccttgaacctgggagtcggagattgtagtgaggtgagatcatgccattgcactccagcctgggtgacagaatgagactccgtctcaaaaaaaaaaaaaaaaaaaaattctagtggcaaggcaaagtgtttggaggggatacagaggaatagatgaaacaaaatttgccagaagtaaataggtaagtgtctaaattggtgataggtacatggtgaatcattatattgttttatacttctctctcgctctctctctccccccgttctctccctgtcttcctctcccctctgtcttcatatatatatatatatatatacacacacacacacacagacacctaataagtttttttaaaaaacaaatacatctaaattacccataggtcaaagaagaaataataatggaaattagaaaatattttacttgaacaataatgataatgcatgacaaaatgttgagatgcaggtaaagccacacttaaaggcaatttatagccttaaaggcagttaatccatccatctcaaaagtttaggaaaagaatagaaaaaaaaaaaaaactcatggaaaacataaagagaaaagtagtaaagctcagagaagaaattaatcaatagaaaaccaataatagacccccaaagccaaacattgatctctttgaagactgatcacgtttgtcccaaaagttattcgttccaacagcattatagagtcactggtccctatttctcagagctggttttccctgctccttcccctgacttttctccccttcccttttgtagatgacattcagggtgagtctccggctccatgtgggacagaagagcccgcccgcacctgccccaatgggaccaaatgtcagccctactgggaagggcccaacaacgggatcactcagttcgacaacatcctgtttgcagtgctgactgttttccagtgcataaccatggaagggtggactgatctcctctacaatgtaagtgatgctgggacagtgtgtgtggacaatcagagtctcagggaggtggcctcctgggaccagtgagactccaaggctgcaatggagggaccctgagctgggaaaggcagcccaaggacaacacagccccactgaagctggcctgaggctcaggcttttgaagattacaggggctcatgagcagaactctaactatagggcatagaagtctggagggcccccagatgcaacatcatttttcattgtgcaagtgtttagatataattttagatttttgaatacggaaaggttatgtgatccaaaaaccaacacagataaaagatagagtaatatctttggacgtaggcgaggggtccctgccctgaggctcacccagtccttctccagccataccactccccgtgggatgagaagttcctggagccaaggggatgtgtctaccaagagcttgtgccccactttgtaggccatgttttaagttaccaggatcctggaattccctgcccatggccagattccatgaacttgcgtgcaattctcatatggatctgttcgtaacccaactgagggccaaggacatccgaggggtggctgttaacacaaatgtggccagagcttggatgtacaagctggaatgcccacacatatgtgtggagcccctctggcaggacagagccatgactaagaagagaaagggacaggacagggctggctctccccacaccttgacccagtgcagatatccggattctaaattccaccctgaccttccaaagtgtaaaggaaggtatatttgcaaagtagaagcacacagcatgttttatttagttaccttttcaatatttccccgtagtatgtggtctgcttttgtactcttgccctagatcttaaaaatgttagggatgtttctggaaagatgtatccctgcccccacttgcatgctacttcctcttcccacaatatgcaacccctttagttcctcagaatatccttccaatgtttatttatgcaattataattataagcataatcgaatctatgtcctcccccctctttcttatcccaaggagtagcattctatacatgctgttcaattctgtgatttttgttttctcataaccacacgttctagagatctttccactgcaggacatggacagtctcttcacgggtgcacactagtatgcccagctaatttttgtagagacagggttcttccgtgttgcccaggcaggtctggaactcctgggctcaagcaatcctcccgcctctgcctcccaaagtgctgggattacaggcgtgagccaccacgcctggccttctttattcttttgcacagctgcatagcattctattgtgtggctgcccatagttttatttgtttgccattaagagaaatgcttgactggcttcctgtccactgacatggaacatgatgctgctctgccaggagcatgttgcacgtacctcttcatacttttgcagatatagctagggggttggagggtctccattcccagaagtgggattgcaggatcaaagactaaatgcatttataattttatttttggggaagatttttgttttgtttttttggagacaaggtctccctctgtcgtccaggctggagcgcagtggtgtaatcatagctcactgcagccttaaactcctgggctcaggtgatcctcccaccccagcctcctgagtagctgggaccacaggcacacaccaccatacctagctaatttttaagaacaattttatagagatggggtctcactatgtttcccaggctgctctcagactcctggcctcaagcaatcctcctgcctcagcctcccaaagtgctaggattacaggtgtgagccactgcacccagcctaaatgcatttataattttgatagatatttaggtgtgcaagttttaaaccccactctgtcctcaccacagttcaccttccctcacctactatgcaggtaagcagtccccaggcaggtcacttgtcagcagctggagtggggcagagccaaggattcaggatcaaacacaaggatgccacaactgtagtgaccccatagagcaccctggggctgctccatacacacagctctgttgaccagtggaggtctcctcttcacctgccctaagggctgaaattaccattgaagtttaggccagcggttggcctgacccgggagcaatacctggcttcctcctcctgtacatagagaagctgaactttcctcttggtcctagtgtatgttccttaacaacccatttatgcctagtgttccattattggaatgctaatcctgtgggagttatttacatcctgctgctcaaggtcatcactaaggtcggatttttcacacacacaaaaattgcaacctccggcataaatgggttaaggaatttccccacttgtgggtggagggagatttgcaaaaactcatccttgtaatcctgatcaacaaaggcccgttttagttgggagtaggcagcaaaaggagccacatgaacagttgcgcctgtcacgcactgcacaagaatgtcattcatatcatagacaacatacgatttctactgttatcctgataatttattgacagaaaaaaggatgtggggaagggacatggtgttctaatttgcatgaaaacctcgtctgagtgtagcatctctgggaacatgcagcagatccgagctcaggccctctcttggccgtcacctgcaaacagcttggacaaagggtcagcccaattggccaaaactcactggggaatttttgtgggttctaggtttttactttgcaaggctggtgtgagaggaggttccagcaggaaatgaaccctcctgagagggaaagagactgggaaatggagaaggctgggaactcagggagagaatgggagtggggaatgggagctgaaaaaaattgtgagcataaaaaagggatatgtcacagggttggatgaccagagaaagcgtctgggggttcagattaagatgctgggggcgtgcccagtggtgggacaggaagcatgaatttccagagggctcggttataaacatcattgtccaatgggtgtttcccttggaagcctctaagcttagagctaagccacctctggggacacaaactgagtggttaagagcagagactcaggtgtcagcctgtctgggttccttccgactcttccacttccttgctgtgcagccttcggcaaggtgcttggcctctctgtgccactatttccacatgtgcaaaacgaagagaagcatagtcccacctcacaaggcacgaggactaagtaaggtggattcgcatgaagtgtttagaactgatcctggcccggggtgacctccgtgtaagtcaaattccccaccctgcatggtgttccttttagaaatgtgcatgaatttttcattagaacagctccagcagtgcctgaggaagtggagtgaggtgtgagaggtcttactttattcccctcgctggccctgctattaaccactaactcagagtagctttctagcactttccacacatttacatcccaccctcgtcctttggttagcagcccatgcaatgatttggccttaatgtgaacctagaacacagcttctcgcccagggatgatttctgcccccaggggacacttggcagtggctgcagacatttttggttgtcacaactggatgggaagaaggaggatgctattggcatcaagtgggtaaaggccacggatgctactcaacattctacaatgcacagcatcccccacctctgccccaccatagagaatgatccaggcccaaatgtcagtaaggtttctgtcaggaaaccctgggtcagaagaccaaggttccttgaggacggggatgccttatactgcaatcagctgtcactctctgcctctctctggggctgctgtgatcacctggcctgcatggacaacccctaggagcagcccccatccagtgcctggagaagtcagtggataaataccccagctccctccctgtcgggcgttttgctctgccctgcatctctccagtgggatcaggctctggttgcccgcagggttaacctggtcacgtacacacccttcacttgccaccttcccttccctgtctggtatttcctgggatgaacttttagatttatttcctggggctgctataatgaagcaccacagactgagtagcttaaaacaacaggaatttatggtctgacagttctggaagccagaagtccaaccccaagatgttagcagagctgacaacacgcccctcaaaagcctccgggggaggatccttctttgcttcttcctggcttttgctggtttcccacaatctttgggattccttggcttctagagccttcattctccattccagtcttctgtcatctaatagcatcctcccagcccgggcacagtggctcacgcctgtaatcccagcactttgggaggccgaggcaggcagatcacttgaggtcaggagtttgagaccagcctggccaacatggtgaaaccccatctctactaaagatacaaaaattagccaggcgtggtgggcgggtgcctgtaatcccagccacttgggaggctgaggcaggagaatcacttgaacccgggagatggaggttgcagtgagccaagatcatgccactgcactccagcctgggtgacagaatgagactccgtctcaaaaaaaaaaaaaaaaaaaaaaagaaaaagaaaagcatcctcccttcgtgtgtctgtgtgtgttctcctcttcttagaaggacatcagttgtattggatcagaacctaccctactccagtccaacctaattttaactaattacgtctgcaattaccctatttccaaataagatcacattctgaggtaccagggggttaggacttaaacatttttgtgtgtgtagcaggaggacgtaattccatttataactcctcctaaataaaacgacttgcatgtgaactcttgtctggggcttcccaaagtgagataacccctctctctacccctaaaacaacgagtagcgtctgtcaatgccagggtgcaggggctaaggtgcccatctttgagtttctgctgaggaggacacagctgctacgttggagcactcttgggttctgccttcgtgcccagccatctcccttgggctagccctgccctgggtctatcctagaatgagcctcgatctgtttggccataggcaagcagagtgtctggaaatctttgtcctccatgactggtgctggagccgaagccagtgggtgtggccttgccagccaactccatttacccagctctgaacaagctagtagttgagatcaacggagagtccagacagtcgctccaagcatcttggaatccatggacacaggtgtaccgcagaggcttcccacctgggtaggcagccctttgtaagatcctggcaccacatttattctcttaacatcctttcagttatccagtaatcatttattgagcacctactgtgtgccaggcaatgattaggtgattggagacactgcaacgaagaagacagactaaaatctccaccctggtaggagagacagatgcaaatggtaaacatgataaataatcaatcacccagaaagcaggagacactaagcaaatgtgtatgtactatgggaagcccaataggaacgaaagctacacaagagaacaagtgatgggtggttccttagtctaggtcaggcaatcagggagggcttctcagaggaggtgatgtttgagcagagaaggagggagccaggcagatgttttggaaacagcattctcagcatggagaacagtggcagctcacctacaggatgtgtttgattcccttccagattttgtattcgtttcttgtttttctcccttggcttcctggtttaaatgccttttgaagaaatctaagctcaactaatcagcgatgctgttgaaggtttatatcaggatatgcatcccagagttatttacaaaattagaacaaaactggaagcaattgaaagcctgacaataggagatcagttaaataccgtatggtccttccgtatgatggcatattatgtcatcattaaaaatcgtctgctgggagaatattaaggatacaggggaaaggctcaccatataatgatgagtgggggtgctgggcgcagtggttcatgcctgtaattccagcaatttgggagtctgagatgggtggatcacttgagcccaagagtttgaggccagcctgggcaacacagtgaaacccaatctctacaaaaaaaaaaaaacaaaaatacaaaaatcagccaggcatagtggcgtacatctgtagtcccagctactcaggaggctgagacaggaggataggatcacttgagccctggagtcagaggtggcaataagccgtgatcacgccactgcactccagcctgggcaacagagtgaaaccctgtcaaaaaacaaaacaaaaaaaatgatgagtgggagaaacaagtttttaaacagggatcaaggaggccaggcatggtggctcacacctataatcccagcactttgggaggccaaggcaggcagatcacctgaggtcaggagtttgagaccagcctggccaacatggcgaaacctcatctctactaaaaatacaaaaattagccaggcatggtggcgggcgcctgtaatcccagctacttgggaggctgaggcaggaaaatcgattgagcccaggaggtggaggttgcagtgagctgtgatcatgccactgcactccagcctgggcaacagagcgaaagctgcacgagagaagaagtgatgcatggttccctagtctaggtcagccaatcagggagggttcctaagaggaggtgatgtttgagcagagaaggaggaagccaggcagatgttttggaaacagcattcccagcatggagaacagtggcagctcaccctgtctagaaaagaagaaatgataagaggggaaaatgagtttttaaaaaggaatcaaggggaggtaaaccttatgatctcaaaggtacaaatatgaaaatataagtaaagaaaaactggaggacactgtaccaagctgaccttcgggtggtgggatttgggaatcttgatattctcaatacttctttgtatcttcaaatttctctatgatgatcacagtttactttttttttttttttttgagatggagtctcactctgttgcccaggctggagtgcagtggtgcgatcttggctcacttggctcacctctggggttcaagcaattctcctacctcttcctcccaagtagctgggactataggcatgcaccagcatggtcagctaattttttgtatttttagtaaaaatggggtttcatcatgttggccaggctggtctcgaactcgtaagttcaagtgatccaccaacctcagcctcccaaattggcttgagccaattaaacttgtcttgctaaatggttagcggggagaaagaagaaggtctcgggtcattcctagaccaggaggcagggagaaagggaggagaatgaacctttcttaggcaaacagtgtcctaggtgtccttatcttacataatctgtcgagagagtcacactaaaataaatcattgattgattgattgatacatcaataataaatggccagccttggtggctcacatctgtaatcccagctacttaggaagctgaggtgggaggattgtttgagacaaggagttcaagaccagcctgggaaacacagcaagactcatcttaaaaaaatttttttttttaattagccagatgcggtggctcacgcctgtaatcccagcactttgggaggccgaggcgggtggatcacgaggtcaggaattcgagaccagcctggccaacagggtgaaaccccgtctctactaaaaatacaaaaattagccaggcgtggtggcacacgcctgtagtcccagctacgcaggaggctgaggcagaagaatcatatgaacctgggaaacagaggttgcagtgagctgagatcacgccattacactccagcctgggcaacaagagcaaaactacatctcaaaaaaaatgttttttaattagccgggtgtggtggtccatgtctgtagttccagctacttgggaggctgaggcaggaggattgcttgagcccagcagttcaaggctgcagtgagctatgatcccgccactgcactccagcctgggcaacagcaagaccccatctcttaaataaacacataagtaaataaatgatcatttttattttattattaaatacacaagataaatgaaaaacaggcaaatctttcttacaaaagaattccatttaaagtatgtaaacttcactccccactgccccaggaggtggagactaatctcccctactttgagagtgggctggatttagtgactcatttccgaagaatagagtaggtaaaggggaaaatagaagttttatagcggaggaacagatagataccactttaaccaaatgatgaagattagtatcccccagggatgtggatattatgtaacccttgattttatgcctatatagcgttcttcccaaaaactcctaatcccagttttttggggttttgctctgtcttctaagctggagtgcgatgatgcaatcatagctcactgcagctcaaactcctggtctcaagcgatcctcccacctcaacctcctgaatagctagggctgtaagcacataccatcatgcccagctaattgtatttttttggtagagacatgttctcacacattgcccacgctgtcctcgagctactggcctctagtgatcctcccaccccagcctccagagtcactgggattataggcatgagccactgtgaccagcccagaatttttttttaaggagttgtgatgtcgtttaagagatgtgattcttcataacacatcaacaacaagtcccagcgatgggttggataagtcttgggatttcatgggagtattaagcttaaaagactttgcatgatatctgtgaactatatgtgatttctgttggtaatgggggtcactgattctgcggtttgccacctccaatcatcatggaagaaaatgttccacttccagtgaaagtaagaggaagtaaaggggtaattattttctatctaaattcacgaactccttgaattctgtccacagacccctaagtgtttcctccccaaggtgaaactgagagaatcttgccagtgccttccgcagtcactgtggctagaaaacccctcagaagaggtgatagtttagcaggtaactggagttctcaccatccgtgtctggctcagcccccatcacaaccagttacccagcccaaaatgtcagtagtactgaggttgagaggctctgctctaggaggccaggcctctcagaggaaggaggattggggtactggctgggcctcaagatgaacctaccccctaagagctttgggatggcgtgagtttctgtccatacccaaggactacaaatgcaggtttactggaaattctgtgccaaaagtgaggtccaactcacttctaactgctacaaaacaaacctccatcaacatagcccatctctgttcttgacctggaagctccaaggtatccacatggctcccatgcccactagacgggcctcttccctggaccttcctgggccagagaaggctctgggtagccttgtggaatcaagatgggtgatcagccacttcctctgtgccaccctgttttggctacttccctaggcatcagcctgggattccttgatggtaaaaatataaaactctctgagctagggcctttaatatccccattttacagatgaagaaactgagtcccagagctgtgcacagcgattgagagtcagaattcagctctgtctcactcagtgtcaacatcctcagattctgccatttatagcctcccacagcaaataggattgagggctgcttctctgagctcaaggggatagaatggggaaccccatgagtactgcaacaaaactgtttgctggagacaagagctggtggctctgtgttgttctagtgacaggtggcctcatttcacagggaccccctcaccctatgtgccccatgtggctcagaaaagccagaaattgtctccactctcacaggggaaggtccctgaccccctctttgccagctgggccaaggcaaattggggtcacttcatggggtacaggacctaccctctcttggttgcccccaaggaggggatgtggaggggctggggacctggcaggaccagggtgtcttgagttaatttggggctgcctttagccgagggcttctgtgtgcctggcatcagctttacattgtgtcttgatccgtaaaacagccctgtgaggaaagatatttttaaccccatcttccagatgaggaaacggaggcccacagggtgacgtgacctgccaaggtcccctagccaagagtgacaaagccagggttcacacacagctctggacacaattcatcacccttcatccgtctctctctgactctttctttttccctctctctctttgtctctctttttttttttttttttttttgagacagcgtctcactctgtcacccaggctagagtgcagtggcgcaatctcggctcactacaacctccatctcctgggttcaagcgattcttgtgcctcaacctcccaagtagctgggattacaggtgcgtgccaccacacccagctaattttggggggttttgttttgttttgagatggagtcttgctctgtcgccaggctggagtacagtggcgtgatctcggctcactgcagcctctgactcccaggttcaagtgattcccctgcctcagcctcctgagtagctgggactacaggcatgcaccaacacgcccagctaattttttgtattttagtaaagacggggtttcaccatgttggccaggatggtctcgatctcctgagctcatgattcgcccgccttggcctcccaaagtgccgggattacaggcgtgagccactgtgcctgccaattttttgtatttttaacagagactgggtttcaacatgttggccgggctggtctcgagctcctgacctcaagtgatctgcctgccttggcctcccaaagtgctggtattacaggcatgagccaccatgcccagcctttgtctcttttattcttgtgttctctctctctcttccttctctttctccacctccttctccttctctcccttctcctcacccttctttgtgcttttctctgtgagtttctcttcttctctatttctctcctttggtgaatgtcaattagaaaagcagaaaaactgcgtttaatttgtgatcataaatgcatgtccctggccaggcgtggtggctcacgcctggaatcccagccctttgagaagctgaggcaggaagattgcttgagaccgggagttcaaaaccagcctggtcaaaaagcaagaccccatctttaaaaaagaaaaataattaattagctgggcatggtggtgtgtacctgtagtcccagctactcgggaggctgaggaaggaggattgcctgagcccaagggtttgaagctgcaccgagctgtgattacacccctgcactccagcctgggtgacagaaccagaccctgtctcaaaaaaaacctaataattaaaaataaataaataaataaatgcgtgtcccctggccagtggttgctaatgtttggaatcacctttgacccatgccctttttcattcatagatgtttgtcttgaccaaaatcaaagcattagactttggactataaatcactggttcattcaacaaccatcattgaatgcctactgtatgcagacactcttctggacacagaggagttgacgtgttggtggggaaagccagtgatcagttgggataaaaagggcagacagcagacattaaatagtttaggctttgtgggccagatggtctccatcgcaacgactcaatctgctcctgtagcgtgaaagtaacgacagataaagcgcgtaagtgaatgagcatggctgtgggccaattaaacgttaacctataaaaacaggtggctggcccgcgggctgtagtttgtggatcactgccttagagatagtgttagagggtggtgagaggtccgggatagaataaaacagtagagagtttgtgcattgtcaagatgagaggttgcagttcttcttatacaccccgaatggccgggcaccgtggccattatgatctataattctaacactttgggaggctgaggcaggaggatcccttgagccctagagtttaagaccagcctaggcacatagtgagaccccatctctacaaaaaaaaaaatttaaaaattagctggacatggtggagcatgcctgtaggcccagctacttgagaggctgagatgggaggactgcttgagcctgggaggttggggctgcagtgagccgatcatgccactgcactccagcccggatgacagagcaagaactgtctcaaaaaaaaaaaacaaaaaaacaaaaaaaacagacctgaaggaacaaatcatatgaatgcattaaagtatcacatgtatccaaaaaatatatacatctatcagcctggcacggtggctcatgcctgtaatcctagcacattgggaggccaaggcaggcagattgcctgagctcaggagtgcaagaccaccctaggctacatggtgaaaccccgtctctactaaaatacaaaaaattagctgggcatggtggcaggcgcctgtagtcccagctacttgggaggctgaggcacaagaattgcttgaacccaggagacagaggttacagttagccgagatcgtgccactgcactccagcctggacaacagagcaagactctgtctcaaaaaaaaaaaaaaaaaaaaaaaaaaaaaaatatatatatatatatatatatatatatatatatatatatatatatatataatcaattaaaaattttccttaataaataaacatttctctccttctctcccttggtgaatgtcaattaataaagcaacaaaactatgtttagttagtgatcattaatgtatgtccctggctgggtgtgatggctcacacttgtaatcccagcactttgggaggctgaggcaggagaggatagtttgaggccagcaattgcttgaggctttttgaaagacatgaaggagatgaagggagccatggagatatctcagggaacagcagccgaggtagatggaacagccagtgcaaaggtcctgaggcaggatgttcctggcatttgtgaggacatgtagctgcccagatgtccagtggggagtgagtgaggatgaaggaaggagctgatgaaggaagatgataaaatacttcatggatcagccaggcatggtggctcccgcctgtaatcccagcactttgggaggccaaggcgggtggatcacaaggtcaagagttccagaccagcctggccaacatggcgaaaccccgtctctactaaaaaatacaaaaaagttagccaggcgtggtcatgcacgcgtgtactctcagctacttgggagactgagactcgagaatcgcttgaacccaggagatggaggttgcagtgagttgagatcaccccactgcactccagcctaggtgacagagcgagactctgtctcaaaaaaaaaaaaaaaaaaaaaaagacttcgtgaacagacagcctatataatttatgatccaaaccaggacagttttgagagtgaaaggggaaaaagagcactgaaaaaataattagcaggcctggcatgatctataacgggtataaagtgggacacacagcctctctcacggtcactgtcagacttcagctttttcacactcaaatccacccccatgtttatcccatatactggagaaacgggtgttctcctgagctgagttttggggttttttccttttgttttgttttgtttttgtttttttaacatcctgtatactttttctcaatgaaccatgctcaaaaaaattagaggaaaataaaccataaaacagaaggcactgaaggattttgctgggactcagccattagtttgtttgatgagtatttatggagcgctttctaagcaccaggcaccaccagcgatactgggatgaatcagtaacatccctcacccttgaagctctcttgggcccattgttatttacttaaaatactatgcaagtacggagaaggggtgaagtgggaaaaaatcagttggttgtaaaggccagaatgacgggtctagtcccacccatgccatctgcaccctgtgtgatccaggcacatcatgttgcctctctcagcttcagtttctccatccaccaggcacagagatggcgggaatcgaggaagatgtggggagtatttcatcagcccaaaaagacttggctaatgcgaccataattctgccttctgcctctcctttcccagaaaaatagcttaatcatttggatttgggataaacacatttcctgtgtttattatttaaatgatccaccaagctgggcatggtggctcacccctgtaatcccaactctttgggaggctgaggagggcggattgcttgagcccaggagttcaagaccagcctggccaacatggcgaaaccccatctttactaaaaaaatacaaaaaaattagctgagcgtggtggtgcgtgcctgtaatcccagctacttgggaggccgaggcacaagaatcacttgaacctgggaggcagaggttgcagtgagcctagatcgtgccatcacactccagtctgggcgacagagtgagattctgtccctaaataaataaataaataaataaataaataaataaaataaatgatccaccaacaggaaccccaggaacatttgtattgactatgcaactaatgcttagtgagcacctactatgtccctggtgctgatctggacactgggatttagacaggaaaaatctctaccctggaggagctgatgatcaagatgacaatcttgaaatgcataagttgacaagatgattcagacagtggaacgtgctgggaagagaatgagatgtctggctgagctgcaggaaggggcaagtccttttgattgagaggtccaagaaggcttctctgatgggggcacaatggatctaaggttgagtgataagaagaaattggccaagccaagacctaaaggcagagttgctccaggcataggttcagagaatggaaataattggctgattgtgatcttgaacttgacctttcttttcttctgctaactttgggtttggtttgttcttgcttttctggctccttgaggtacgtgttgggttcttaatttgtaattttttttttttttttttgcttttttgagacagagtctcactgtggtgcccaggctggagtacagcagcatgatcttgactcactgcaacctctgcctcctaggctcaagtgaacctcccacttcagcatccccagtagctgggactactggtgcacagcaccacacccagctaatttttttatttttattttttagagatggggtctcactgtgttgcccaggctggtctcaaacccctagctcaagcgatcctcctgccttagccccccaaagtgctgggatgagaggcgtgagccaccacatctggcctctgttttttgtgatgtaggtatttgatgctataaacttccctcttagttgcttcttggccctttagctaaggtcaagtgtaaacttccctcagcactgcttctgctgcatctcacaggtgttggtgtgttgtgtctctattttcattcatttccaaaattttttaagtctccatcttaatttctgcattgacccaatggttgttcaggagcatgttgcgtaatatccatatatttgcatcatttctgaaattcttcttggtattgatttctagttttatcccacggtagtctgagaagatgcttgacagaattccagtattttaaaatttgttgagagttgttttgtggcctaacatgtggtctgtcttggagaatgtccatgtgctgatgagaagaatgtatgttctccatcagacatgcaagagacagacactttctcacctgcctcatgggatccataaaagagtcaatcagaagttggcatttaagaaagaccagaaggaggctgggtgcagtggctcatgcctgtaatcccagcactttgggaggctgaagtgggtggatcacctgaggtcaggagttcaagaccagcctgaccaacaaggtgaaatcttgtctctattttaaaaaatacaaaaattagctaggtgtggtggcgggcacctgtaatcccagctactctggaggctgaggcagagaatcacttggacccaggaggtggaggttgcagtgagctgagatcacaccattgcactccagcctgggcaacagagcaagaccccatctcaaaaaaaaaaagaaagaaaaaaaagaaagaaagaccagaaagaggtgaaggagcaagctacagagatatcaaactgtatcaatctggctgggcgtggtggctcatgcctgaaatcccagcactttgggaggctgaagcaggaggatcacttgagcccaggagttcgagaccagcctgggcaacagagaccccctctctacaaaatataaaaatttaattaaaaagatgtattggtcagggcagccaagttatgctgcagtaacaaacatccccaaagcctccatgacttttgacaacagatgtatttcctgctcatgctacatgtccagtgcaggttggcagtggggaagaagggggctctgttcagtgcagtcacttgagacctagctaatcacctagaacattgccacttgctattccagaaggaaaaaaggaatgctagaaggtcccacactgaaagttcaatgctctggctccaaaatgacagctatttccactcactcctcattggccagcacttagcatgtggtcctcagccaaccccaaagggactcaggaaggaccatcccaccatattgctggaaatatttgatggcagcattaatggggaacagtgttccaggcagtggaagtctttgagcccttggaagaaagacaaggcgatctctagagcacatccttcccaatattaatgaatttaacaaatgagcaagccatcctcccccactctccttcccgaattcagacttgtgcatatccctcccttaacttgaactgccaaagaagagatgagaaccaggagaagagatctgtgaccccatctttgctgatgaactaccacagaacagccatggcatctccagtccttgtgcttgtaaaatgtacttttcattttgctcctgaacgaaatccacccacccccacccccaaaccagggaaagctcatctcctaatccaaaactgcacccagccttccaccaccttcttccctgggaattgttgattccagagtatggaattgaataattggatgagtttggaagagaaaaagtgtctctaaaatcaggcagcagaagcccactccccagagaggatggtgcagatgagagttcaggagggagcttggcttggggttgacgatctgagctatgcagggaacttggacacacctctcaatcagtcattcaacagacaccacttattgagcaccgactgtgtgccagatgttgtcctagggggctgggaatacaggaatacagcagggaacaaaaaggacaaagcccctccctcttgtcgaatggacattccagccaggaagacgagagaacaagagaaataagtaaagtatataggcggtgaaatgcaaatgggaaaaaagaaacaatggggaccagaaatgaggggtgcaattgtaaagggccatcaggggaggcctccctcagaaggtggcatttgagtaaaaaacctgaaggaggtgaggggaaaccatgtagcaatctcaggaaagagcattccaggcagggagggacagcctgtgcaagggccgaggtaggactgtgcttggcgtggttgagaaactgcaaggaagccaggtggctggaaccgaatgagcgagggaaaaggggaggagataaaagcaaggagatgggagggttggaggccccctctgccattcagtaactgagtaacttcatttatttcctgtagcttgaaccacaaagaaccacaaatagagtagctgaaaacaacagaaatttatttattctctcgcagttcaggaggccaggagtccacagaccatcaaggtcagctgggccacagaccatcaagatgtcagctgggccatggtgcctcctgagacttggtctgaaatcccttcttgcctccctcctagcttctggtggtttgccaacagtgcttggtggtccttgtcttgtagacgtatcaccctgatcccgccttcatctccatttcacatggccttctccctctgtgcaaggttgtctctgtgcccaggtttctccttttcttattatttacttatttgtttgtttgtttctttattttagacacagggtcttgctctgtctcccaggctggagtgcagtggtgcgatcatagctcactacagcctcaaactcctggcctcaagcaatcctcctacctcagcctcctgagtagctgggactgcagatgtgagccactgtgctctgcccagatgtcctctttttataaggaaacccgtcatttaggatgaggttccaccctaatgacctgatcttaacttgattccatctgcaaagaccctatttccaattcataggtaccagggattaggacttcttcaatgcatctttttggagagacccactgcaacccacaacagaactgtgggcatgtaacttgacctctcggccaggcgtgatggctcacacctgtaatcccagcactttgggaggccgaggtgagtggatcgcctgaggtcgggagttcgagaccagcctggccaacatggtcaaaccccgcctctactaaaaatagaaaaattagctgggcatggtagcaagcacctgtaatcccaactacttgggagggtgaggcaggagaattgcttgaacccaggatgtagaggttgcagtgagccaagatagtgccattgcactccagcctgggtgacagagtgagactccatctcaaaaaaaaaaaaaaaaaaaatagacctctctgtgcctcagctttctcacccgggaggatggggataattatatacccactcctggggttcatgagaggattaaatgagctcaaacagtccaagcctccacgtgtgtctgttgtggtgctgggtagcatgtcctgtggccagaggttcccaagcttgtcgaggacccaggcaagggcagattcgggtcttgttggcagcacctgagatggacgggctgccttggtatggaagggcctcggctgtttttccctttcagtcctgtccctctcccccatcctccaccctgtccctgtcatctgagcctgctcctcgtgatggctcagagtctccctactggcggccggtgcagagtttcgttccctgggctatatttagccctgagaaatgggaacgagaaccctcagccgccaaagtgatggagagaggagcacaaagccagtgctgccttctgtccagcaatgttccgctgactcggttctttcttccagaaccttccagaagcaaagcattggcatttctgagctcgttaaaacaaggatgtgggctggtggctggcacattcattgtccccagaacctgtctgtgtccatgattaaagctgactttgttagttttattttcagtgcttttttttttttttaatccatggcaaaacacacatgacataaaatttaccatcctaatattttttttaactttgtaacattttttaattgacaagtaattgtacttattcatggggtacatagtgacgtttcaatgcatataatgcgtagtgctcagatcagggtaattagcatatccatcttctcagacctttattgtttctttctgttaggaacattcaagctcctccttctagctatttgaaaccattaatatattgttgtcatcctaaccatttttaaggatacagtttcgtgaaattaagtataatacattcacattgttgtgcaactgtcaccaccatccatctcccaaacttttccatcttccaaatgtaactctgtccccactaaacgcgaactccctgttccccctcccccagcccttggcacccaccatgctactttctgtttttataaatctgacgactctagggacctcctataaatggaatcatacaggattttcccttttatgactggtttatttcacatagcataatgccctcaaggttcacccatgttgcagcacgtatcagcattttctttctttttaaggtaaagttgactattaaaaaaaaacttctgccgggctcagtggctcacgcctgtaattacagcactttgggaggccaaggcaggcagatcaggaggtgaggagttcaagaccagcctgaccaacatggtgaaaccccatctctactaaaaatacaaaaattagccaggcatggtggcgggcgcctgtaatcccaactactcaggaggctgaggcaagagaattgcttgaacccgggaggcagaggttgcagtgagctgagatcatgccactgcactccagcctcggcaacagagtaagactccgtctcaaaaaaaaacaactttttaagaattgaagtagaataaacatacagaaaaatccgcggattataagtgaagagcttgattaattgtcacaaactaaacacatccatgtaaccagcacacaaatgaggaaacagaaacttctcagccccagaagcccccctcatatcctgttcctagtcactacctccccgcaagggtacccctaccaggactttgagcatcattcaccagtttagcctgttttgtattttgcataaatgaagtctggcttcttttgcttgacgttaactttttaagatctcatgtgacctgtggcattgttcattgcatgtatcctctctctcctattgataacagtgtggattgtttgcaatttggagctatgatgaataccattgctatgaatgttcttgtgtgtgctttctgttgtgtaattattcagaattactatttcggaattactatctaattgtagtgatcttggatcagtaactatccaagaattactgggtgttggcaaaggtacatacagttatacactgcacaatggcattttggtcaacaacagatcaaatatgtaacagtggtcccataatggaccgaatacataacagtgattatcatacagtatttttactatagcttttctgtttttagattcttttttttttgagacgaagtctcgctctgttgcccaggctggagtgcagtggtgtgatctccgctcactgcaagctccgccttctgggttcacgccattctcctgcctcagcctcccaggtagctacaggcgcccgtcaccaggcccggctaattttttttgtatttttagtagagacggggtttcaccatgttagccaggatggcctcgatctcctgacctcatgatctgcccgcctcggcctcccaaagtgctgggattgcaggcgtgagccaccgcacccggcctgtttttagatatttttagatacactatagagttacaattgcctacagtattccatagaataacatgctgtatgggtttgtagcctaggagcaataggcgagaccatgcagcctaggtgtgtagtaggctataccatctaggtttgtgtaagtacactccatgatgtttgcacaacaaaatgacctagtgacacatttttcagaatgtatgcccattgttaagcatgacttaattttagcatagaaactctcaaccaatttttcaagtagttgtaccatgtgttatgggttttattgtctcaccccaaaattcatatgttgaagtcctaacccccagtacctcagaatgtgaccttatttggaaatagattcattgcacatgtaaaggttttgccattggcaaaactgccgttatttttgcaccaaccatagcagttaagatgagatcattagggtgggtcctaatctaatacgatggtgtccatataaaaaggggagattttggcacagagacaggcacactcacaggaagaatgccatgtttaaacaaaggcagagctcaggatgatgcctctacaagccaagaatcagcaaagattgccagcaaaccgccagaagctaggagagaggcataaaacagattctgtctcacagctctcagaaggaaccagcccttctgacaccttgagcttggatttttggcctctataactgtaagacaataaatctttgttgtttaagccacctaggttgtggttccttgttacagcagccacaggagatgaatacagcatggtgccctcccattggcagattatgagggttccagttgctccacagcttcacagacacctggtagtaatgacctcatcttaacttctttctcattttagcctttcttccaggcagcagcagtgtcatacatgcttttaaaggtgggcttttaaagccacacttgagagccctgcattctgcaggtgtcacagggtgatcaactattcaaaggctacccctgccctgacagctggaggcaaggcttcccagcacagaggttaagcccatggactctggggccaggtggttagtgcaaatcccatgtccactagtgaataactctgtgatcttgggctgatgattttgtctttctaagcctcagtttcctcaatagtaacatgggcattataacatagaggcatcatgaggattaaatgactaagtgagctaacatacataatgtgcttaggaaggtgccagcacaccataaatactctgtaagtgctggcttttatcattcttttctctctctctctctctctctctctctctctctctctctctctctccctctctctctctgtctctctttctctctccaccccccaacctcctctccttgattttcttcccctcatcttacttccttcttgctatagtgttctattttctgtttcagagagtattctatttgtggacttttttcctcttgaaaattgagctgaaacttctgagaattttttgtgattggcattaaggctgcagggaatggagcagggagacacttgaggaaagggctcatggaccatctgtctggcttggtgatttcaccaggccatcagactctgtggtcatgcatctcctctaaggggagtctatgactgtgttgggagaagagaaggaaccagggattaattaatccatttcaataggttttgtgttttgtttggtttactttttccttctccttctggactgtggtctgggaagtcctcttgtgtttcttactccattcccaggtcaattatgttatgtgaggagaacataattaagagagagctttaccctttggatgttttcttcagaaaacgttcctccatttccccctctgggatgccagagccccagaactccacaagccaagaacatttaagacagagccacaagagaaccgagcttccccttccctcacctgtcaggttctatctgagtcccagtcaactctcacctgctttccctcctcacaccctacagagcaacgatgcctcagggaacacttggaactggttgtacttcatccccctcatcatcatcggctccttttttatgctgaaccttgtgctgggtgtgctgtcagggtaagtttctgctactccccaccccatcccactcactcctctttgctaacttctttccaagtagaggccattgaagctttgttttcattcactagacagagaaaaggcttcttcccttgtttgggttaccagactgttattagcaagccatgcacaggtgcagaggttgtgtactgctaggggtacccagtgagagggttcatatgggctttactttctttacattttttttaaaaaccaatagtttgggtttacttctcccccattttccaaatataaaatcatagcatatgctctaacggtgtattttcctgacccatattgtcctctatccccaagatttttttggcttaatcataaatgggcttcatttttcttaccataagaagtctgggcacttgtatggtggctctatggcaccatcagcaaccccagattcttccagctttccattctgacatctttaccagaggcttccaatctcgtggatacctcatggtcttaagatggctgcctcacgccctccggatggccacttcatgttccaaacaggaaaaggaagaagggaaacaggaagaggtgggacctatggcagagaagccaacctgctgcagaaatctttcattcatggcttattggtctaacttaaaagagggctgaaataattattagccaaaagtatgaagagaatgagaatgaggtatgcagccagtggtggttggcatggcatggttttatcctttcggtttttttcttttttattgtttttttttgagacggtgtctagctttattacccagactggagtgtagggggcgatcatagctcactgtaacctagaactcctaggcacaagcgatcctcctgcctcagcctcctgagtagctaaggcaacaagtgtatgccaccatgcccagctacattttttatttttcatagagatggggcccactgtgttgtccaggctggtctcaaattcctggccttaaatgatactcccatctcagcctcacaaagtgctgggattacagacatgagccactgtgcctggcctttttctttacctaggcacagttgtcgggaaatgtgtgaagctggcagaagcacccatcactataatatcccagtcttttcccagaagtcctgactcctcctgttgaaaactcctgacctccagggacttctgaatccccaaacacacacacacacacaaacacacacacacacacacacacacacacacaaacacacacacaaacgtttcctaacattttcaaaacagccatactctggcttttctatgcttctccagggagtttgccaaagaaagggaacgggtggagaaccggcgggcttttctgaagctgaggcggcaacaacagattgaacgtgagctcaatgggtacatggagtggatctcaaaagcaggtgaggccctttcatcctggggcccagggatggagatcccaggccacggagtacaaagagagtcatgcagtttggagaaggctaagctgggagggttatgatgggaggagaaagagaacctgaattggtagtcccaaattttatcaacaagaatccagagtctgatatgaagaagtctaagatgaagccaggatctgacatcacgtaacttgaattctgaaatcagacgctggtttacatcccggccctgccactttttacccatgcaccacacatccctgtacctccgtttcctcagctgttacatggaggcgatggtagtgcctaagtcatagtactattggagtatttagtaaaataatctcagctgagtcacttggggagagaagtgcctgatacacggtaggcacatatttatttgttcagccatttaacaaacatttagggagcacctgctgtgtgccaggcactgatctaagcactgaggatatgggagtaaacaatacacaccaaatccctgccctcagagctctgatattctaatgagagagataaagcaaacaaatacatgtcatgttgggaactcccaaattcagagaaggaagataaaacagactaggaagataaaacagagtaggaagttggccgggcgcggtggctcacgcctgtaatcccagcactttgggaggctaaggcgggcagatttcctgaggtcaggcattcgagaccagcctggccaacatggtgaaaccctgtctctactaaaaatacaaaaattagccaggcatggtggcgcacgcctgtaatcccagctactcgggaggctgaggcaggagaattgcttgaacccaggaggcagaggttacagtgagctgaggtcgcaccactgcactccagcctgggcaacagagtgagactctgtgtcagagaaaaaaaaaagagtaggaagttagaggcagggtggtcagggaaggcttctctaaggaagtaccctctgagcagagagacctgaaggacgtgaagaaggaagctgtggggatgtcaagggaaggggcattccaggcagagacagcaagtgcaaaggccctgagctaggaacgtatttgagacacagcaaggaagccagtgcagctgaaacagagtgagaggtggggacagctggaggagaggaagacaggaaggtgatggagatcagatcaagcaggggcttataggctgtggtgtggacattggtttttattttgcgcgaggtggggagaatgttggctattgctactgttgcggaggtggggcttgaagtcacaaaccacccagcagcatgttttttggtcggttgagctgtcaccatcagtcagcagagaatgggggtggccgggcagacccttcttcctggtccaagggagaactcatcctccaaatgcaggagcttaactctgtgctcttcctcttcagaagaggtgatcctcgccgaggatgaaactgacggggagcagaggcatccctttgatggtaactgctctaaacccacctcaggggtgggtcccaggggagaagggagaagctgtggtggggagtcgggggagagcaggtgactggttctaaggatcttgcagagggtagacgttcctcttggaggaattttaggacttccatgcagagtttccctattctggcctccacttttttgttttaaccatggacctggttttttctgctttgtgccttggtttttctcatctgcaaaatgggtatgatataaacaataccctagctcacgagattgtttctcagaatgatattcgttatggcaaatagaacacctgggatagtgcctggcatggggtcagcacgtttctgtttgctaaataagtaataattccaccaataatccagtttactgtgaacggctgctgtctcccatgttagaaacttaacgagacagaaccatgactttctttcttttcttttttttttaattgagacagagtctcgctctgtcacccaggctggagtgcagtcacacgatctcacctcactgcaacctctggctcccaggttcaagcaattctctgcctcagcctcatgagaagctgagattacaagcatgagccaccatgcctggctaatttttatattgttgatagagatggggtttcgccatgttggccgggctggtcttgaactccttgcctcaaatgatctgcacaccttggcctcccaaaatgctgggagtgtagatgtcaattcatggtcccctggaaacctgaatatgaaaggagggaccattaaaaaggtgtccaaaagcccaacctccccagcatagctgggagtcaggggacagactgtaagagtcactgtgtatccaacctgaggcttcatgaaagtaaagtttcctagaatttagagatagggttggatgcggtctgtctgtggctcacatctgtaatcccaacactttgggaggccaagacaggaggaacacttgagcctgggagttcaagaccagcctgggcaacataatgaggttccgtctctacaaaaaataaacttagccagatgtgggggcacacgcacctatggtcccagctactcaggaggctgaggtgggaggatcacttgagcccaagaggtcgaggttgcagtgggcaccactccactccagcctgggtgacagagtgagaccctgtttcaaaagaaaaaaaaagaatttagagataggccagaataatatgtctgcaatataataataacagcaataagaaaaataatagtactccctgaaaaatgcaacttcttgcttgagatttatcttctcatactttagaaaactggttagacaggggctgggcgtggtggctcatgcctgtaatcccagcactttgggaggccaaggcgggtggatcacttgaggccaggagttcaagaccggcctggccatcatggcgaaaccccatctctactaaaaatacaaaaattagctaggtgtcatggcacacgcctgtaatcccagctactcaggaggctaaactacgagaattgcttgaacctgggagacggaagttgcggtgagccgagatcacaccactgcactccagcctaggcgacagagcaagactctgtctcaaaaaaaagaaagaaagctggttagacagggtgatgacttttgattaaaaatctgagagatttgagggaaataaaagaactggcactgcgtcccagaaggttataaaatgaattttattatcttagttggggaggggagattacctaactcccctaaatgagttaggtaatctaactcatttagggtacctaaatctttttattggaagtctacacctgaacttgtctgctgtggagcccctggggtgtatagcttgaatatgggggcagaatcccaaaattgcagcctgcctagcgagtatgctacaggtcaaggggtggactgttttcataagaaagtgaggtttcttagaatttaaaaatagaggctgagtggggcggctcacgcctgtaatcctagcacttttggaggccaaggcaggcaaatcacttgaggtcaagagtttgaccagcctggccaacatggcaaaaccccatctctactaataatacaaaaattagccaggcgtggtggtgcatgcctgtagtctcagctactcaggaggctgagggaggagaatcgcttgaactcaggaggcagaggttgcagtaagccaagatcacaccactctctgggtgacagagcaagattctgtctcaaaataaataaacaaataaataaataaaccagaaggaaaatagtggctgagggcccagacctggagtcggactgaacccgacttgattcttgtctttacccctttaagcaaagtgatagtgccaccttgaacctcagtttacacatctgaaaaatgggtatactattagttcccgtgagaacagttgccgtgagagttaaatccaaggacacactgtgtccatatggtctgtgttgcaaaaagggtaacgtctttttctcttgccatgtttccattgttggagctctgcggagaaccaccataaagaaaagcaagacagatttgctcaaccccgaagaggctgaggatcagctggctgatatagcctctgtgggtgagtcccttcctctgccacctatcagttgttcatcacctatcgcccaagagacatggtggggtgggggcagagggcttgcaaaccgtgctgcctggatttgggtctcagctccaccctttcccacctgtgcgtgtgtcctgggcagattacatcattatgggaataacatccgtgcctagcttctcattattttgtgggaattcaactaaatgatccccatgaagcatggcaaaccagcacctggcagggacgaagctcccagtcaagttggtgaatgtttgtgactcattcgggaagtattcatgggggacctgcttatattaggtgcttggttgcaaacaagacaaggcagtcacgaggctgagctgggaggatcacttgagcctgggaagtggaggctgcaataagccattattgtgttactgcactccagcctgggcacagaaaaaaaaaaaaagacacaaactgagccaggcacagtggctcacgcctgtaatcccaacactttgggaagctgagatgagcggatcacctgatgtcgggagttcgagaccagcctggccaacatggtgaaaccctggctctactaaaaatacgaaaaaaattagcctgtagttccagctactctggaggctgaggcgggagcatcacttgaacctgggaagcagaggttgcagtgagctgagatctcatcactgccctccagcctgggcaacagagcaagatcctgtctcaaaaaaaaaaaaaaaaaaaagacacaaaccaaatccctacctacatggagctcacagtccagtgcaggaaatagaaattaaacagagaattacacaaataaacctgtaatggtaatggcacttcagggagaggctctgggcttagcttgctctagaaggatggggagcagtcagggaaggctacctggaggaagtgacggttaagctgggaactgaaggatgggtaggagatcactgtggtggtgatagcagaaggaacagtgtgagaggcagggctcagacctttgccaccacaagggccagagttcgagggaggagggaacatttattctttcccttctcactcctctgtcctattgattcattggctgtgatgatgttgattttgaccttctaaagtgagaatgtattgttattgttgttgttgttctttaatgggtttttgtttttaatggaaggaagagcatccaggcagaggaaataagactggaataagattgaggggagaaggaatttaggctgcttgggaaactgtgtggccgcagtttagaggaagaaaggatggcaagagaaagaggaagggaggaagagaaggagggagagaagtgaaggaaggagggaagttagtacatccatgtgtttctgatccatagtttctgatccactatttcgtattccccttttatcgctcgcccctagtttataaccttattgctgagtttaggcataatttccattgcgatcacatatctcgtagggtggatacactatggtttgtttagccatagctctattatagggtgtttgagttgtttccaataatttctcttacgaagaacactgctgtgcacatttacgtacaatgactccccccaccctttgggcgtatttccttggggataattataggatcaaagatattaacagcttttcaactcattattcaaagagccattctgagtttcaaaaacatggaacccatttataaacctgccaagtatgcatatgttcatggattccccacccaggccatcgaatattaccaatttaatttcctttcccagttaagtgggtttgtaatgaaaccttaaagcttgttttcatttgcatttttaatttccagccaaaacacgcttttctttgtaatggagaactcattctgcttccactcgtgtgtgcatctgtttaatttcctgtaagcaaatgtcaagaattggagcgctcagtaggtgtcttgagtatttgatcaattatgtctgtctcacgtgttacgttacctccattgtttaaaatctgttttatgacgaggtacagtggttcacgcctgtaatcccactgctttgggaggccagtgcaggaggatctcctaagatcagccgttcaagaccagcctgggcaacataacaaggctccatctctgaaaaacaaaatgttgaaaaacttagccaggcattatggcacacacctatagtcccatctatttaggaagctaaggcaggaggatttcttgaacccaggaattcaaggttgcagtgagctatgattgtgccactgcactgcaacgtgggcaacagagtgagaacctgtctcttaaaaaaataaaataacatacattcttaaaaatctactttgctggccgggcgcggtggctcacgcctgtaatcccagcactttgggaggctgaggcgggtagatcgcttaaggtcaggagtaggagaccagcctggccaacatggtgaaaccgtgtctgtactaaaaattcaacaattagctgggtgtggtggcgtgagcctgtaatcccagctactcaggaggctgaggcacaaaatcacttgaacccgggaggcggaggctgcagtgagctgagatggcgccattgccctccagcctgggcatcaagagtgaaactccatcaaaaaaataaaaaatctgcatatacatatatatgtatatatatttttaatttttttaatttttttttttttttctgagatggagtcttgctctagcacccaggctggagagcaatggtgccatctcggctcactgcagcctccgcctctgttaacaaggcaggtgacattgcagctttctaaacagacccaaaacccaggccagtggcttgttctttcatagccacgtttgctacaggcaaatccaccaaaacccacctcatcagcctgattactcaaaaagacaaagaaaggagcccccaatctagccagtggttttctagaccaccccaaaagagatctctggaattccaggattctggcaaggaatcacatttagctttatttatttatgtaaagaatgcaacaatacaggctgggtgtggtggctcacgcctgtaatcccaacattttgggaagctgaggtgggaggatcgtttgaggtcaggagtttcagaccagcctaggcaacatagtgagaccctgtctctatcaaatattagctgggcattgtggcacacgccagtagtcccagctactcgtgaggctgaggtggatcacctgagcccaggaggtcaaggctgcggtgagccacagcatgcccctgcactccagcctgcgtgacagagacttcatctcaaaaaaaaaaacaaaaaaaagtaataatacagtaatgcatatttcaaagtaaggtgggagctatgtggtatttgcgttcacgttcacattataccacagtatgcacagtccttttttttttttttttgagacagtgtcttgctctgatgttcaggctggagtgcagtggtgcaggcatagctcactgcagcctcaaacccctggactcaagtgatcctcccacctcagcctcccaagtagctgggactataggtgtacactgctacactcagctaagttttttatattttttactagagatgggatctcaatatgttgcctaggctggtctcaaactcctggcctcaaacaatcctcctacctccacctcccaaagcagtgggattacaggcgtgagccaccacacctggcccacatgcagtcttatataattggtgattctactgcgctgttgaatcagttgataaacgcactataaagcaggttcattcctaattgatgaacttactgctgaaataaggaacttgaatcatttacatgaaaagttgagccatgttgctgaaaggatatcaatttttttttcttttttttctttttttttgagatggagtcttactctgtcgcccaggtgggagtgcagtggtgcgatctcggctcactgcaacctccaccttccaggttcaagcgattctcccacctcagcctccaagtagctgggactacaggtgcacaccaccacgccctgccaatttttgtactgttagtagagatggggtttcaccatgttggccaggctggtctcaaactcctgacctcaagtgatctgcccacctcagcctccgaaagtgctgggattacaggtgttagccaccgcgcctgacaggatatcaaatttcatttagactgcaggaatacgttcaagagatctattttgtacagcctggcgactgtattaataacaatgtattatatacttgaaaattgctcagagagtaggttttaagcattctcaccgtgagaaaagtgataagcatatgtaataatgcatatgttaactagctcaactgagccactccatagtgtatacatatggtcaaaatatcatgttatgcactataaatagatacagcctgtatctgtcaatttaaaataaatgaataataactttaaaaagaaaaataacagtatggctgggcacggtggctcacacctgtaatcccagcactttgggatgccaagacaggcttgaggccaggagtttgagaccagcctggccaacatggcgaaactttgtctctaataaatatacaaaaatcggctgggcatggaggcgggcgcctgtaatcccaactacttgggaggcagaggcatcacttaacctgggagatggaggttgcagtgagccaagatctgcactccagcctgggtgatagagtgagcctttatttatttctgtaaagaatgcaataatacaggcctggtgcggtggctcatgcctataatcccaatgttttggaaggccaaggtgagaggatcatttgaggctacaggcgcatgccacagtgcccagctaatacttgatagagacacggtctcgctatgttgcccaggctggtctcaaaaccctggcttcaaatgagcctcccaccttggcctcccagagtgttgtgattacaggtgtgagacactgtacctggcctgtattaaaaaaaaaaaaaagaagaagaagaagaagaggaggaaagaagaagaaggaagaaggaagaagaagaagaggaggaggaggaggaatgggaaggggaaggggaagaagaagaggaggaaggggaaggggaagaagaagaggaggaggaaggggaaggggaagaggaagaagaagaggaagaagaagacgaagaagaagcacaatgataaataagtaaaatgtggagcatatgaaaacaaaacaaaaaaaagttgatccattatgaatggaagctgccattgtaactctgcttttttaggaaaaccagaccccatttagatgattttatttgtttttaaaggcaggttcttgctctgtcactcaggctggagtgcagtgatatgatcatagctctctgcagcctggagctcctgggctcaggcgatcctcccagcttagcctcccaagtagctgggactacaggcaccaccacacccagctaatttgttgttgttgttgatgttgttgttgagatggggtctggctatgttgcccaggctggtctcaaactcctggcctcaagtgatcctcctgccctggcttcccaaagttctgggattacaggcatgattttttattaatttatttgcagctgacaaatggtaattgtgtatgtttatggagtgcagtgtgatgttttaatctatgtatacatcatagaatgattcagtcatgctaattaacacatccatcgcctcaccacctcaccgttttttgtgtgtggggaaggcattaaaaatctcttagcaattttgaaatatgcaacacattactatttattaataatgcaatataaatacacaataatgtattaatgcatcactaaatgcgatgcaatgcaatgcaatgcaatagatcactaaaacttactcctccagtctaactgcaacttataccctttgatcaacatcttctccttctcaatccctcctcctcccctgcagcctccaggaaccaccttcctgctctttctatgagatcaattttttttagttttaagctcccacatgtgagatcatactgtaattgtctttctgtgccagcttattttactcagtataatgtcctccagttctgtccctgttgtcacacattacagaatttctttcttttagggctgtatagtattctatttgtatacataccacattttctttatccattcatccattgtgggacacttagtttgcttccatattttggctattgtgaataatgctgaagtgaacgtgggagtgcagatgttctgaaaagacttaaatgtcagacctgaaatggtaaagatgctccaagaaaacataaggagaaagctccatggcattggtctcgggaatgattttttggacaggacctcaaaagcacaggcaacagaagccaaaatggacaaatgggatcgtatcaaactaaaaaatttgtgcacagcaaaggaagcgttcagcagaggaaagagacaacctaaggaatgtgagaaaacgtttgcaaacaatacatctgataaggagctaatatccaaaatatataaggaactcaaacaactcaacagcaagaaaacaacccaattaaaaatgggcaaagacagctactcgggaggctaagatgtgacgatcccttgagcccgggaggaggaggttgcagtgagctgacattgcatcactgcactccaccctgggcgacagaaggagaccgagaccctgtctcaaaataaaaaataaaaatgtgcaaaggatctgaacatacatatcccaaaagaaaagacatacaagtggccaacaggtatatgaataaaatgctgaacatcactcatcatcagggaaatgcaaatcaaaaccaccattagctatcacctcacacctgttagagtagctattatctttttgtttgtttgtttgttttttgttttttgttttgtttttgagagggagtctcactctgtcacccaagctggagcgcagtgttgtgatctcagctcactgcaacctctgcctcctgggttcaagggattctcctgcctcagcctcccgagtaactgaaattacaggcacacgccaccatgcccagctaacttttgtatttagtttcactatgttggtcaggctggtcttgaattcctgacctcaaatgatctgccctccttggcctcccaaagtgctgggattacaggtgtgagacactgtgcccagcctagagtagctattatcaaaaagacaaatgaggtttgttgaagttctaacccctggtacctgcaaatgtggccttacatgaaaatagggtctttgcaggtggtaatcaagttaagatgagatcaaacttaattagggtgggtcctaaatccaatgactgctgtctttataagaggagaagcaggctgaccaacatggtgaaaccccatctctactaaaaatacaaaaattagctgggtgcagtagtgcacacctgtagtcccagctactcaggaggctgaggcaggagaattgcttaaacccaggaggtggaggttgcagtgagcagacgtcatgccactgcactccagcctgggtgacagagtgagactccatcttacaagaaaaaaaaaaaagacaaatcataacaagtgctggcaaggatgtggggaaacggggatccatttacatcattttaataacacaggctctatatgggtggtattgagttcccagagttgccattacaaaatgtcacaaacccagtggcttaaaacaacagaaatttcttctctcacagttctagaggccagaagtccaaactgaaatcaaggtgtcagcagagccaccacgttccctcagaaggttttaggggagaatctgttccatggtattttcttagtttctggtgctgccagcgatacttggtgttcctcagttcatagatgcataattccagtctctgcctctgttgtcatatggtcttctttctgtgtttctgtatgcgatttcttttttttttttttttttctgagacaagtctcactccatcacccaggctggagtgcaatggcacgatcacagctcactacaaccccaacctcacaggctcatgccgtcctcccacctcagcctcccgagtagctgggattacaggcgtgtgccaccatgcccggctaatttttgtatttttagtagatacggggtttcaccatgttggccaggctggtctcgaactcctgaccttacgatctgcccatctcggcctcccaaagtgttgggattacgggcacgagcccaccgcacctggccctaattactttatttttttgtaaatttttttttgtaaatttcatgtagcctgagcatacagtgtttataatatatacaggagtgtacaataatatcctaggccttcacattcactcaccactcaactcactccctcaccaagagcaacttccagtcctgcaagctccattcatgccaagtaccctatgcagctgaaccaccttttctcttttatactgtgtttttactgtaccttttctatgtttagatatgttcagacacacaaatactatgatgttacagttgcctacagtattaagtacagtaacatgctgggcaggtttgtagccgaggagctacaaaccacgtagcctgggtgtggagtaggctacaacatctaggtttatgtaagttcactttaagatgctcacacaaggacaaaattgcctaacaatgcatttctcagaacacgtctccctcattaagccacacatggctgtattacaatttacatataattttaagcgtatataaattgccagaaatcaccagatgaatccttggcggtgacataccccttcccccaccatagaacattgcagactggcccggacgcccagtatctcatgcctgtaatgccagcactttgggaggctgcagcgggcagatcacttgaggttaggagttcgagaccagcctgaccaacatggcaaaacaccatctttactaaaaatacaaaaattattcggacgtggtagtgggcacctgtagttccagctacttgggaggctgaggcaggagagtcacttgaacttgggaggcagaggttgcaatgagccaagatcgtgccactgcactccagcccgggtgacagaatgagactctatctcaaaaaaaaaagaaaaaaaaaaaaaaaggaaaagaacatttcagactggtaccagttacaccggctcttgatcccttgaatgtggctgaccctgaactaggatgtacttcataataacacgtccggctgggaatacttagtacaaaagaaagagtataaaatatcttttgaatccaccttgatattgattccatgttgaaatggtaatattttggatgtattgggttgaataaaacatctcatgaaagtgatttttaaaaatctagaaattgtctgcaattataattccagaccacagagaaaaacgagagacaggaatgtatagaaaaagggaacgtgggacaaagtgagtatgaaattcaactaacagaagtgacagtgcctagcatggggtccagcacttagtaggtgttcaattaatattcatttccctctcccttaccagtgaagggtatgcctgtcgtggggaatgtgtcttcaggctgagtgatcaggaaggactttctcaatggctggcacgtgaacctagtcatgatttcagctcttgaggttgtactagaagatttatatccaataatcgtaaggtaccacttagcatcacgctaagatgtattaattcatttatgcctttggatggccctttgaggtaggaagtgtggttgtctccagtttaccaaggtggcttgcccaaggtcatctgctggttggtgattaagccaggttttcagtgtggctccagcaggagtgggggctggggaccttctacctgctgtggtttctctctctctctctctctctctctctctctctctctcgatctgtggaacatcccccctgtcccccaaggtcccaagggtcttatttcttttggccaagccctttggagacctgcagatctggacacatctttgagagtttcaggaactagggccagaaatgctgggcagggtcatgaggagctgccactggggttgagaaggtgatggacatgaggggaagggtctttgcagaaaggagaggcgtccctgtaagcaggtcacagccactgggcctggccaactgcagccgagtggaatgtgcccctgccccatgaccatatgccccaggtgtgcaatgtggcggcccagagcacacactctgaaccatcttgacacatcttcactggttactagacccccctcagcctgtttccttggctgtaaaatggggatgacgctggtccctacttcctagggctctgagcaggagtaagtagcttgtcgtataaaacatgttccctgcagtgcctggtgcctgctaaatgttccataaacgtcagctgttattttcattcaggggaagctgaaatccatattttcatggaaaatctcccagtttttaaatgtggaccaataatttcagctttcacaaacccagtatgagtcggtatggcccctagggtgccaactcaaaatctctgttgagaattttgctgataggaagtggcctccttggaggtgtttgctgtgtcctgtgtctggcaagtggggtggttttgataaacgtgctggatggatgtatgggtgaatggataaatggaggaatgaatggagaaacaaatgagcaaatgaataatgaatggatggatgaatggatgagcgaatggatggatgaatggatgagcaaatgaatgatgtacacacaaaggaatggataaatgatgaatgtgctaatgaatttaagaatgatgaaagaatgaatgaataaatgaacaaatggatggatgaaagaatgaatgaatgtactaatgaatgaatcaatcaatgaagaaccatttaaaaatgaatgcaactgagggtttataagaaaaggtatcttaagcctgggcatggtaattcatgctggaatcccaatgcttagggacgctgaggcgggaggatcgcttgaacccaggagttcaagaccagcctgggcaacacagggagacctcattgctaccaaaaacaaaattgttttaattaagcgggcatggtggtacgtgcctgtagtcatagctacttgggaggctgaggtgggaggatcgcttgaacccaggagttcaaggctgcagtgagctaggatcaagccactgcattccagcctgggcaacaaagcaagatcctgtctcaaaaaaaaaaaaaaaagatgtattttagaaggtaaattcaatctgtccaaaactgagctctgaccttcccctaaacctgtgcccattcagtggatgagagctccatcccttaaggggttcaccaattcatccattcctttgtatgtacatcattcattcaccttggctcatccctctctcttacatccacaccgttccatcagcaaatgttgaatctgtcttaaatgattcatcccaaatcctccccgcttaactaccacccaactccagcccccatccatcatcatcatcacttgcctggatgggttcagtcacctccagcctggtctcccagctcccgtcctcacctctcactgtctactctcccactcggcagccagagggtgcctgtgaacacccaaatcaggttccatccctcctctactcagaaccctccacggctcccccctcactcagggtaaaagccaaagtcctccttgtggtccaccaggccatgcatgatctgcctgtcacctccctgccttcaccaccttcctcttttcccctcaaccactccactccagccacactgacttccttgtgctcttccccaaaaatgtcgggcagacacattcatgcttcaggaccttaaatttgctgtttcctctacctaagatactaaagtgacaagtcaacacactcaccttgaccatgcaatttaatgttgcagcctaccctgtggactctccaagggctcccagtccctctgtgatgctttactttttctcttaaaaaaaaaattgttatttaaaagaacttgtctcgctgtgttgcccaggctggtgtcaaactcctggcctcatacagtcctcccattccagcttcccaaagtactgggattagaggcatgtgccactgcacccatcccaactttttttttcccatagcacttttcattttccatcccactgttaatttacttattacgtccactgtctgtctcctccccttagagggtcagaccccggaagtccaggctctgttgcctaatgtatcctgagcccctggaacagagcctggcacaaaataggtactcaataaatgcataagagcaaaactatatgtaggcagaggacacacccagcttattcctcagtgatcacttctaaagttaaatgtccatggaaaacagtctcatccacatctctttctggaggccttccaagcgtgctccatgcagctctgttgcctgcccctgcatcagggaatggaggctctgctttatcctgccctgtggtgtgactcccagaggcatcagatgtggctgggagtgggagacatggaaaattggctcctgcaacagagaactatcagccttcccatcaattggttacttctaattctgttatttttcaggggcactgtcttctcataagctccatctatgcaaaactaagcccatgggtcatgatggttccctcaggccagaggcttgctggagagactaatggatcccctggctaaaatctgtgcttgggctgcacattggttaatttcttctgaaggaacagcctgagcctgacattctccatcttttccctggcaggttctcccttcgcccgagccagcattaaaagtgccaagctggagaactcgaccttttttcacaaaaaggagaggaggatgcgtttctacatccgccgcatggtcaaaactcaggccttctactggactgtactcagtttggtagctctcaacacgctgtgtgttgctattgttcactacaaccagcccgagtggctctccgacttcctttgtgagtatcacccagccccacccctgccaactccctgatccctccctcacaccctttttccacttctctttctctggtagtatgtgtatcttctttggtcctcattgaatctgccctttcctttagccatttctataactgtcactggggccaatgttactgttgctatgacaatggaacccatctcccttagacctgagagctggaagctggaattcagaccaacaaatgctcctgtgattcctttctaagagagagggacagaggggtgctggtgaaggggatgttggaagagagacagagaaagacggagctcataagatagacagatagaaacagaaacatacatgtattaataatttttatgtacatctctggaaatgttcataacttatggttaagagaggatgccttagaaataaggagtggcttatatgttgccctcattttctctacttatttctgactctacttctctcttctttcaaaccttctgcttctttcctgttaggttggtgcaaaattaattgcgttttttgccttttttttttttttttttaaccacagttacttttgcaccaacctaatacttcctcccctgccctttttggcttccttattcattcatagaacatcccctccagtatctgcgagagcgttttgctccctcaaggtacaaggcccactaaggctttgccctctgggcctattcccagattctatgtgagttagcatgagatagtatcaaaattgagggccaagtgagggtgaggaaaagcagcaaaagatggggagatgtctgagcaggatttaaaaagtaaagagctcgaggaatcaacaagagcagcgactggggccaggcatggtggctcacacctgtaatcccagcattttgggaggctgaggtgggtggatcacttgaggccaggagttcaagaccagcctggccaatatggtgaaaccctgtctttacaaaaaatacaaaaattagccagatgtgatggtgcacacctgtaatcccagctactcaggaggctgaggcactagaactgcttgaatccaggaggcagaggttgcagtgagccaagatcatgccactgcactccagcctgagcaacagagagagtgtctgtctcaaaaaataaagtaaaataaaataaaataaaataaagagtagtgattgggcagtgaggggggcaggtggatgccctggctttggctcacaggccccaagtaaggacttctcaaaacgtcttttgcctactggctgtctaatttattcactgaccttctgacctggttcagaattgacttaggacagcaagaagagacagtctagtctttgacctagaaaggcccgtgagcctagtccaggccattgtcttcttataaccctccttgttcccagtcacgttggctgaccccccaggacacccctcaggaaccagttctccttcccagggccctgacctagtttcaaacttagtaattgtttttagtccctctggagtctcttataaatgaggactctacttcgtgttttaacttcctctaatactctatttttaatctcctatattctctctactaatcatcttgtacagtctgtcctggttcaggaacaagggactgagacttcctgcctgggtcctcagtgtctataaaggtcctttactcattcccactttccctttgagaaaactgagacacagagaggttaagtagattgcccaggatcacacattagcttggcatgatggcgggcgcctgtaatcccagctacttgggaggctgaggcaggagaatcgcttgaacctgggaggcagaggttgcagtgagcccagatcatgccactgcactctagcctgggcaacagagctagacgccatctcaaaaaaaaaaaaaaaaaaaaaaagatacacattaatttcagagatgtcaaaatataaacaaaaatgtatatcttggcatcagtgaagtgtagttgtttctctggatctcagactccacatctatgtggtagaaaccggatttgatggtcctgaaagttcttccagatgcaacaatgctaaggataagtaattctttcaagtcttgtgcatcacctgctatcatgtttccatggtaactgaggaacaagatctcagaaactcttcagtcctcccagagttacttctggtgggtctaggaatgtgtcagatgttacaaacagacttcctctgctgatattttggtcctaggaaccctagagttcccctcagacactaagatctccttagcgtcctataaataaggagaaattttggtgataaatactgtgaaggactttgacggtcagttcaaaacacctcttaaaagcatgacatagcaaacacccttggcaaatatcttagttcatttgtactgctataacaaattacccgagactgggtaatttgataagaacagaaatttattttctcacagttctggaggctgggaagcccaagatcaaggcattggcaggtttccctgtctggcgaaagctactctctgcttccaagattgcaccttgaacactgtatcctctggaagggaggaacactgggtccttacatggcagaaggtggaggagcaagagggacaaacttcctctgtcaacctcttttataagggcacctaatcccattcatgagagctctaccgtaatgacttaatcacctcctgaaggccccacctcttaatactgttacattggcaattaagtttcaacgtgaattttggaggggacacaaacatttaaaccatcacaaccaccaaacacaattagctttgtggccttaattagctatatgaaattcatggaagttagtttcagtcctctgtctctttcctttctgtatgctttctgctcctcagaaaccctcctcatctctcctttctatccattaagtacccacgcccttcctaactcctcatcttcctaccctaccaagaaagccctctcagaaaaggatctgatgtcagccatttatttgctggagcaaatgcatatccatgttttacccctccctgaggcatttgcaattttatgcttgctcatcaaagaacaaaaggctttgtcttactcaagactttttaggtcactcacaacacaggatttctaggggacataagacaagttttctgagttaggagaaaagccataccttaggtgggttgcctgtgtcgctccaactaagtacttaacttcaggattacaaataggatatcattatgatttctatttccttttatcctttggagctcagtcacgtagaagtagattaaatataattgttagatcacagcaccctggcattatggggccgttatggtccattgttattatgtgaattattcagttaattagtttattttttaaatgtgataaacacccaggaacccaccagtcaacacaaaagtccttggcaataatctatatccgatccttctcatcgaaccagggcaaaaactacaagatggagacccactgatatttttctcattccttttaaaatcggcctaaggttggttagcttgttggttggagggtagggcataattgttgctttttttttttttttttttttttagacaaggtcttgctctgtcacccaggctacagtagggtggcccaatcttggctcactgcaacctccacctcccaggtttaagtgattctcatgcctcagcctcccaagtagctgggtttacaggcatgtgtcaccacactggctaatttttgtatttttagtagaggcggggtttgccatgttagccaggctggtctcaaactcctgacctcagttgatctgaccgcctaggcctcccaaagtgctgggattacagacgtgagccaccatgcccagccagctcttcctttttaacagaggggaaactgaggcccatgggaaggacaccttggacagggcgtggccacagtgggtcatgtatataatcccagcactttgggaggctgtgctgggaggatcacttgaggccaggagttcaagaccagccagggcaacatagtgagacccccatctccacataaaaattttaaaaagaaaaaagataagtcagaagttgggtgtggtgacacatgcctgtagttctagcatgttggaggccaaatcagggaaactgtttgaggccaggagtttgaaaccagcctaacagcatagcaagacctcatctctacaaaaaataaaaagtttaaaaatgataataaaaggaaagtcagagccacctggaacccctaccctcagcaagcctaacctcctctctgtttcctccttctcccttctagactatgcagaattcattttcttaggactctttatgtccgaaatgtttataaaaatgtacgggcttgggacgcggccttacttccactcttccttcaactgctttgactgtggggtaagtgctcttgtttctaagagttcatttctccagctcttgcctggaatgacagatacctggacacattaaagggagaaaggtaaagtcacccctgaatatgagagactcagatggatgcagaaggaatgagaaaacaatcccaaacactggcaaggatacagtgtacccagaaccctcaaccaccgccagtgggaggaaaacgtatagaccccctttggaaagctaagtgggggacataagacaagttttccaagttgggagaaaagccatgccttaggtgggttgcctgtgtcgctccaactaagtacccaacttcaggattacaaacaggacatcaatatgatttctatttcttcttttcctttgtagctcagtcatgtggaggtagatgaagtataattgttagattacaacaccctggcattatggagccattatggtcctttgttattttgtgaattactcagttaattaatttattttttaaatgtgattaacacccagtaacccactagtccacacaaaacctaagtcctggagaataatctacgtccaatccttctcatcgaaccagggcaaaaactacaagatggagatatgacccagcattccattgctaggaattcatcctagaaaatctcacccagatacctaggagacacaggccagaatgtccctgcagctggaagtgaaattaaggttgttcgcaaataagtggagaatgcctggcccagggcagccctaatcatttaccatagtcctgttggtctcagaaaggcttaataatttatttatttttttttattttttgtttttattttttgtttttgagatggagtctcgttctgtcacccaggctggagtgcggtggcgccatctcggctcactgcaagctccgcctcccaggttcactccattctcctgcctcagcctcccgagtagctgggactacaggtgcccgccatcatacctggctaattttttgtatttttagtagagatggggtttcaccgtgttagccaggatggtcttgatctcctgacctcgtgatccacccgccttggcctcccaaagtgctgggattacaggcgtgagccaccacacccagccagcttaataatttataataactgaatgttgtactgttttctgccattatagaaaattatgttgttggagaaaacaaaatacatacaaacaagcaaaccttccctacataaatgacccaagtagttaaagaataaaaccaatttctttccattaaaaagaaaagaaagccgggtgtgatgcctcatgcctatagcctcagctattcaggaggctgaggcagcagaattgcttgagcccaggagttgaaaaccagcccaggcaacatagcaagaccctgtctctacaaaaattaataataattagccaggtgtggtggtgcacacctgtagccccagctactcagaaggctaaggtgggaggattgcttgagcccagcagtttgaggctgcagtgagctatgatcacaccactgccctccagcctggacaagagagtgagaccccatctctaagaaataaaagtaggccaggcacagtggctcacacctataatcccagcactttgagaggcggaggcaggtggatcacctgaagtcaggagttcaagaccagcctggccaacatggcgaaaccccgtctatactaaaaaaatacaaaaattagccaggcgtcgtggcacatgcctgtaatcccagctacttgggaggctgaggaaggagaatcacttgaactggggaggcagaggttgcagtaagctgagattgcaccactgcactccagcctgggtgacagaatgagactccgtctcaaaaaaaaaaaaagaaaaattttaaaatgtcctgagcaaccttgtttgtaatagttccaagtctcaatatccgtgtatccctttgctgtagaacagataaatattttgtggcatatctatataatgaaatactctgtgacaatcaaagtccaccaacagcagccacatgcccaacaacaggaatgaatctcacccatgtaacatggcacagaaggaggcaggagctagcaacgtaagtccatacagttcatgcaaagttcaagtggacaaaattaaactctctctctctctctacatatatatatatatatatatatattttttttttttttttttttttttttttttttttttgagacagagtctcactctattgcccaggctggagtgcagtggcgcaatcttggctcactacaacctccacctcccgggttcaagccattctcccgcctcagcctcccaagtagctgggattagaggcatgcaccaccacccccggctaattttgtattttttgtagagaccgggattcagcaatttgcccaggctggtctcgaaatcctgatctcaggtgatccacctgccctggcctcccaaagtgctgggattacaagcgtgagccaccacgccccgccttaaactgtattttttaaggatgatacttgaatacgttaaaaaggcgaggaccttgaaaacacaacgctcggtaaaagaaaccaaacacaaaaggtcaagtattgcataattccatttgtatgaaatgtccagagcaggcaaatccatagagacagaaagtagattagtggttgctagggtctgggtgagggagagtggggagtaactgctcatggggacagggcctcctttgggggtgatgaaaatgttttggaacttgatagaggtgatagttgcagaatattgtgcatgtacctaaaggcactgaattgtgtaattcaaagtgtgaattttatgttatgtgaatttcacctcagttttttttaaggtaagaaaatggttattacaaaattcaggatggtagttatatcacagtgtctctggaaacttccagggtatccacatgtccctttttattttattttattttttattttatttgagatagggtcttgctctgttgcccaggctagagtgcagtggcaggatcatgaccctctcctgtctcaaattcctaggctcaagctatcctccctcctcagcctcctaagtagctgggactataggcacatgccaccatgcttgactaattttttttttttttgtaaagtcagggtttccctgtgttacccaggctggtcttgaactcctgggctcaagtgatctgcccacctcggcctcccaaagttccagaattacaggcatgagccactgccctagccttctcctaattgttgacataggtagtagttgcatgacattcactttgtaattatgtgtttcaggaattctcaggcctgtgggagctcttaataaataaaaaagaggccaggtgtggtggctcacgcctgtaatcccagcactttgggaggccgaggcaggcggatcacgaggtcaggagttcgagactagcctggccaacacagtgaaaccccgtctctactaaaaatacaaaaaattagccgggcgtggtggcgggtgcctgtaatcccagttacttgggaggctgaggcaggagaatcgcttgaacctgggaggcggaggttgcagtaagctgagatcgcgccactgcacaccagcctgggtgataagagcaagactccatctcaaaataaatgaataaataaaaataaataaataaataagaggccgggtgcagtggctcaatgctttggaaagtggaggccaacagttggagagaccaaagcaggaggatggcttcagcccagaagtttgaggccagcctgggcaatactagcgagacactatctctataaaaatgttttaaaattagccagatgtggtggggcacacctgtaatcccagctactcaagaggctgaggtgggaggatcacttaagcccaggaggacagtgctgcagtgagctatgattgcgccactgcactccagcctgggtgacacagtgagacccggtctctatagataaatgaatggatgaatgagggggtcaaggatcctcacccggcttccatttggagggaggagtttggttgagttcttgcaaggttggtacctaggaaatgcttgccagttctggagcccagacactgtccctggacatgagaccaggttctctgccctaggttatcattgggagcatcttcgaggtcatctgggctgtcataaaacctggcacatcctttggaatcagcgtgttacgagccctcaggttattgcgtattttcaaagtcacaaagtaagtctttggggttcctggacatttgtacagggggtggggatgggggacatggtggggccgcctccagaaagttgggaaagtgagcctcgtgtttcgagggctgactccggggccctgcctcccccgcctggcctgagtcctcgcctggcctctgtcggcaggtactgggcatctctcagaaacctggtcgtctctctcctcaactccatgaagtccatcatcagcctgttgtttctccttttcctgttcattgtcgtcttcgcccttttgggaatgcaactcttcggcggccagtaagtccttcacaggaattccaactcctggttccctggggtcaggctcagggaacacacagtcccctccaccgtgcaggctgccttcctcgtagcccagacacccattgcggtcacccaaatgggcagggccctgggtaccactcagggtttcctggggacagagatgatggagacgttcgtttccttggagatgagatactgagccacaccctcagagcaccccgggtggggccaacgtgaaatgtctgtgtcctccctgcaggtttaatttcgatgaagggactcctcccaccaacttcgatacttttccagcagcaataatgacggtgtttcaggtacagcctccacctggccccacgggccaacacctctcagtgtcacagatgaaagtgcctgctccacatccaaggggcttccctgaactcctccttctctacctggccttttcacaccactttgaaacacagattttatggttatcattattcaattatggtgaggccaacagatcaggagatgaatgtcattggaaagatagtttgtggctgggcacggtggctcacacccataatcccagcactttggccaggtacggtggctcacacctgtaatcccaacgctttgggaagcccaggtgggcggatcacttgagatcaggaattcgagaccagcctggccaacatggtgaaaccccatctctactaaaaatacaaaaattagccgggcgtggtagcacatgcctgtaatcccagctactcgggagatgaggcacaagaattgcttgaacctgggaggcagaggttgcagtgagccaagatcgcgccactgcactccagcctgggcaacagagtgagactccatctcaaaaaagaaaaagaaaaaaaaaaccactttgggaggtcaagatgggaggactacttgaggccaggagtttgagacaagtctgggcaacatagtgagactccgtctctgcaaaaaaataataataataattagctgggcatggtgatacatacctcctagctactagggcagctgaagtggaaggattgcttgagcccaggaggttgaggctgcagtaagctacaatcacaccactatactccagcctgggcgagagagcaaagccctgtctcaaaaacgaaaagaaagtttgttatactcacagatcctcagagaaggagcacaccatgcaggaccaagcagagaagcaacagggtcaagcaggaagagaaggaaaatgtgggcaagaggcttgattgtggtttccatgggacggaatgggtgaggcagagtaaacagctcgagactggctagtttggatcatttcagtgggctctggggcagaggagctgttcctacttgtctaggacctggccttggggtgattagggcaggtggatagtgctgggaagataaaggaggtggttgggatatgggctggttgggatattgtttggtttgcttttaaaaagcctgctcagggctaaattgtttactacctctagggactggctagtgctggaccgggcagtccctccagagtcagcaagaccccagatgcatcagaataaagaaaataaaatgcgtggccaggccaatgaggtggttcatgcctgtaatctcagcactttgggagaccaaggcgggaggattgcttgagcccaggagttcaaggctgccgtgagctccagcctgcaccacagagcaaggccctgtctcttaaaaaaaaggcagagaaaaaaaatggctaatacacccatcaaatctgaagataccttggtctcatattccagggtgatcaacccaaagcaacttctgcacccatgtgggcgcattccctgaggcttgggactggcccagccgggaccttcagagcatctttggtggattctttctctttgagggactgagagtgtatagaaaatgtgacttcactctctccttctcctggggaggtagtttctaaatgagaccccaagacagggagttgaagaggaaaccttccatgaagggaagttctgagcccccacataagcgattttttttttttttttgagatggagtctcgctctgttgcccaggctggagtgcgacggcacgttcttggctcactacaacctctgcctcctgggttcaagcgattctcctgcctcagcctcccgagtagctgagactacaggtgcatactaccatgcctggctaatttttgtatttttagtagagacagggtttcactatgttggccaggctggtctcgaactcctggcctcgtgatctgcctgcctcggcctcccaaagtgctgggattacaggcatgagccaccacacctggcccataagcgattattaatagcactgatcgctagtcatgtatctttagctcagaggttctcacccaaggacaagtctgtcctccaaggacatgtagcaatgtctgcaagcattgttggttgtcacagctagggagagggtgctactggcatctggtgggtggagactaggaatgctgctcaatatcctacaatgcacaggacagccccaaatagaataatctggccccaaatatcagcagtgctgaggcttagaaaccctgttttagcagattcatgtttttggagttctttaacatttactttatcctcatggggatatggatagaaggaaggaagttggatcttttttaaaggagcatgtaggtgctgtttgaatatccccttggttctttcagtatgcatcagcacaacttgcgtctgtcaacacctaatcctttgccttggtctttctctggtcccctgctctgcccccaaggaactgcagtccagcagtactgtgaattttttgtgccacaccttaaaaggagcagccgttggtggataaataccccagctccctcaccctcaggtgggatgacccctagagctccccagcaagaccaagccccggttacctacagtggaaactcgcttgatcacatactgtttacgttccaccctcttttcccttttctcacttctcctctcccctactggtgcttcctgagatcacctcccagacaaaccacttgcacccgaacccttgttccagggtctgcctcaggcagggggaccccaaacgtgtccttgtgctacatttgtgctatccacgtagtagcttgtttaatcatcaccatgaccacatgaggaacacaggtaaatattaaaatcctgtcttagtctgctcaggcagccataacaaaataccacacactgggtggcttatacaggaaacatttattctctcatagttctggaggccgggaagtccaagatcaaagtgttagcagggttagttagttcctggtgagggccctcttcctagcttgcagatagccaccttcttgctgtgtcctcatatgtcaaagagagagagagagagttgtgatgtttcttcctgttctttttttttttttttttttgagacaaaaatctcaaaaaaaaatctattttttttttaggcaaatcacatttttttgtcacccagcctggagtgcagtggcacaatcatagctcactgcagcctcaaactcctaggttcaaacgatcctcccacctcagccccttgagtagctgggactacagatgggcaccagctaatttttttaaattttttgtaaagatggggtcttgctatattgcccaggctaatcttgaactcctgggctcaagtgatcctcccaccttggcctcccaaagtgctgggattacaggcatgagccatggcatgcggtctcttcctgttcttataagggcactaataccatcatgaagtcccccatgacctcatctaaccctagttacctcttaaaggccccatctccaaataccatcccatcataggttagggcttcaactcatgaatttggaggcgggcacaatttagtccataacaaatccccttaatcacatcaagtaagacagagttacaggagggtctgtgactcctccagggtcccattttcctagaagccaggctaagagccccacgacgcaggaacggccctttctactcgcaaacaaagagaaaagccaaggagaagccaacacggagtctggctctgcaaaccgggcaggattgttaaagacctcctgggctcggggatggggtgggcggattccggctccacagctgcatctccaaggggcccgtggctgagaggggggttggctgtgtgtttcttcctcccctttcagatcctgacgggcgaagactggaacgaggtcatgtacgacgggatcaagtctcaggggggcgtgcagggcggcatggtgttctccatctatttcattgtactgacgctctttgggaactgtatccttcatggagagagagaaggggacaggcctggacctctggcagaggagaggttgcaggggctcaagggagggtactgagagacccagatacccagggcccaagtggtgtcccaccagtggttgcttttcctgactcagacatttgcagacaccctcctgaatgtgttcttggccatcgctgtggacaatctggccaacgcccaggagctcaccaaggtggaggcggtgggagaatgtttctctggcaaagttaccacctgcccatggcagatcaggacgggggtgggggtgggggtgggggtgggggtgggggcatgggaacagggttagaacttttgccggggatgcaccatgcaaagagaaggcgcctctccccccactcccagaaacagactgtccctcatcaagcaaattctacagccaagagggtgggaagggggaaggcagtgaggtcgctgcaggaaacggatggcaaactcaaccaaaaggccgtttacagggagtaagcagggtttccaaggaatggtgtagcccccaggctagtggatgggagagggagtgctgttatggggacccagtcagagctggggccaaggaaaaagggctgccaccagccctgggaccttagagaacccagaaccatggcaaggcacagatggagtggccaataaatgtccccaccttctctcttcctctggcttcccgctggagcctccccttagccaaacgcagcatgttaagagctagcctccgtccagcctaagcctctccccaaggaccctattaagttaagattacatgtaacaggtacagggtcttcctctcagccctggggtctccctcagcattgcagccccacctccagtgcctcgaggtattcaggacatgtttgtgaaattgaaccaaaccaagcagacgttgccaacgctccatctgccggccctggcaggagggagagagagtttcccggccccagctcccagtggagggaagcggaagtctctgccatcccaagcacacggccacaagcctggccactgtggagctggctggcatggctgagccgagggctgatccagccatgagctcatccaagttccaagagtccatccttaggggctggtgcaggagggtagcagaaggggagggagaaaggccagttcgtttatctcctgggaggtgtggacattcctctccagatccacattctttctttcattgatcctacaagcatttcttggtcatttaatacgtgtttttaatcctattcagtcctcatggaaaccttaggagccaagttctctgagccccattttacagatttcatcattcagtaagcacttaatgagcacctactgtgtgaccaaggccctggtctaggacttagggattaagcagtgaacaaaaaaaggcaaaaatccctgcctccgtggagcagggattcaagaggggagacagacaagaaacaagataaatttgtaaacatacgtagcttgtcagttggtgataaacacaacagagaaaaattcagtagggaaagtcagggagagttggaattttagatgagatgtgtgtcgcacagagaggttgagagacttgcccaaggccacacagcagtaagttgtggagctgggatttgaacccaggccgtctgggtctgcagcttgtgctcttaactgctgtgtaccagttgcttgaatttgggcatgttttatgctcacttgggaacctgtgggaaatgcagattccagggcccagcactggttctatagattatttggggagcctgaggatctgcattttaggtgtttctgaggcagatggtccagagacctagctctgaaaaatgctgggaatggtgccaggaggggtgggggtggccctatgagagcagggtggccagccagatcccatctccatgttgtctctgacagtgtcctgatctgaccatttccaaggtggtaaggttgctccccgttccagtgattcggagcacagcgggagagctgcctgcaatggcatgacttttcttatgggcgggttcatttctggccatttctttctcgttgccttttctttgctttttctttgttggcttttctgttttacgaatgaggccctgcatgaaggctgaagaaggatttaaagtccaaaaacgtctttttctgtatgtatttttaaaacctcttcccccattctcctcctctctgaacctaaccaccagtgagcagcagcaccctgggcagttggctgtagcccaagtgccctgctctcctctccccaccgccttcctgtcatgggggctgggaatataaattcctctcctcattctccttctgggggctgttgacagtgcatggcaggggccatcggatgccaggctcttctgtgtgtgagggtagttggtgttttttgaaagttggttcagagagttcacatggctcagaaagcctagtgagaggaaaatctttgcactgctttccagctcattaagacaggatgcaggggccaggcatggtggcacatgcctggaatcccagcactttgggaggccgaaatgggaggatcatttgaggccagaagttcaagaccagcctgggcaacatagtgagaccctgtctctacaaaaaaaaaaaaaaaattaaatgtatacaggcatagtggcatgcacctgtagtcccagttgcttgggaggctgaggtgggaggattgcttgagcccaggagttcaaggttacagtgagctatgattgtgccactgcactccaggctgggcaaccaagggagactctgtctctgaaaacaaacaaaagaaaaaaaaataggctgcaggaaagtcttcattgtaggaagagaagggacatttttattttttgttatctggctgtgtgttaaaataggcttcataatgagttagatgtcaaacttatacacagaggggatagcaatacacttaaccaatagcaggtacccattccaattggggagccttggttctgattggtcgaaatatttcaaatgttgcccctggtcagcaacagggtcagaagtgagtccccaaggcctagttcatgttttgtgaacaaagattccacgtgccttttaggacgagcaagaggaagaagaagcagcgaaccagaaacttgccctacagaaagccaaggaggtggcagaagtgagtcctctgtccgcggccaacatgtctatagctgtgtaagtgcccctaatccctgggatgctaccctggctcctgaacgtccacactatcccaggcacagatttgggaagcagtgggggtggtccttgacagaactgagctttaggaagagacacttcttgtccttccacccactttcactcaataaatatttggttagcagctgttatgtacccagcactgttctaacttctggggatacagcattaacaaggaggaaaaaaaaaatcccacctgtgtgtagccattctagcaagggaaggagtcaataaattagataaataagtaaattatatattgtgttagaaggcgatggaactacagagaaagtaggggagggaaatagcaaatgctgggagtgaagagagttgtgattttaaacgaagttgtcagggaaggcatcacctagaataggggtccccagtcccggggctgtggactggtaccaggccgaggcctattaggaacggggctgcacagcaggaggtgaacagtgagcaagcaagcattaccgcctgagctccacctgccgtcagatcagcaggcagcattagattctcataggaacacaaacactattgtgaacggtgcatctgagggatctaggttgcgtgctccttttaagaatcgaatgcctgatgatctcaggtgaaacagtttcatcccaaaaccaccccccacacctaggtctgtggaaaaactgtcttccacaaaactggcccctggtgccaaaaaggttggggactgctcacctagaaggttacatggcctgaaggaggtgagggaggagccactggggggcctggggaagggcatcccaggcagagggaacagcataggcaatggccctgaggcaggaacatgcctgatgtgaaggaggcctgtgtgactagaatcgaatagtaagtgtgaggaggtgaaggcaaggaggtgacaagcagattacacagggccttctgggtcaggggggaggacttgggcttttgcccctagccaggtgggagccatggagggttcttgagcagaggaggctgggacctgactcagatgctcacagactcctagcattcagtggggagtagagggtggagagcaggagtgggaggctgagatgtgggttggttcgcctgggtcatccatccaagctacagtgcctagcaatgctctaagtcctgtgaccatgccactgcaggaaagagcaacagaagaatcaaaagccagccaagtccgtgtgggagcagcggaccagtgagatgcgaaagcagaacttgctggccagccgggaggccctgtataacgaaatggacccggacgagcgctggaaggctgcctacacgcggcacctgcggccagacatgaagacgcacttggaccggccgctggtggtggacccgcaggagaaccgcaacaacaacaccaacaagagccgggcggccgagcccaccgtggaccagcgcctcggccagcagcgcgccgaggacttcctcaggaaacaggcccgctaccacgatcgggcccgggaccccagcggctcggcgggcctggacgcacggaggccctgggcgggaagccaggaggccgagctgagccgggagggaccctacggccgcgagtcggaccaccacgcccgggagggcagcctggagcaacccgggttctgggagggcgaggccgagcgaggcaaggccggggacccccaccggaggcacgtgcaccggcaggggggcagcagggagagccgcagcgggtccccgcgcacgggcgcggacggggagcatcgacgtcatcgcgcgcaccgcaggcccggggaggagggtccggaggacaaggcggagcggagggcgcggcaccgcgagggcagccggccggcccggggcggcgagggcgagggcgagggccccgacgggggcgagcgcaggagaaggcaccggcatggcgctccagccacgtacgagggggacgcgcggagggaggacaaggagcggaggcatcggaggaggaagtaagtggaggtgacctcgaatccgcagaatgacggtaacattaataatgacaacagccaaagtagcacgtgctgtgtatttgtttataaaaatatattataaaatgctgtatttggccaggcgcagtggctcacgcctgtaatcccagcactttgggaggccgaggcggatggatcacgaggtcaggagttcaagaccagcctggccaagatggtgaaaccccacctctaataaaaatacaaaaattagccgggcacggtggcaggcgcctgtagccccagctactcaggaggctgaggcaggagaatcgcctgaaaacagggggcggaggttgcaatgagccgagatcacaccaccgcactccagcctgggcgacagagtgagactctgtctcaaaaaaaaaaaaaaagtgctgtatttggccaggagcagtggctcatgcctgtaatcccagcactttgagaggccgaggcgggcggatcacttgaggtcaggagttggagaacaggctggccaacatagtgaaaccccgtctctactaaaaatacaaaaattagtggtggtgcccacctgtattcccactactcaggaggctgaggcgggagaatcagttgaacctgggaggtggaggtaggttgcagtgagctgagatcgtgccatcacactccagcctgggcaacagagcaagactctgtctcaaaaaaaaaaaaatgctgtatgtttttgtttttttgacacagggtctcgcctgttgcccaggctggagtgcagtggcagtcatagctcagtgcagcctctacctcccgggctcaagccatccgcctcagcctcacaagtagctgggaccacagacatgtgccacatgcctggctaatttttgtagagacagtgttttgtagagacagggtttcactgtgtttcccaggctggtctcaaactcctgaactcaagcattccgcctgccttagcctccctaaagtgctgggactacagggttgagccaccacactcagcctaatttttttacctttagtagaaatgaggcctggctctgttgcccaggctggtccccaactcctggcctcaagcaatcatcccacctcagtctcccaaagtgttcggattagaggcttcacagatggggaaactgagagattgagtgagctcctcaaggtcattcctctaaccagtgtccttgaacccaggctctctggcaccagaggccttgagcatttcagggaaactattaagagaagccccactgtcgtccagaattatatagtcttctgtgttcttgctgtgtgacttttgcaaagtgacttcatatctctgggcctcacacaatggaaatagtgggatctaattgggtcattgccaggattgaatgaggtaatgtatgcaaagggcctggaagagcagctgacacataataagtgctcggtaaatttagagcatttttggccattttcagccaactctatttacctaatgctattctttggaagtttgaaaagccactctgttgggaggccaaggtgggaggatcacttgataccaggagttggagaccagtctgggcaatagaggcagaccccatctctataaaatataaaaaattaaacagatgtggtggcatgcacctgcagtcccaactacttgggaggctgaggcaggagggtcactggagcccaggatgtctaggctatgatgagctatgattgcaccactgcacttcagcctgggcgacagagcaaggctttgtctcaaaaaataaaataaaaaataaagaaaaagaaaaggcactttgggccgttagaattgaagggagagcagagtttcaaagctttggatgcagcgggatgtggtggctcatgcctgtagtcccagcactttgggaggccaaggtgggaggatccacttgagccccggagttcaagaccagcctgcgcaacatagtgagacctcaccttttaaaaataaataaaaatgttagaaagcttttgaggcatcttccaggccagcaacttatccattcagaaccagcatcctctttttcataacgacattttgtaatactttctagcagatgctatagtgattctgcatatagggactcaacaacttacccattaaaatagacatcgtagacattgtcctattacaaattaacctgctcttagtcctcttttatattaccatcagggcataatattgatttttttaatgatgggtttaagtgatcctgttgtatgacatatgaggtaggccagcacttctcaaaatctaatgtgtatgtgaatccccagggatcttgttaaaacacaaattgtaattccgtagggctaaggactcagtggagcctgagattctgcatttgcaacgagctcccagatgaggctgatactactggtccagggaccacattttgagtaatgagactctggaggacatagtgaagtaattctgatatgtacaccatacacaaaatcaccatgaagtgacaggcacaaatgatggctaactctgggttgtgtggacaattcaaaccacatgaggggagttgccagcagtgtcaagatgttccacaatgttgaacacctcttggcaaagttccatatacaaaagagtctagtctttcttccatttatttaatagttgcattgcaggaaaatgcaatgtatattaaaaacatacaaaaaatatgttgtgttcttatgtaaaagagttaggtttaaactaaaagcacaggatcaggtgcagtggctcccacctgtaatcccagtgcattgggaggctgaggaaggagaatcgcttgaggccaggagttcgagaccaacctgggcgacataaggagacctcgatctctacaaaagaagttttttaattagccaggtgtggcggcaggtgcctgtagttctagctacttggaaggctgaagcaggaggattgcttgagcccaggagttcaagattacagtgagctatgattatgccattgcattccaacctgggcaacagaacaagtccttgtctcaaaaaaaaaaaaaagaaagaaagaaagaaaaaacccaaacaaacaagcaaactaaaagcacaggtaattacaagcaagatttttcacctctttgagggacattagaaagtcatgaagaggaaaagataagtctttcccatatgggactgtcatgtacatggtagggtatttagtataactgcctaccattctctaagtgcctgcagtgcccctcaatcattatgttattaggtttccacgtagttctacaacagttttctgaaaaccattgttctaggtcattctttcgcttcaatcttctcctatgggtttatgcattcattcagttagtatttactaagtgcctactatattctaagctcatgctgtgagttcagtcacacaactgcaagtgaagtggtctgagacattctgagaaatacgaccaagaaactgctcccagggtctcagggcaggtttccagaggagcaatctgagaagggagtagagtgtttcagtctaacaacagcatgtgcaaaggccctggggtggaccagaaggaggccagtttgcaggacatgactagtgacgagaaagtgacaaagaaattgaaggtgcattgatgagactctggggctgtcagtcactcaggggaatgagagatcaaaacgggagtttaggtggaataaagtgtttaccacagcactctctgtatagtaaagaccaatgaagagccaggtacaggccagtgtgatggttcacgcctgtaatcccagcactttgggaggcagagacaggtggatcacctgaggtcaggggttcagaaccagcttggccaacatggcaaaaccctgtctctactaaaaatacaaaaaattagccaggcgtggtggtggacgcctataatcccagctactcaggaggctgaggcacaagaattgtcctgcgaggcagaggttacagtgagctgagatcacaccactgcactccagcctgggcaacagaacaagactctgtctcaaaaaaaaaaaaaaaaaaaaaaagccaggtacagtggtatgcacctgtaatcccagctactcaggaggctgaggcaaaggattgcttgagcccaggagttcgagaccagcctgagcatttagagaatgggaggccagtatactaaataccctaccatgtacaagacagtctcatatggaaaagaattatcctttcctcttcatgactttctagtgctcctcacacaggtgaaaaatcttgcttataattatctgtgcctttagtttgttggtttatttagggttttgtttgttttttttttttttttgaggcagggtcttgctctgttgcccaggttggattgcagtagcattgctcattttagagatgagcaagacctcatgtctaaaaaaaaaagaaagaccaatgattattaattactcttgctattattactaatattactgttattatcagccttattaacagatctactgttattgaaggaggcagagtgacagggacaaaatgtctctccctaacaatatgccaggaagagtttttgaaagacaacagtaaacattggaaactacaagagcagcaaagcctggttgtgaaaggcaaggactttggggcaggcagtcacattcctgccctatcacttccaggctgtgtgactttcagaatttcactcctctctgggcctccatttcctcatctataaaatgaagataagaatagtagctacctccttctctgggtataagatttaactgagccgggcgcggtggctcatgcctgtaatcccagcactttgggaggccgaggtgagcggatcacaaggtcatgagttcaagaccatcctggctaatatggtgaaaccccatctctactaaaaataccaaaaaaaaaaaaaattagccgggcgtaggtggtgcacgcctgtagtcccagctactcgggaggctgaggtaggagaatggtgtaaaacccgggaggcggagcttgcagtgagccgagatcgcaccactgcactccagccggggagacagagcgagactccatctcaaaaaaaaaaaaaaaaaaaaaaaagatttaactgagttagtacgtgtaaaatgctttgagtggttcctggcttataccaagagctcaataaatgttagcaattttttgtagcattttggggtctcactatgttgcccaggctggtgtcaaactcctggcctcaagaaattctcccactttggcctcccaaagtgctggatttacagacatgagacaccatgcctggccatgttagctattattaatatgaatattattaagtactcaatgaatgctatttttagcagtaatagtaagcactcaggaagtgtcagctaatactgttagtaatactctcatcaataaacataaaaagcaataaggacccagcttgcccaaatcccacagatggttcctgctccctctcttcttcagaggaagaaactatctccccactttcacccccatagcctcagctggccagacccccattctgaaccaggggagtactgctaattccattattaatagacacatcaaacaatctggccgggagagacattattcatttggctgataaagaggttctaaggctctttggaaataaaagttcatgaagattcatgcactttaagagaaaaaaattcaagatcagtcattcatctgctttaaaaaaagtggcaaagataaaactttatttgagaatataaaataataaaaagacattttcgttctctgttgtgacaaagccagtggccttcggaggtctgccttgtacatttttcctcttcttcagtcattccttgaggctttttgcaaacgtaccctgtgtttttcattctccagcatattgataattttttttttttgagacatggtctcgctttgtcatccaggccccggagtacagtggtacaatcatggctcactgcagccttgacttcctgagctcaggtgattctcccacctcagcctcccgagcagctgggactacaggtgtgcatgaccatgcctagctaatcttttgtattttttgtagacacagggttttgccacattgccaaggctggtctccaactcctgggttcaagcgatcctcccacctcagcctcccaaagtgctgggattacaggagcgagctaccttgccaggccgatcatatttttttcctttttattcactttgtcttctcctcattcctaccttcatctgtctttcagtggctcactccagtgaaaagtggactgacgcacattctatttcatataattcaatggctgctggccccagatcccccataccaggtggccgagcccagtggccctgcagggtggacaaaatgagggtggaactttcccagactgtcagtaaaaatctatggaggacagagcttctgcctctcccttgcaaccaggcagtgccttctcccaggcctatctgcttgcaaagggaacttttgccaagacctgctccactctagaattcttatctctgctgttcgcatcctaattccacctgcatctgtcaccatgacaacctgctccccaaaaggaacaggaagagagatgctggacttttgagctccacagtttatcctgcatgggggtagggagtggttaattacttagcactctaattcttacggtacccccaatgggcccaagttggtttttttaaaaaaaaacagtcttgctctgttacccaggctggagtgcagtggcacaatcatagctcactgtagcctcaaactcctggactcaaatgatcttcccacctcagcctcccaagtaactggaacaacagtctcgtgcaactacgcccagctaattttttttttttttttttttttttagagatggggtctcactatgttccccagactgatctcaaactcctgggctcaagcgatcttccttcctcagcctcccaaagtgctaggattacaggcgtaagccactgtaccaagctgccccattaaagctttgaacaccagagagcccagctcagctgttttccagctgggtaactctgggtaactttgcctctctgaacctcagtctcctcctgtgtgaaatggggctgatcactatacccatctcggatggtggtagttgcagggattaaatgagttaatacgtgaggtccttaggacagggggtggggacacgagataagcaataaacaggaactgctgttattatcacccccacataatccgatctcagggtctgagtgtgccccaggcaaggtgtccacagccctctgcagaaggatgcccaagtgatcagctggcacaagaacgccacgcacagcaggtgttatgcaactggccacctattccaggcagaggatgccagatccccagggagaagggggtaggggtgcagcttcaaagttttctgccccttttgagttctccttggagacactttggaaatgaaacctcccggaaattgatattaggcctctgcaggctgagcttgttaaaatttcccaacaaacagagccaacagacgctctacaaggaagcaaaaacaagacaaaacacattggcagacccttttccatctgctcttggtagatggtattcctctaagaaaatgccgccacgagtttctccatggcttcttgagctggtggccaaaggatttaggttctctttgaaattataacttaactgggcctgctttatggcagggatatcactctctgaaatgtgtatatatatgtgtatgtatatatatacacatatatacacatatacatacacagggccaggcgtggtggctcacacctgtaatcccagcactttgggcggccaaggcaggtggatctcttgagccccaggagttcaataccagcctgaacaacatagtgagaccctgtctctacaaaaattaataaaaataaccaggcatggcagtgtgtgcctgcaatcccagctacccagggtgggaagatcgcttgagcccaggagttaaaagttgcagtgagctatggtcataccactgcacttcagcctgggcaacagagcaagaccctgtctcttaaaaatatattattattattatacacacacagacacacacagacacacacacacattacagatgatgagaaaatactctcagccaggttttcatgatacacaacttctcaaaaagcatcacaagcaggttagaattagggatttctttgtggactgtccaagatgttgaggaaatattggtttagaatttacctcatttaggccagaaatggtggctcacgcctgtaatcctaacactttgggaggccaaggccaatggatctcttgaagccaggagttttagcctggccaacatggcaaaatcctgtctctactaaaactacagaaaaaaaaaaaaaaattagccgggtgtggtggcacaggcctgtagtcccagctactctggaggctgaggcaggagaatcacttgaacctgggaggcagaggttgcagtgagccgagatcgtgcattacacttcagcctgggtgacagagcaagactccatctcaaaaaataagatagataagataaatatatataatatatatgttatatatataatatagaaactacagaacaagtgatctttgtatgtttccagaatataacagcgggacaggcataggatagacgttcccattgcaaaagggagaaattggaagggataaagaggtcaccagtcctaagcaagtgctaaatccagcaagacaaatcccattaggtttcaaggcctgagaataatcctcggtgactctcagctcattaacatacttagttctcagagccagactcaatgaggttacggcccgcatgttatgggtcaggaactgaggctaagtaactcactggagattatgtggtaaagaaggtccaggatcattgcttcagtctccaggatatggggaaggttctactcctgttatcccaaattttaaaatgtgggaactaaggctcagagaggttaagcaaatcacacagggttgcacagctagtgatgttgctgagatttccctgtgtgtagtggctcatgcctataatcccagcattttgggaggctgaggcaagagggtcgcttgatcccaggagtttgagaccagcctgggcaatatagtgagacctcatctctacaaaaagaaaaattaaaaagttagccaggcgtggtggcaggcacctgaagtcccagctactgggaaggctgaggtgggaggattgcctgagcctgggaggtggcgattacagtgagctgagatcgcgccactgcactacaacctgggcgacagagtgagaccctgtctcaaaaaaaaaaaaaaaaaaagacattgccgagattcaaacccaggtcagcctgtcttctgaaatgtccctctatgacccactcacaaaactgagaaggcagaaagttgcttggacctgtctatttcccctgtgcagtctcagagaaacagtggaactgcctcggtttctccttccgggaagtattcatagaagcatcccacttacctactttggtctgaaaataaattagcttgtctctcttccacttactaaaaacaccgtgggtttttgcaagttaaaatgcaaaaataaaatgaggagaatggtgctggtagtttagccagtgggaagccctctggggaaagccagccttttatttattacttatttatttatttattctttctagatagatttatgggaaaccagggctgtgttgtccaggggtctgtagtccagaaggcatcagatgggctactaagtgagtctttgtccacctgtagatggcaagaggcagggcccaggtgtccatggcttggagaggcaggggttgatgggaggtttgaggctgtgggatctctcctggggcctcagtatcctcatctggataatggggacattctggccaggcacggtggctctatatatccagcacttagggaggcctataatcccagcactttgggaggctgaggtgggtggatcactgtaggccacgagttcaagcagcctgggcaacatggcgaagccctgtctctactgaaaatagaaaaactagctgggtattgtggtgcacgctggtaatcccagctattcgggaggctgaggcacgaggatcacttgaatccacgaggcagaggttgcagtgagccaagatcctgccactgcactccagcctgggcaacagagtgaggctctgtctcagttaaaaaaaaaaagaaaaaagaaaaagaaagaaagaaaaagaaaatgggggtattcatttatcatttgacagtaagtttacccagcattgactgtgtgagaggccctgtactaggcagtgaaaactcagctaagaataagaaagttaaaaacaagctgggcattgtggtttacgcctgtaatcccaacattttaggaggccgaggaggaagaatcacttgaggccaggagtttgagaccaccctgggcaacatagtgagacgccagtctctacaaaaaattgtaaaattagccagacatggtggcgtgagcctgtagcctcagctacctggaggctgagatgggaggatcactggagcccagaagttcaaggctgcagtaagctatgatcctgccactgctctccagcctgggcaacagagtaagaccctgtctgaaaaaaaaaaaaaaaaagaggccaggtgcagtggctcacacctgtaatctcagcactttgggaggctgaggtgggtggatcacttgaggtcaggaattcgagaccagcctggccaaaatggtgaaaccccatctctactgaaatacaaaaaattagccggtcgtagtggtgggcacctgtaatcccagctactcaggaggctgaggcaagagaatcgcttgaacctgggagccagaggttgcagtgagccgagatcacgccactgtacgacagagcaagaaaaaagaaagaaagaaagaaaagaaataagatgatggggagttgtggaaacctgtccatgggcacgtgaaggtcttgacctctgaccaagaagtgaacaggctcctctcaattccaggcactgcagggatctgggacatgacttctccatgaccaaactgtaccctttccttttcttttttgtttttttggtgacagggtctcactctgtcacccagactggagtgcagtggggcgatcacggctcactgcagcctcaacctcccaggctcaagcaatcctcccacttcggcctcccaagtagctagaactacaggcacacagcgccacgcccgtcaatttacacattttttgtagaaatagggtctcactatgttgcccaagctggtcttgaactcctggccttaagcaatcctcctgcctccgcttcccaaagtgctgggattacaggcgtgagccactgcgcccagcccaaattgtactcttgaaagatggaatcttagctaggatcctgaactgttgccttttatcctaaatcagttgttggttctttttcattcacttgccttcctcagagagaaccagggctccggggtccctgtgtcgggccccaacctgtcaaccacccggccaatccagcaggacctgggccgccaagacccacccctggcagaggatattgacaacatgaagaacaacaagctggccaccgcggagtcggccgctccccacggcagccttggccacgccggcctgccccagagcccagccaagatgggaaacagcaccgaccccggccccatgctggccatccctgccatggccaccaacccccagaacgccgccagccgccggacgcccaacaacccggggaacccatccaatcccggcccccccaagacccccgagaatagccttatcgtcaccaaccccagcggcacccagaccaattcagctaagactgccaggaaacccgaccacaccacagtggacatccccccagcctgcccaccccccctcaaccacaccgtcgtacaaggtgagaccctctgctctcacatcactgggcaggggacctggcgtccctggagccagaggctctgctgagtgaccctggactgtgaccccatctctctggcctcagtctcctcccctggaaaatgggcataggcgtagtttcctaccccacagggctgtggagggttcagtgagataatttgtgcacagtgcctggcacggggttgtgttcagtcgggttagcaatatcttctacgtccttccttcccaaggggagccaggaagccaccccatttgaggagcaatagggtcctctgatggaagcttgagggggtcagatgattgattctctcggcccagcactgtccaaaagaaatgtaacacaggccacatgcaaatgtcagtttaaactctctagtcgccacattaaaaaaggggccagatgtactggctcatgcctgtaatcccagtacttcaggaggccgaggtagagtgagccaagatggcacctctgtactgcagcctgggtgacaaagcgagactgtctcaaaaaaaaaaaaaaaaaaaaaaaatggtgaactgctgggtggattatgtcttaagttcatctagtgtcagttctatgtgagagattttcatgagtttgctggataaaggctttccatggtcctgagacctaagatcctaaggtcttgtcactgtgcccattttatagatgtagggactgaggctcagagaggctcagcctgcccgtgggcacataagcaggctgggctgcagaatggaagctccagaggctgatggctcctccccctgagtcaagagaggggtgctaatgggggcatgccatgcagtttatgggaggtctcagtatttctatctgttcagtgggtctcttggcactctccctacctgcctgcaagtgagggtgtgaaggtccaacgaggataggggcaggtctgtgttaatatcccatgagggccccaccgcactcaaggctatagagtggttgagagcaggctctcgggggccaggccgcctgggttccaaatgccagctctgccacttcctgctgtgtgaccttagacaagtcactttacttctctgtgcctcaatttcctcatctgtaaacaggagatcagaatatatcaacctcagggctatacaagggttcagtgatgtcataagatgcctggtatatacagcaggcactttagaaatgtcagccgcttcttgcctgccctgggagtacacaggagttcccagagacttgtgggaaattgtggagggagccctgtgttggttcttgtcccaacagtgaacaaaaacgccaacccagacccactgccaaaaaaagaggaagagaagaaggaggaggaggaagacgaccgtggggaagacggccctaagccaatgcctccctatagctccatgttcatcctgtccacgaccaacccgtgagtatggcccccagcaagggcagggggggcctggggctcccaccagggtggcggaagtcaggccagatagagggcaatgagtgagtgttgaccaccatgagtccagggatacctttgaacaagttgaaaatggatgctccttccgtaagtcaggtaagatgatttgtcacaatatactttgttggaagagacccctgtcctgccatccactagaaaatcattgttatttatgacaataaataaacaaatttgtcataaataaacaaataaatttgtcctaaacaacaaataaatttgtcataaataaacaaatcttcactgtgatgtaagaggcacccccttagaaatggctgccttgtgcagtacacagcctgaacaactgcacgtggcagccctaggacctgaactctgtttctaacctagactctgtaagggtttagattctgggcggatagtgtctgagttccatggccttctgtcttgggcatctttgaaatggatagactatttaggggagaaatttatcccatgaatgtcgtagtggctcggaggttgttttagaattgaatgtctcccagggatatttcttgaaagcctgaccgctcaaaatgcttcttgacaatgaaggatcatgtcagataagatgggggagaagctgctttctataatctgcctcttggcaactcaccctgggtagtaataaataaaagtacctttaaagtacttttttatttagttgacttatcgattttactaaggaaacacttatgtggtatctactcagtgccaggcactgttctgagtgccttaaaattttttttaatttctctgaggttgttactatgcttagctccatttgacagatgaaaaaactgaggtccagagacgtgaattcacctgcccaaggtcacacagcaagccagtgggagagctggagtttgagcccagacactggctctagcctccttgttcttaaccactcagctctgctgccattcacacaaccttatgaactatttattattggctccacttattaagaggttaactggcacatcccattggcacattcaaggctctgataaggcctgcaattcataatttcaataactaactttttggagcccctatcatgagccaggcataaattaagtcttgggtctcatgattttgtgaagtaagcactagtattacggctattttacagatgagggcaccaaggcacagaggggacaagtaacttgcccaaggtcacacagctaatttttaaaaagaaagaaagaaatctacttaacccatagattcacaatattgtttggccctgggacatttaatatcgaaaagcctttttatctcctacagaattaaggaccgtatttcttcaacctagcttggggatcaagatacttcaagagggtcgtttgggagtgataggaactttgctaaacagggcatgtgaatgtcttctctcaccgaggtcccctctgccttcttggggttccaggacccagagagggcccccacctggaggagtttaatagtttgttgtgtaggaggccttgggggttggagatctcagtagtggtaggtaacatgagattatggaagaaaagggtttgtgagcctgtggtctgagtggacctctgcacgcccatctgtctccaacagccttcgccgcctgtgccattacatcctgaacctgcgctactttgagatgtgcatcctcatggtcattgccatgagcagcatcgccctggccgccgaggaccctgtgcagcccaacgcacctcggaacaacgtgagtcccacagagcacaccccttcctagcctggctgctctgcctcaggccactttctcctgcatccaaaatgctcataggtagggtgggatgttggggtcacccctaggcatagcccttatggctgctggttgagaggggaagctctgattccttggggatgctcttgggagcaagacattccttgaggcagtttctctgtgagcctggtggggtggaggtggcccagagtgactggggctgaaaattgctggattctctaatggaggcgtgagactagcaggatatggatgttgcacattctctacatggaataggggggttactggggcaggggcggtgctcagaggtggtcccctccgcagtagacatttccctttgtacacgaagctttgaaagaaacaactatttggctcagaaacacagcctaagcttttggtttttatgaaagcaagcccctttgcggatggtgggtctgttgacaacccctgttaattgagcacttgctgtgtcccaggaagaaactcagcatgcagtatctcatttaatcctcacaatgcgcccccccaaccccccgcccaggcatccccatttgacagatgggaaaactgaggctcaggggaatgagagagtggtaagtggcctgtccagggtcacacagcagaattccaactctgcatcccccaaagctcccactgcttcccccaactgtctgcatttactaatcacctactgtatgctacggatgggtgtgcatagcccctttgagtcctgacaagcaggaatgagtgcatgcttgtggttgagatggggaaaccgaggcaccaacaggcaagggcgtgcctcagtcatgggctgcgggcagaggcttgaccccagggcctggtagagggtggactggtggctcctgtttccctccccagctccctcccccaacccttccctcccaacccagagccaaaaaagtgtgttttctgctggtccaaggctctgctgccctggctaagtaggttaggacccaggcaaagctggcgagccccatccctcaagcccgcccacagcttaccatgcactttcccttccttcccaggcctggcaggcccccctggggacctgatgggggagatggaaggaaataattagaacgcagctcctggaggaagctagagccagtgctcagcctcctcacagtccgcttagttgcttcccgcagcctggtttcccccaggggcctccaggagccaggcgtggggaggaggtgtccctggaggggtccacaaaccccctgctgacgcgaggatgctgaagaaggcgttgccttcggcagggagggcacaggcatggatgatccagggggcacggcagctcccagggctgaagggaatctaggcagtgctcagaccaggccccagggactgtttgcaaagagcgttcagctccccggccccctccctcgtccatctcgcagtcgaaacttctctacaagaacactgtggccccataacgttcacaccacgtaaccaccatccagggcaagaaatagaacaaaaacgccccacgcggcatgtgcctcctcgatcccccacccccaccgccttctttccctctagagctgctggggacactgtctggagacatttttggttgtcacgacaggaggggggaggtgctcctggcatctggtgggtggaggccagggatgttgctcagcacccgccgatgcccaggacagcccccactctagaggatgatccagacccaaatgtccacagagcccagcttgagaaaccctgccttaccggtaaccacgaccccagcttctggaatgagcgtttttggcttctctctttttcccacctgcacaggctttttttttttttttttttaagagacaatgtctctctctgtcgcccaggttggggtgcagtaacgtgatcatggctcactgcagcctcaacgtcccgggctcaagtgatcctcccacctcagccccccaggtagctaggaccacaggcatgcaccaccacacccagctaatttttaaatgcttgtagaaacgggcctcgctatgttgccaggctggtctcgaactcttgacctcaagcaatcctccctcctcagattcccagagctctggaattacaggcatgtaattccaattcttacatgcctgtaattggccaacactggccaattcttaaaaactgaatttatgtttgctcttctgtaacattcaataaatgagacacttctatgcttcgcattaaatgagtacatgttgcttttgcaggattgatgggcattcttttttttttttttttttttgagatggagtcttgctctgtcacccaggctggagtgcagtggtgcaatcttggctcactgcaacctccgcctcccgggtttaagcgattctcctgcctcagcctccagagtagctgggactacaggcaggcgccaccacacccggctaatttttgtatttttagtagagacggggtttcacactatcagccagactggtctcaaactcctgacctcaagtgatccgcccgccttggcctcccaaagtgctgggattacaggcgtgagccaccacgcccggtcaatgagcattctttatgatgctgttttgagatttactgtgtggcatgggatgtgttatccatcccctgttgacagatgtttgggttgtttctaagtgtgaatactgtccccatgccacgcccctcaacatgtttcctgagtcacctggacagtaatttctccaggaggccagatgcagtggctcacgcctataatcccagcacttcgagaggccaaggtgggagcaatgcttgaggccaggagttcaagaccagcttgggcaacatagtgagacccccacctctaccaaaaaaaaaaaaaatttttttttttttaattaaccgagcgtggtggtgcacacctgtggtcccagccacttgggaggctgaggtgggaggatcacttgggtctggaaggtcaaggctgtagtgatccatgttcataccactgcactccaacctgggtgacagagcgagaccctgtctcaataaataagaattcctccagggtataaaccaaaagcgaagtttctagagcatataatttgcaagtggttggcctcagtaaatgcagcttgaatgtttattggacaataaacacagtgaccctttgggaggccaaggcgggtggatcacctgaggtcaggagtttgagaccagcctggccaacatggtgaaaccccgtctctaccaaaaatacaaaaattatctgggcgtggtaacacacaactgtaatcccagctactcgggaggctgaagcacaagaatcacttgaacccaggaggtggaggttgcagtgagccaagatggcgtcactgcactctagccttggcgacagagcgagaccctgtctccaaaatatatataaataaataaaaataaacacagtgggccgggcacagtgggccgggctcgcacctgtaatcccagcactttgggaggccaaggtgggtagatcacgtgaggtcaggagttcgagaccagactggccaatatggtaaaacctggtctctactaaaaatacaaaaattagccgggcgtggtagcatgcgcctgtaatcccagacacttggaggctgaggcagaagaattgcttgaacccgggaggcagaggttccagtgagccaagattgtgccactgcactccagcctgggtgacagagtgagacaccatctcaaaaaaaaattaaaaaataaatgaacgcagtggcccttgcaccagtagctcatgggaactcctgttcttccacatccttgtcaacacttggtactgtcgactgtttcatttggccgatctgctgggtgtggagtgagatcttattggggttgtgcttggcatttccctgtaatgaatgagatcaagcacttttttggattagactgagccacaggaaataacattttcaaatagatgaaaaagatctaagtattaggaatacttgaacctaatttattggtcttttgatttcctcttgcacagcttattaagagctccagaattagattcacctgacccccacggcctgccctttcccagctccctctcttccttctttccttccattcattcctttagtaagtatttgataagcaactactatgtgccaggtactgagcgagccagggaggattgacagggtatgagatggtccctgcactcccagagcccacaaaccaccaggcctttgaccaggctgtgcccactgcctcgtgcacctgaaatactctcccaccaccatcccctctgcccacccaggtctttcaagccaatccccttgcaccagcccctccctccaggaagtcacctcaccctgaccccaggcactctggtctctgattcctcttcaagcaccacatataacaggaatataagttataaccacacagatcacagagcccagctcctccaggacccagtacagccccaactgttgatgcattcattcaacaaacatttcttgagcacctactgtattcctgaccctgtattataagctggagacgccatggtgacagacagacatccctgtccttgtggggctgacatttgggtgggggagatggacaatgagattatcagtaactacaacaaatgttcagggagtgataagtggccgggggtgtggtgggcagagggaaggagagacttcgtaaagaggatctcaagcaccaggagatggaatttaaacagccggtcaggggagtcctcactgggaaagtgttatttgagctaagtcataaaggaggagaaagacggaatcaaatgggatgtgggggaaagcattccagagagacagaacagcctgtgcaaaggccctgaggtggaagcatcttggggaacaaaaggaagtgagcaagggagagaatgagaggaagtgagggcagggagctgaatggtcagatcgtgcaggggcttgagggcctcggggaggactttgacttttatccctgaatgaggtgggagccacggaggattgtaagcaggggaaggatgtgcctgacttctttggtgttcacagcgccctctggtggccatgttcagtaatgctcagcccttgcagcttctgggtggatctgattttttttttttttttttttttagacagtctctgtctcccaggctggagtgcagtggcacgatctcggctcactgcaacctccgcctcccacgttcaagtgactgtcacgccttggcctcccaagtagctggaattacaggcacacgccaccatgcccagctaattttttatatttttagtagacacggggttttgccatttggttaggctggtctcgaactcctgacctcaagtgatctgcctgcctcagcctcccaaagtgctgggattacaggctcgagccaccgtgcccagccggtgtccaccccatgtctagcaccagccagacactgtgccggcgcaccctcatcttcaggcctgggtgacaccagaggtgtgctatggtgtgtcctggacaggggctgggccagaggacattgctcgtccaggcagaaacatcaggcctggggaggggcacaggaaaaatcaacctaccctggcaggggcctggccttgaagcaggaagagatgccgtggcaggaagttggccccagtgtttaaaaaaaccacgtagcaactatttctcgcccaggatgcccaggaaagcaagggtactgggggattagatccatcaccaagaaggatacagtcagccctgaacttctctggggccgcttctaatccactacagggcttggggcaaattttaaaaggtacccttcccgtgggttagcgaactggcctagtacagtgatttttttgttaggatttgctgccatctgctggacaatttcattcacaacatacaaatctgcagtatgaaaagagatgggaggggcccttgtgcagtgcacgccctgcgcaactgtatatagcagctgtgtttcctcttctgggtagaaactctgctccccagtaggcgatcgttagttttaccggggctctgctggaacaggccagtgatccactgctctcttgcttttatcccttacaggtgctgcgatactttgactacgtttttacaggcgtctttacctttgagatggtgatcaaggtgagtgcagattataagtgagaacacacggtaatttttttttttaagcaagtgcagggctgggcacagtggatcatgcctgtaatcccagcactttgggaggctgaggcaggcagatcacttgagatcaggaggttgaggccagcctggccaacatggtgaaaccccatctctactaaaaatacaaaaattagccgggcatggtggcacatgtctgtaatcccagctactcgggaggctgaggcaggagaatcacttgaaccctaggctgcaatgagccgatgtggaggctgcagtgagccgagatcttgccactgcattccagcctgggtgacacagcgagactctgtcaaaaaaaaaaaaaaaaaaaagagctgggattccaggagatcctgagcctccaagaatgccccccttgagaggatgagtctcccagaggattagaaatgcctggtgtgtttgaagagcagcaaggaagctggtgtggctgggcggagtgagagaacagtggggaaacgaaggacagagagatgagtggggaggtgagggggcaccttgtgccggggatcacagagagggctcttcggctcttactttgagtgaggtgagggccatagagtgttctgagcagaggagggacttgatccaggtgttcacaggtgccctttggcatctgtgggaagccagaggacctgtgagcaggtgatcacactggtccccatgggcgatgacggggacaggatcaggctggtgaccaaagaagaggtgagaagtggacagattcttggaaggttctggaaatagagccagtgagttttgctgatagagccaccaatgagggatttgggacaaagaggcatcaaagaggatcccaaagtttggatctaagagccggcaagccagagctggcttccatcaggcaaaggggggccgcctcatggggcaggggctccccactcctccctggagtcctctggccactgcccatccctgcaagatgaggtggcctcattggcttccctgcctctccccgagaggctagagagtgggtggcagcaccccagggtggggatcaggtgggggttctgagcaccctctcttctcccccacagatgattgacctggggctcgtcctgcatcagggtgcctacttccgtgacctctggaatattctcgacttcatagtggtcagtggggccctggtagcctttgccttcacgtaagtctcctcgcaagggttcctcttgcctcttttcccccaacccccagcctgggccacacatcggattacaggacatgttctcagggtctagggatggggtgtgtgggctccggggacgtgggagatatcagcatgccaccaggaagagcttcgatggctttttgcatgatgtccatggaggaagaaggagaagggaccccccctcctgccaaccttctacctcctcacacagcaacgggcctcagccacatcactggccccttgctgtgcagcttcctgtagactagcctcgccggaacatctcatccccctactactccacaagcgccgcccaaaccgctgtctctttggaaagtccctaaagagacaatcaggaaacgaatgtgcatgagaattctgaccccctccctatgcctgaaggccccgtagttgtagacctggtgactccctttgtgtgtctttcacttctcctggcagtcctaggattctctgccctctgaaaggccatgtgtcatcctgcagctccaagatggcgccccagttgtaggcagccatttcaggatggcacccaagctcttagtagtcatcccaagatggcatccaagttctgggtggccattccaagatggcccctgagttctgagctatcattccaagatggcctctgaatttggggtggtcattcttagatggtccctgagttccaaggtgaccttcaagttctgggtagccattccaggatggtccccaagctctgggtggctattccaagatggccccaagttctaggcagccattgcaagatggcccctgagttccagggtggcccccaagttctgggcaaccattccaaggtggcatccaagttctgggtggctattccaagatggcctctgatttctgggctaccatgctaagatggcctctggattcttggtggccattcttacatggtccctgagttccaaggtggccttcaagttctgggtagccattccaagacggtccccaagtcttggatggctactcgaaggtgacccccaagttctgggcagccatctcaaggtggcaccctagttctgggtaaccattccaaaatggcacccaagttctagggcaaccatttcaaaatggcccccaagttctgggtgactatttcaagatggtacccaacaggtgagtggccattagcccttagggccctgatagcagacttagcagtacattcctgaagttgtagacatttggagcgggatgaaaaatatctaatcagtctttaatcaagaaacaaatcttggggaccctggctgtgcccatcatggtgaatgattccctgacaggttttgaaaggatcttgacacattcactcccatcgtgagagaatcaggggcttcctcctgtgcctctgcctctaggctccctcctgagccaatctggaggggcccttgaatggtctccctcaccaaacaatgaggacttggtttgtcaggagggccaaaatagtggcccatttccagtagaagggctgttaagtaggccacacttagattcttctctgggaacacaatgaggtcaagttgtgttagaacaaaaaatctccagagtttttggatgcctcagagctggagatgtatcatgaaggttgggaggctgattatacttctttctctttctctttcactccttcctcctctttctcctctctttttgttcgtttactcttttctttttctcttctcctctccctccccacatccttccctctcctcaaagcttttcagtgtctatttgactactagagcaatgcacggtggcttacacctgcaatcccagcactttgggaggctgagacaggcagattgcttgagcccaggaggccaagaccagcctgggtaacatagggagaccccatctctaaaaaaaaaaaaaaacaattagccaggcatggtagtatgcctgcactagcagctacacgggaggctgaggtgggagaattgcttgagcccaggaggttcaaggctgcagtgagccgaaatcgcaccactgcaccccagtctggggaacacaggaagaacttgtctcaaaaaaataaaaagtttaaaaaattaaaaatcaatgaatttgctatttagaatattatgctttatatggttactgaataattttaatagtgatgagtacaaaaaaaacaggtttagcaagctgttctgtaggttaaaaagtaaataaataaataattaattaaacaaaatacaatgcacatcaaattaggggacaaagattgtgacgaataagacaaggagtccatgtctttaaaatatgaaaagcagttacaaatcaataagaaacactacttctcaatggataaatgggcaaaggacataaacagaaatctgatagaatgctggcaactagtaaaaatggaggtaaatcaacccttggaattcagagaaatgtaaaataaaaacgagatacaattcattccctatcaagttagcactgttcccgccgcacccccacacacacacaaaaaatgatttttttagctaataaacagcatatataagaatgtattataataggctgggcacagtggctcacgcctgtaaccctagcattttgggaggccaagggagggggatcacctgaggtcagcagttcgagaccagcctggccgacatgacaaaaccctgtctctactaaaaaatacaaaaattagccaggcatggtggcggatgcctgtaatcccagctactcaggtgggtaaggcaggagaattgcttggacccaggagatggagactgcagtgagccgagatcatgccactgcactccagcctgggtgagaaagcaagattttgtctcaaaaataaaaaaaggaatgtattataataaaatatacttttctccccctctatcacctatttaagcaggtccttcaagttgtcaggtagacatcatgctatgagaaaatttaaatcctgaaaagccagaatgttttaccaccctcagcctggaatgaatccttctcctatggaaataacctacgggtttctccacccctctctgcctttcagccccttccctccctctcccctccttttctttctccctctttctcttcctcctttcccctctcttccctctctcttcttccctctctctgtctctttctgttcgtctttctccttttaccccctctcagtttctatctttttattttcctctttctctctctctctccctctctttctctctcactccctgcactgttgatgacctatgtccttgggtgatgtgggcctcccctggaccgtgtagcttggagaaagctgaccctctgtcatcggtctggcaacagggacttggcccccctaccctgcattctgatgaggaatggtattcagacaaaggcagatcccaggacacaggaggacatgctcaggcagggacccccgcccctttcctctggggcaaggtctgctcagcagcctccaagattcctagggctcaagaggtggcaggtagctcagggcactagggcaggcagtggggtgaatatgtcactcatatccacctgtccacacacaatgcttaccttggccacctgtgcccaggggaatgggttttatcctgtgaatcctcccagtgaccaccactgagtgtggcacagataaatggtaccaagcccaagctgttcaggtctccaatgtcactttcctctcagacctctgttgtagctgacatactgtaatgctgaggagggccgggcacagtggctcatgcctgtaatcctagctctttcggaggccaaggcagatggatcacctggggtcaggagttcaagaccagcctgggcaacatggtgaaaccccaggcaacatggtaaaaccctgtctctactaaaaatacaaatattagccaagcgtgatagcaggcgcctgtaatctcagctactcgggaggctgaggcagaagaattgcttgaacctgggaagtggaggttgcagtgagccaagattgcaccactgcactccagcctgggcaacagagcaagactctgtctcaaaaaaaaaaaaaaatgctgaggaggtgactgtcccacctccatcctccgagttgaccatcacaatttagggaggggaatgacctacaaaggacccagaagcaagcctttcaattgttgagcttttgccattatgggccatcgtttacaacatgctgtttctaggttctctggaggtaaaattagcctcctcttttaaacaaagctaatctgcaaaagcgaaccaaaaattcttttccaccagagatcaattagcagaatgagctgggtgcgatggctcacacctgtaatcccagcacttggggaggccgaggcaggtggatcacttgaggtcaggggtccaagaccagcatggccaacatggtgaaaccccatctctactaaaaatacaaaaactagctgggtgtggtggggagggcctgtagtcccagctactcgggagggtgaggcaggagaattgcttgaacccaggaggtgaaggttgcagtgagccaagattgtgccactgcactccagcctgggtgacggagcaagactccatctcaaaaaaaaaaaaaaaaaaaaaaaacagcagaatgattcttttggggagttgactttttttttaatttctgagttttctttttaaatatcaagttatacaagggcattcaaattggcctacaactcacaggaatttggcagcctgtttgcagagtcaagcttttacattgttctcatgaaattggtacaggcataaagccacccttcactcttgaaaatccattttgaatgttgttgttttaattcttatgcaagaaaaggatctggatagggatttcaggccatcctgtcaaccctggcaggcttgtagatcatgcaggaactgggaggtgtgagattttgccagtaggatcctggcaagtgcctgggactctcccagggttttggaagagccgacggacatgagtccaacagggagcatctttatatcatggccgaagggatgagagaggagaccctcaaacctcacgcctaccacaccctccccaccccactgtcaagagtccatctggtactgctgttcctcccccagggcagggctgcaggcccagcacagctggccaggtgccttgatcaagccattcctgcacacctaagagccaaactgctagaaaaccagaataggagctactgcttttttccctaaaaagttttggaatcttctccccgttacaggtttctggcctcttttgcctgagaaggtctctcaccctatgaggactttgcttattgtctttccttgttatcggatagttggcacattggaaggagcatggatgctctgaggttctcagcctgagcgctgaactctccacccgccccccaccccccaccccagggtcctctgcttatttcctttctggtcttttaacttgctttgtctgtcctctgtgcatatcccctcatagacaaggctgagagccccacaagtattagattgaccttattgttttaagaaattgtccctccaggtctgtttgatttctctctagatgtgcaagtcctttagcctctctgtgcctcagtttttcccatctagatgaggaaactgcggcccagagggactgtggagggaagtaagtccgacaagatcactgaggttgggttcagctgtcagatgctacccatctcccagccctgaatacggaggctcacagtgagcagaatgatgctcagcagcctggccagcctgggttctttgaggcctggcagggctgcgagatccaggggaagggaataggggaagggagcataaggttattcccttccttgttgaaaggaaccttgccattctggcctgttggggtcaaagcaaggattcttcccccagtgctgtgattgtggcctcgtctccgatatgggagaaaactatccctgtggtcccaccaagggatgtattgaagctcttctgaagatgtccacccctcctgcacctcacccaaatatctgtgtgtgtgtgtcctgctcaattcactgactgtgtcccttgtatccatgcgtctaccataaacaccccatttcatgagccatcacacgtggtatcacgctctgtgcccatgcatcagggcggccaactgacatttctcagcagctggcagatcatgatcctgccctcaccgccaagagtccatctggcgcggctgttcttcccccaaaggcaggaccgcaactggcagagcgccttgatcaagctgctcctgcatacccaggagccaaactgtcaggaagccaaagatggagccctcaggctgctatctcttgatcctcatcttcaaaacagcccccacccctgaaggcattatttttcttgtgtatgatgaaatggaaagaagattagagtgcgagatacccacacctgggtttgaatcttagtctgtcttcccagctgtgtgcctgcccttgggcaggtcactctttttctctaggcctcagcttcctcatctggaaaatggtcataatggtgctgtcttcccataggcaaatgcagtgatgtccagaagactcccatattaaacctaaagtcagcagattaggcaaaaatcactgtcattgaaaactccctcaatcatccgtaaagaagctgggtgtggtgtctctcacctgtagtcccagctacttgggaggctgaggtgggagaatcacttgagccagggagttcaaggctgcggtaagctatgattgtgctactgcactccagcctgggcgacagagcaagaccacgtctctaaaaatataaaataaagccgggtgcggtggcttacgcctgtaatcccagcactttggaaggctgaggcagcctggcaacagagtgagaatccatcaaaaaaaaaaaaaaaaaaaaaaaaagtagaatctatatgattctacgtatgcaataattcctagatacactgaatttgagaaccccaagtcagactacaggaaaaggagatgagggggtgtggaggagaatccacttggaatatttgtagacatttaaaccattctgtgttttaaaaaatatcacagccgggcgcggtggctcacacctgtaatcctagcactttgggaggccaaggtgggcggatcacgaggtcaagagatggagaccatcctggctaacacggtgaaaccccatctctactaaaaatacaaaaaaaattagctgggcgtggtggtgggcgcctgtagtcccagcactcgggaggctgaggaaggagaatggcgtgaacctgggaggcggagcttgcagtgagccgagatcttgccactgcactccagcctgggcgacagagcgagactccgtttcaaaaaaaaaaaaaaaaatcactaacttccagaggggtcgtggatggaaaattccatagagtccgcttggcgacagggtttccgccattctgatggcggtcaagtctttctaacctggatctccagtcattgttgaaggcgcctaatgagccccaagcctgattccaatgaatcacgagaggaccagctgctaggtgctgatagctttccccaggcccgcatttgctcagagggcttcagagttgcttctaattccatcccaagtcagaactctttgctgaccccctccttcataaagagcaaagccaaggccatagcttttgttaatcaaacatcagaattccacagacctgagttggttggttgtttgttttaagagacagagtcttgcccaggatgcagtggctcacacttgtaatcccagcgctctgggaggcctaggcaggaggatcacttgagcccaggagtttgagaccagcctgagcaacataatgagacccccgtctctacaaaaaatggaaaaatttgcctgtatttccagctacttgggaggctaaggtgggagaatcacctgagccctggaggttgaggctacagtgagccaagatcccgctactgcactgcagcctgggcaacagagggagaccctgcctcaaaaaaaaaggagagaaggagagagacagggtctccctatgttgtccaggctggtctcgaacttctggcctcaagcaatcttcccaactcgtcctcccaaggtgctgggattatagctgtgagccacggcacccagtctgggcctgttttgcagatgaggataacgagaggcagagtcaggattcaaacccaggtcccctcaacttcaaagctcacaaccttttagacattctaaaaccttgcagctccacaacgcctggagaagaggggtttctccggctcttggcagtgactttccgtggtgaattcacctttggtaactgacagctttgcagctgtcctgctacctggaaatttggctttcttagtgctttcttgggcagtgccaggtgcctgccaagggcgggggactgaatggaggtgggggcggcttccagatggaaggatggacatcggccagcgccatgagcctgaggctcccccaactgctgcccgggcgggactcgggggtgctcaggggtgcgtgtgtgtacgtgcgtgttctgtgttcttttttctgaggccacttacgatctgtctctccctccgatgccacatcaccaggagcagtacacggtaaagtctctctctatctttctctctctctctctttctctctctctctctctcatattctgtctctcgtgatctgtcccctggtgcagcctcgttagttctgggcctgtttctgtggccttgtgtccttgctgccgctgtcctgtcgcttcaaatgaccagaactcactccctgcgaaggaggcatcccaaagggtcttgccaatgcctccgcccatgccccaccagttcttgcagagaacagaaggggcagaggttcagtttcaataggcaagctgggtggagcagttatcagaagcaatgaaagtgggccagacacggtggctcacgcctctaatcccagcattttgggaggccgaggcgggtagatcacttgaggtcaggagtttcagaccagcctggtcaacatggtgaaaccccatctctactaaaaatgcaaaaaattatctgggcttggtggtgcacacctgtaatcccagctacataggaagctgaggcaggagaatcacttaaacctgggaggtggaggttgcagtgagctgagattgcaccactgcactccaccctgggtgacagagtgagactctgtctcaaaaaaatatataaaataaattgaacaataaaaaaataaaatggccatggaatcgttttcagatgaggagatgcagaatgcccatggagacatgctcccaattgtcacttgtttgggacatcaagattttagccagttccatgtgcaacctggatgtacagttccttgactttttttctatcaacatgtattctaaagttcaatttcaaaaggaaactttagccaggtgcagtggtgcatgcctgcagtcccagccatttgggaggctgagactgaaggatcacttgagcccaggagttggaggctgcggtgagctatgatcgtgccactgcactcccccctgagattccatctctttaatttaaataaaaaaaaaggaaactatattatccacttacaaccagcattgctaacctaagataaatctgcaactgcaaaagtaaatgtaggccagacatggtggctcacacctataatcccagcactttgggaggccgaggcaggtggatcacttgaggtcgggagttcgagaccagcctgaccaacatggagaaaccccgtctctactaaaaatacaaaattagccggacgtgatggcacatgcctgtaatcccagctactcgggaggctgaggcaaaagaatttcttgaacccgggaggcagagactgctgtgagctgagatcacgccattcactccagcctgggtaacaagagagaaatgccatctcaaaaaaaaaaaaaaaaagtaaatctaacagaaaccagacaatgttgttgccttcaagctgggctctttgttaaaaggaaaattactaagtgttagggaggtgttaaaggcctattagcatctacctgaggcttcctttctcgcaaaagcagagcgtctgaaagatacgtggaaaagaaacttaaagtataataaaaaagaaagaaagaaaaagaaatgattatgcccctctgagatccaattatttaatctgtgcccctgttctgcctaaaattatctcagtgactgtccaacgtgtgtctcacacttgggggcacagccttgagatgataatgatgatgttagttttaaaaagaaaaaaaaaggttcagagttctgaatcctggagtatatctctgcctagcaggctaaaatacaattatcgtctttgttccctgaaaaatgaaaaaaatggagtcctttaaaaagcaaatggtgtgaagaatgatgtttttgcactggatactgagacccatcgtgatgggggtctctggggcagctctgctcatgacctgggaggtcactgtagggagatgttttctaggtgacctccccacccaaatactccaaccggaggcattcacgtgtcctgagaccacacgccaggcgcaggctaggggctaggacaagaatcaagattaaaggggaaatggccaggtgcggtggctcatgcctgtaatcccagcactttgggagtcaaggccagtggattacttgaggtcgggagttcgagaccagcctggccaacacggtgaaaccctgtctctactgaaaatacaaaaattagccaggtgtggtgactcatgcctgtagtcccagctattcgggaggctgaggtgggagaatcacttgaacccaggaggcagaggttgcagtaagccaagatcatgccactgcactccagcctgggcaatagagcaagactccatctcaaaaaaaaaaaaaaagattaaagggaaaatgaacacagagaagagtagattacactgtaagcctttgaagagttttctgtctaaaaccagagaccgaagaaacaaacaaagattaactccgaaatagcacataggagctggcaggagccagaggtaggcagtcaggaaatgctgtcggagggagcaacaggtaatttgggctttgaggaccgggtagttctgtgactggagaagtggaggaagggcatttctagcagcgggaacagtatatgcataagcagacagaggcaaaagaatgtggctggggcttgagatatgtagccataaatgggaatgcaaaggtgaaggtaagttggactagattttcaagagcattgaatgccatgcccagaagtttgcacttgctcttctgagaattcacgtgctccagaagaattctgagcaagagaaagagtgacaaggtcattggctttagccactgtgtgcataaaacatggaagaaaaggcagggaatgaggagcaagttgggagacgggtgaggggggatggcacccaggaatggatggcgggatgttaaggaaggtgacccactggggatggggatggggatagagggcaggcagttgaccatgactctcaggtttctggtgtggacaactggatgggtcatgagtgccatgaaccacaagctattcatggtcccactcaataccctcctcttggggggcctgagtcatggttggccaagggtgtcatggcatctctggggtctgcattgctaagctcagttccaacagaccttggactgaacttctgtgcagtcctctctggcaaagatgggctcagagacccttggagcaatgcagcagagaccatggcagcagccacatcagcatctgaaaacagcggcacccggttattttccctccttcagactcagggaatatggtgggggaggggagatttggtataagggccactttaagtatcttccagaatcccattggaagggggagaaaatcccatttttttaagagcccactgataccacctttaaaaagaatacacagggggccaggcgcagtggctcacacctgtaatcccaacactttgggaggccaaggtgggtggatcacctgaggtcaggagttcaagaccagcctggccaacatggtgaagccccatctctactaaaaatacaaaagttagctgggcatggtggcacgcacctgtagtcccagctacttggagaggctgaggcaagagaatcacttgaacctgggaggtggaggttgcagtgagccaagatcataccattgcactccagcctgggcaacaagagtgaaactccatctcaaaaaaaaaaaagaatacataggggaccactaaactcctagaccaagggcttttttgaaaatagctgtgaccaggtgtagtggctcacacctgtaatcccagcactttgagagggtgaggagggcagattgcttgagctcaggagtttgaaaccagcctgggcaacatggtgaaacctcatctctacaaaaagacaaaacaattagccaggcgcagtggcgtgtgcctgtagtcccagctacttgggaggctgaggtgggaggatggctttagcccaggaggcggaggttgcagtgagccgagatcgtgccactgcactccagccttggtgacagagccagaccctgtctcaaaaaagaaaaaagaaaagctgtgcagaaatgggggtggggaatcagccaacccccttgtgctgggtctcagggacacccaatacagctgctcaggcccagccagatggcaaagggccctcaaccaaccctgggaccagaaccacaaaaagccacgtacttactggctcccgagcccaagcttaacaggtgaaatggaccactcttcaccaggaagggcagggctgtgccaagctcaccccagacttctaggcctgggagggtagggtcccatggagctgtgggctgccccctacccaacctgacctctgcttcctctcttcccttcttcccacctaaacattcctccacagtggcaatagcaaaggaaaagacatcaacacgattaaatccctccgagtcctccgggtgctacgacctcttaaaaccatcaagcggctgccaaagctcaaggtgagattgggagatggtggggtgcggtgggggggactgtcagggttatcatgtacagctgagcaggttgtacactgctcaaggacaacacattaaaggaggtgctgataacatcctagccatcgtgtatggatatttgtattattacaacttcccagcagatggcagtaaagtgagctgacctaaaataatctgtgtattatggcagtttttctttagatgaagtgtcttggggttaagatcctttttcctaattcgcatgaaggcatcatatggatttaaaagggtataaccgtgatctgggaagcaggaactagatttcttgttccataaaattttgacttttcatctacctattctaggctctagtatctcccattccaaaatagcatgaaccagcatttcccaaaagcctgtcattcaaaaacatatatatatattaagggaaataaaatccagtcattagagcacccactttcactctatgcttcacctgggggtccccagtattatctcttatgtaatatgtttctttaaatcaagtcacacccgtaatccctgcattttgaaagaccaaggcaggagtgttgcttgagcccaggagaatgagaccagcctgggcaacatagttagactctgtctctactaaaaattaaagacagaaaacagatactgttatggaaatctaaccaaatatggctgcctgcctaaggctttgtgcattgacaactgctctttcttggttaaagagggaaaatgtcaatggtaggtgttaacatggtagcaactaagtaaaaatttctccttcactcaaaaggattgagagagttggaaaggaagtaactttgttaccttgtttttctgtgttgggctcctgtatcacttaaaagcatctctggtatcccatctgggagttttagatccatagaatgccaggattgagtccaactcctccaacgcttatttctgaaagctggggggaccttaccctagtgacttgacttatgaccttgcctgtaaaatgggaatgatcatggcagtattttggtatgatgggccactggaggcagaaggttgggcaggtccccagcccctcatgctctctgtcaactccaccccacaggctgtgtttgactgtgtggtgaactcacttaaaaacgtcttcaacatcctcatcgtctacatgctattcatgttcatcttcgccgtggtggctgtgcagctcttcaaggggaaattcttccactgcactgacgagtccaaagagtttgagaaagattgtcggtgggtctccactttccagcacattcccattggaaccagcaggtgggcaggggggaagtggctagaggcattggccacttgggctcagagactggagaagtgatgagccttggaagtgactcagttgcaaccagcttggatcttgggtagaaagaaaaccggttttagaatttgagtcaccacccagagccacagaatgagtcataagcaaattgattgacctttcagccaccgcctttgtcatgtgagggatattaatacacatccacagttccttacttgaaatcgttacaggcagatgtgtttcaaagttgagaatattttgagattcccatgtgggacatgacaccctcagctgggtctaaggcagccctataatcaaacacaatatttctgccataaaatgtgtaactatttacatcaaatggggtaaataacaagtataaagagcttcatgtccaatcagatcaggtttcattaccaaataagttaggtaagaggccaggtgcagtggctcacacctgtaattccaacactttgggaggctgaggtgggaggatcacttgaggccaggagttggagaccaggttgggcaacataatgagagcccatcctacaaaataaattttaaaagttagcggggcatggtagcacacacctgtagtcccagctacccgggaggctgaggcgggaggattgtttaaacacaggagttcaaggctgcaatgcactatgatggtaccactgcactccagcctgcgtgacagagtgagaccctgcctctcaaaaatatatacatataggccgggcgcagtggctcatgcttataatctcagcactttaggaggccgaggcgggcggatcatgaggtcaggagatcgagaccatcctggctaacacggtgaaaccctgtctctactaaaaatacaaaaacctagctgggcatggtggcagacgcctgtagtcccagctacttgggaggctgagacaggagaatggcgtgaacccgggaggcggagcttgcagtgagcccagattgggccactgtactccagtctgggcaacagagccagactccatctcaaacaaacaaacaaacaaacaacaacaacaaaaatatatatatatatatatgtatatatatatatgtacacgcacacacacatatgtattatatgtgtgtgtgtatatatatgtatgtgtatatatagtgatattgttaccagtgtaaagtggcattttgcaacacatggtagcctgttgttatcttgatggctatttattgaaattaggaggatgccagatgtctggataggagtctggaactaacccttgtttcctgccttgaaaaggagtagcaacctcccttagcctgatgaacctctaaatgtcccctatgtctctctgcctcctcctaaactccctccaccccacccccagcaagcctgaggctctcaccctgaggactagaagttatcacgttggaagagggtgctggaccctgggtcagctctcccaccaggagtaaggttgtgccatcacccatggatttatctcaaagtagatgcacacgtcatcccctatgaagcacaggaacacatggtggcaggatggggagtcactgcttcccaagcagtctaggctggtggaccactcttcctttccctccccctgtctctgataaccaaagacaagtgcaagacagcccctctttcccatttactaacagtccccactctctgtggcagaggcaaatacctcctctacgagaagaatgaggtgaaggcgcgagaccgggagtggaagaagtatgaattccattacgacaatgtgctgtgggctctgctgaccctcttcaccgtgtccacgggagaaggctggccacagtaagtggcccgactggaaatctatccaggaggagccctggggagcaggaggataaagggcctgagagcttagcaataagaaaggtcttggaggccgggcatggtggctcacgcctgtaatcccaacactttaggaggccaaggcagatgtatcacttgaggccaggagtttgagatcagcctggccatcatggcaaaactccatttctactaaaaatcccaaaaaaaaaaaaaaaaaaaaaaaaaaaaaagctgccaggcatggtggctcacacctgtggtcccggctactcaggaggctgagacacgagaatcacttgaacccaggaggcagaggttgcagtgagccgagattgcaccactgcacttcatcctgagtgacagagcaagactatggcctccccgccttcaaaaaaaaaaaaaagtgaggctgaatcatggacttagtctttatttaaaattttgagccacttgtggtggctcatacctgttatcccagctactcaggaggctgaggtgggaggatcgcttgagcccaagagttcaaggctgcagtgagctgtgattatgccattgtactccagcctagacaacagaaggagacccctatccctgaaaaaaaaaaagaagaagaaattgatatttgttcatcatggactttttgcattaattttgattttttaaaatattggagcaaaagattatcttgattactgagattttcagtacccccttaatttgcacccaaaacaaatgcctccctccctcacctcgtccaagtaatggtctttctctcagaggtcttggaaatgccaggctggaagcttggtagattccagcatgtgccctcagcatcctcacctccctccctctctcagcaaatatgccaacctgaacatgccctactacccactctcagacacatccagtactcacacatgtgggaataatgctaacccacaaggcacctttgagcaaagtttttttaaacacctttctcaacagacttcatttccatctgtctgaaaatcatcgcaatagacttaaatgattttgttcaaacaaggcactgaaggaccacctgccaaaaaattgtcatcatgaatacacaaatctatcatgcctatcatgtgaaggtatcgcttagacacagagcctttgagcagtgtgcaacctgcactactgtacagagctgctgtgcacttacccactctcatatatatccccattgtacctcctgagcacccagcaccacctgtgctcaaatacccactctacatgcatacacccacctctactccctccattgccacaacctgtctttaaatcccaacttggccacttataagtgggtggtcttcagcacgtccctttaaattgctgaacctcaagttcctcatgtgcaaagtggagccagtaataacctccctgggagggttgctgagccggtggggatgaattgttgaatattgtttccagcacacagcaagcccttcatgcacagcagtagaaatgactgacattggccaggcgtggtggctcacacctgtaatctcaacagtttgggagaccgaggcaggtggatcacctgaggtcaggagttcaagaccagcctggccaacatggtgaaaccccgtctctactaaaaatacaaaaaaattagccaggcttggtggcgcatgtctgtaatcccagctacttgggaggctgaggcaggagaatcatttgaacccgggaggcggaggttgtagtgacccaagatcacgccgttgcactccagcctgggcaacgagagcgaaactccatctcaaaaaattaaaattaaaattaagaaataactgacattgttgtcagcctttcaaaaaacagcgactacttaaatttctttttcatttccctctgttcctgttctgccatctcacttccaccctctctccaccttcctcatcaccccttgggtccctgtctctctccttcctgccccttccctctccctgccccattccttgcagggtcctcaagcattcggtggacgccacctttgagaaccagggccccagccccgggtaccgcatggagatgtccattttctacgtcgtctactttgtggtgttccccttcttctttgtcaatatctttgtggccttgatcatcatcaccttccaggagcaaggggacaagatgatggaggaatacagcctggagaaaaatgaggtgccacttccaattccatctgtcctttaaaaactggggacacacacaaactttaaaacacacacaacacccaggaacccctttctaggggtacctgggggagggaacagaagcattgtcccaaccgaatccagtcttcagggcagcccttcatggagtttccagaggaaacacatcatatagtgtatgtatcagtcagtttagactaggttatgccgcagtaacaagcaaccccagatttcattgccaaatatccacaaagggacttattttttgctcacactgcatgtcaacatcagttgtggatcttgccatctttattctggttcccaggctggcagagcagcagagcagcctccctctgagatgctccagatgaaaaagagagtatgtcagactgaggttcagttcttcaggcttgtgctcaaaaattacacatgtcacttctgctcacatttcatcagccaaagcaagtcacacatccattctgacatcagtggagtgggcaaatacaatctcccctagcgaagggtggtgaatatttatgaatgaaaagccaagccaggtgtggtggctcacacctgtaatcccaacattttgggaagctgaggcaggaggatcacttgagctcaggagtttgagaccagcctggccaacatagcaagaccccatctctactacaaatcaaaaaaattagccaggcaggatggtgcacacctttagccccagtaacatgggaggctgaggtgggaggatgcttgagcttgggagttcgaggctgcagtgagctatcattatgccactgcactacagcctgggcaacagagcaagaccctctctcaaaaaaagaaaaggaaagaaaatccagtcccctgtctaccagagagtatagacatgactctttgcctctctggcatcatccaagctaaatagaggacctagaatatatcctctgctcccttgacccttaagacttaataaccactattcctccttctctctccctcaaagagaaggagaagacgcagcaaagtattcagtaagaaagaatgggctgggcgcagtggctcacgcctgtaatcttaacactttaggaggccaaggcaggaggattgcttgagcccggaagttcaagaccagcctgagcaacatagtgagaccccatctctatgattaaaaaaaaaaagttttaattagctgggtgtggtggtgcacgcctgtagtcccagctactcaggaggctgaagcgggaggatcacttgagtccaggaggtcaaggctgcagtgagctgtgattgcactgcactccagcctgggtgacaaagcaagcccgtgtcaaagaaaaaaaaaaaaaaaggaaggagggagggagggagggaaggaaggaaatgagagagagaaagaaaggagggagggaaggaaggagatagggaagaaggaatgaagaagaaagaaagggagcgaaggaaagaaggaagaagagagaaaggaaaggagaaaggggaaagggtggaaggaatgaagggaaggaaggaaaaaggaaagtgaaggagggagggaggaaggaaggaaaggagggagggaaggagggagggaaggagggagggagggaaggagggagggagagaaggagggagggagggaaggaaggagggaggaaggaaggaaggagggagggagcgagggagggaggaaggggaagaaggattaggcttcaatttgatttggcacactcggtagctgtgtcacctcaggcaagtggtttaacctttctaagcctctattttggtgatctgcaaagtgaggccattgatagtacccacttcccatgtttgtattagccatgcaataatggggaaatgtcagtgcaagttttggcagttggtgacatctcaagcaactgtagctgttgggataagaaagcaatggtgagaaggaagagagagcccaggaatcctggctgggggcaagagaggcagagactcaagcagaagcacttgagaaccgcgacgagttagacagagggtgcccggtgtacagccaccttcctcctgcctctgccgctctcaccactggcctctctcccgcagagggcctgcattgatttcgccatcagcgccaagccgctgacccgacacatgccgcagaacaagcagagcttccagtaccgcatgtggcagttcgtggtgtctccgcctttcgagtacacgatcatggccatgatcgccctcaacaccatcgtgcttatgatgaaggtaagtgccccacaccagcccccagcactacttaacccccacctcgttcctgcctctaccctgataaaatgaaaccatctgcagtttcccagacagaccacactctggatcacctctgagattttgttcctgctgttccctctacctgacacactgttcccaccactcccccggccagcttcttcttcccagctgtacctgcagacctcttcctccagaaagccttccctgaccacccaagactgcttgaggtgcccatcttagcaggcatcctatctttatgtcgcctgccacaaaaatctgcgtcaggttgcatgacagtgtcccccacccatttatgatgacctcagccctgaattcctagaggccaacaaggatctggctcagacggaacaagaagctctctataaatgtttgattaatgaaatgagggggctgggcgcggtggctcatgcctgtaatcccagaactttgggaggccgaggcgggcggatcacctgaggtcacgagttcgagaccagcctgaccaacacggagaaaccgcatctctactaaaaatacaaaattagccaggcgtggtggtgcgcatctgtaatcccagctactcgggaggctgaggcaggagaattgcttgaacccgggaggcggaggttgccatgagccgagatagcgcaattgcactctagcctgggcaacaagagcaagactccatctcaaaaaaaaaaagaaaagaaaaagaaagaaatgagggagaaggggtaggtgaggaccctaaaatccccagggctaaggagcggcttccaaaaaaaaactctgaaaacctttcaccctgtgctttggactccaaagcgtggattcaagcccagctcttccatttaattcatttacctttgtacaagcaaccagtgactttctggggactcagtttccctgtcaataaaatgggaatgataataagagcacatttgccccctccagaggaggtgagaggattgaatgagaaagttcatgcaaggaccttagctccttctcggcacttcaaaaacgatcaatagtggccgggcaaggtggctcacacctgtaatcccagcactttgggaggtcgaggcaggcggatcacttgaggccaggtgttcgggaccaactggccaacatggtgaaatcccgtctctactaaaaatacaaaaattagctgggcgtggtggcgcatgcctataataccagctgcgtgagaggctgaggcatgagaatcgcttgaacccagggggcggaagttgcagtgagctgagatcacaccactgcactccagcctgggtaacagagtgagactccgtctcaaaaaaaataaggaagccggggacggtggctcacgcctgtaatcccagcactttgggaggccgaggagggcgatcacaaggttaggagatcaagaccatcctggctaacacggtgaaacgctgtctctactaaaaatacaaaaagttagctgggcatggtggtgggcacctgtagtcccagctacttgggaggctgaggcaggggaatggcatgaacccaggaggtggagcttgcagtgagccgagatcgcgccactgcactccagcccgggtgacagagtgagactcctcaaaaaaaaaaaaaaaaaaaaagtataattcagccaagcacaatggcgtatgcctatagtcccgactatcaggaggctaaggtaggattgtgagttcaagcccagcctgggcaaaataggaagaccccgtctaccaaaaaaaaaaaaaaaaggttgggggaggtttttgtttttttggatgtgaaaagaagagcctagtccggcggagagcggggctttcctgaactgtgcctcctaccagtgaggttgctcagaccttgcctggggctggagtgttgcctggagaacagccatgaagctgcctccccacttcccacttcccacccctgctcgctgacccctgctactcctgcttctttcccctagttctatggggcttctgttgcttatgaaaatgccctgcgggtgttcaacatcgtcttcacctccctcttctctctggaatgtgtgctgaaagtcatggcttttgggattctggtaagtaccaccttggggctacagctatgggcttgggagaagcccaagggggaacaatgggtcctggatgatggtctcccaacgtggccccaagaaccccaacctcaagggtggcttcagtatcctgccagtggccacagatcctacttaggcattcttgtgtttgccaaggagtcccagggagacccaacctgtgagtgttaccatatggctgcttatgtatccagttcctcaaaatgatgggagtcatcatggctgggagtctttagcatccattttagagataagaaaactgaaatcaggctgggcgaggtgtctcatggctgtaattccagcactttgggaggccaaggtgggcggatcacctgaggtcgggagttcgagaccagcctgaccaacatggagaaactctgtctctactaaaaatacaaaattagccgggtgtggtggcgcatgcctgtaatcccagctactcgggaggctgaggcaggagaatcgcttgaacctgggaggcagaggttgtggtgagccgagatcacatcactgcactccagcctgggcaacaagagtgaaactctgtctcaaaaaaaagaaagaaagaaagaaaactgaaatcaggctgagcacagtggctcatgcctgtaatcctagcacttcaggaggccaaggcaggaggatcgcttgaagctaggagttctcaaccagcctgggcagcaaagcaagcccctgtccctacaaaaaaaaaaaaaatttttttttaattagccaggcatggtaactcgtgcctgtagtgccagttactcaggaggctgaggtgggaagatattttgagcccaggaggtggaggttgcagtgagctatgatcatgccactgcaccccagcctgggcaacagcaagactccatctttaaaaaacaaacacagaggtcaggcacagtgactcacacctgtaatcccagcactttgggaggcagaggcaggcaaatcacttgagcctaggagttcgagaccaccctggccaacatggcaaaaccccatctctactaaaactacaaaaaattagcctggcgtgcttgtgggtgcccatgatcccagctactcaggaggctgaggcaggagaatcgcttgaacccacaaagtggaggttacagtgagctgagatcacaccactgcactccagcctgagcaacagagcaagtctcaaaaaaataataataataaaaataaatatgtctttatttttcaccagccactaactaaattttaacatttccttccatcttaaagggagataacaaacccttagtattagtattatcaacccttaatattatcaacatgacctgtgtcacttataaacatcagatattttcatactgcattataagagctgcagataccttaacatttaatttgcattcatcattgctttaaaatgttgcttgtgattaaacctacagctagaatttgttactcagtgtttttttgttgttgttctgttttgttttgtttgagacagtctcgctgttgcccaggctggagtgcagtggcgcaatctcggctcactgaaagctccaccccctgggttcacgccattctcctgcctcagcctcccgagtagctgggactacaggtgcctgccaccacacctggctaattgtttgtatttttagtagagatggggtttcaccatgttggccaggatggtcttgatttcctgacctcatgatccgcccgcctcggcctcccaaagtgctgggattacaggcgggagccaccgcacccggcctactcagtgtgttaatggagaagtatattcattgttagatcgccatttttaaaactttttttttttttttgagacacagtcttgctctgttgcccaagctggagtaccgtggcacaatcttggctcactgaaacctccacctcctgggttcaagcgattctcccatctcagccttctgagtagctgggactacagatgcacaccagcatgccaggctaatttttatatttttagtagagacggggtttcaccatgttggccaggctggtctcgaactcctggcatcaagcaatctgcctgcttcagcctcccaaaatgctgggattacaggcatgagacactgtgcctagccttaaaaaatattttgatagctattttattacaaaaggtaaccttgaagcccttgctattttgttatgcatttacaagcctttatgcataaaataaaatagccagcactattctcacatggccaaggttcatagcacacacacaaaagtatagttggctgagtgcggtggctcacacctgtaatcccaacactttgggagacagaggtgggtggatcatgaggtcaagagatccagaccacccttgccaacatggtgaaaccccatctctactaaaaagtacaaaaattagctgggtgtggtggcgcatgcctgtagtctcagctactcgggaggctgaggcaggagaatcatttgaacgtgggaggcggaggttgcagtgagccgagatcttgccactgcactccagcctgggtgacagagtgagactccatctcaataaataaataaattaaattaaattaaattaaaattattttttaaaaaattgggggctgagtgtgatggctcacacctgtaatcccggcagtttgggagcttgaggagggcagatcccttgaggtcaggagttcaagaccagcctggacaacatggtgaaaccccgtctctactaaaaatacaaaaattagccaggcatggtggcgtgtgcctgtaatcccagctactcgtgaggctgaggcccaagcatcgcttgaacctgtgaggcggaggttgcagtgagccaagatggcaccagtgcactccagcctgggtgacagagtgagactttgtctcaaaaaaaaaaaaaaattaaggtgaagaaggcttatactagtgggctgggacttgaagtgaagtgaattcttgaaggtccccagtgagtggccaaggtgggacttgaaccaggacatctgttctcttgaccaccagcttagtccatccctttgaagagagtgacctacagtctgggtctcagccagggtctcaggaaaccaggttcccaccttggctcacggaggtggttaggggcatcagctttagcaccagagttcagatcttgcctcgtcctatataagctttgtcacctccccatcattaaaaggagccatcctccccctccacctcagcagagccctggtaaacagcaaatggactaacgtgcatctagagggttgaggatgaagcctggcctggcatgggcactcaataaatgctaggggccaggcacggtggctgacacctgtaatcgcagcactttgggaggctgaggcaggtggatcgcttgagcccaggagtctgagaccaacctggacaacatagtgagattctgtctctacaaaaagtacaaaattagcctggtgtggtggcgtgcacctgcagtcccatctacttaggaggctgaggtgagaggatggattcagcccaggatgtcagggctgcagtgagtcgtgattgagccgctgcaccccaccctgggtgacagagcaagaccctgtatcaaaataaataaataaatgctaggaaagggatcctactaatggacctttttcctccaaaacagtggctttcatttggtggagatgctacttattagaagcacttgaggccaggtgtggtggctcatgcctgtagtcccagcactttgggacttctgccaaggcagaagaattgcttgaacccaggcgtttcagaccagcctgggcaacatagcaagacctcatctctagaaaacattgaaaaattagccagcatagtggcacatgactgttgtcctaactacttaggcgaaggcaggaggattacttgagctcaggagttcaaggctgcagtgagctgcgatcacatcactgccctccagcctgagcaacaacacaagacccggactctaaaaatcaaaaaagaagcacttagggaaatttcttaaaattaaatgataccctgagcaaacccctagatgttctgattcatttggtttggtgaggtgggagggaatcactgaatctgtaatttattattatttttttttttttgagatggattctcactctgttgcccaggctggagtgcagtggtgcaatcttggctcactgcaacctctgcttcccgggttcaagcaattgtcctgcctcagcctcccgactagttgggattacaggcgcccaccatcacgcccggctaatttttgtatttttagcagagacggggattcaccacgtcagccaggttggtctccaactcctgacctcaggtgatccgcctgcctcggcctcccaaagtgctgggattataggcatgagccaccgtacctagcctgcagttattttattctgagttgatcttctgctggtgaagtgagtcttccactggggcctggagctgcatctccctcaccctgccaatcctgcaagagccagcactgagcttcccctctgctttctcttttttttttttttttttttttttgagatgggatcttactctgttgcccagcctgttcttgaactcgtggcctcaagcagttctccctccttggcctcccaaagtgctggaattataggcatgagccaccacgcctggtctcccctttcagttttaaatgaagccacaagttccctgtataacatttgggagatagaggggagctctctagcctaggggttgaggtctgtgaccaaacgcctataaagttgtctttgtttggactcccccagaagcagagcctgagacaaggattgagtgcaaggaatttatctgggatgcagggcagtaagggagagaggaagtgacacagggacagaaaggcaaccaggaaagagtgtattattaagccagttcctgctgtgaacaaatggggctcagtttcagtggatacctccaggaggcaacagagagcacataccacagagtcatcccacctcacagggagggaattggagtatttatcctccagtgcccatcagacataatcacaggccactcccaggggagctattaattccctaacacttgtgcagccacagagagaccctgggcaaagtagtgtacctcaggtgtgtagttgagctatgggcagggccccagcaacacctgccaaaatgccaaaagtgccagtgggacctgaattcctttttatttatttatttatttatttatttatttttatttatttatttttgacggagtctcgctctgtggcccaggctggagtgcagtggtgcaatctctgctcactgcaagctctgcctcccaggttcacgccattctcctgcctcagcctccggagtagctgggactacaggcgcgcaccaccacgcctgcctgatttttgtgtgcgtgtatttttagtagagatggggattcaccatgttatccaggatggtcttgatctcctgacctcgtgatccgcccacatcggcctcccaaagtgctgggattgcaggcgtgagccaccgcgcccggccccctgaattccttttttaggcagttgtgaaacaacaacatcccatctgttgggcacctactgtatattccatgctcagcgacgcacattcattgtctgattgctgtgttaccactgccttccagagaagggcgcagaggccccaggcacttcgcctaggagggaagcacagctctaaggtcaggctccttctctgtaaggtagaggggctacttcagggtcacactgaccgccccaacccctgacctggcctctgcttctgcgaagatgctgagaaggccctgtgttttgtgttttgggtcccactgaccccagaggggagggccatctctttgacccagactcttggatccaaactggggtgccacccatcaccatgtcagtacccggttgaggggagtcagagatagcaggagaccttgtgggacttgaggctgtgactgttctccaaacaatgtggagtatttccatattttaacaaaagagaggccaggcgtggtggctcacgcctgtaatcccagcactttgggaggccgaggcggatggatcacaacgtcaggagatcaagatcatcctggctaacatggtgaaaccccgtctctactaaaaaatacaaaaaattagccaggcgtggtggtgggcgcctgtagtcccagctactcaggagactgaagcaggagaatggtgtgaacccgggaggcagagcttgtagtgagccgagaacgtgccactgcactccagcctgggcgacagagtgagactctgtctcaaaaaaaaaaaacaaacagagaggttatgcttgtgtttccccttgagccagcacccagcccaggaatgcagcagtcaggatagatcaagtgaagctgcagtaacaaacagcccccacatctcagtgacttaaattgatgggaagggttttttacattcagcagggaagctgtttgcctcatagttacccagggacccaggctcacagagtagctgccattcaaaatgttactggtcgccaagcccagggttgagaggctagagagtccaacactgaccagaaagtgaccacactgcttccacacacagcacatcactgcacctagacacacatggccccatctaaacacaaggggaccaggaagtgcgtgtgcctgaaaggccccaaagccccgtccagtgcctgttctgcaccctgttactgtccgcctccagatcaggaaatggaggcccagagaggttaagccacttgcccatagccacacagctgtggtagcagagctgggatttgaacccagagtctcctttctttgcgagtatgctgccaacctagtggggacctgaacacagactgtgggctctctgaggcctgggttcaaatcctggctttacatctctgtgctgctagcctcaggcagatgagtggcttggttacctcctagaaaatgggtatacctgggagtggtggctcacgcctataatcccaacactttggaaggccaaagtgagcagatcacttgaggtcagaagttcgagaccagcctgaccaacatggtgaaaccccgtctctactaaaaatacaaaaattagctgggtgtggtggcatgcacctgtggtcctacctacttgggaggctgaggcaggagaatcgcttgaacccaggaggcagaggttacagtgagccgagatcgtgccactgcactccagcctggatgactgagcgagactccatctcaaaaaaaaaaaaaaaaaagagaaagaaagaaaaagaaaatgggtgataacccttccctccaggatcttcatgaggagctcagtgatgtcatttataaagcccctggggtctcgggagccctcaaaaatgctggagagacaggccacagctctgaagagcagccccagccctgtggagctgaagcagggtctggaggccccctctggggccaggccaatcatgggaaggcccccaggagttcccagggagggagactcagcacagatgatgtcgaacagcctttaccgcagcccttcgaacaaccataactgtcccgggcactccgctgatgggcaactgtgcctctaacatgcacccggccagcctagggggccgggaaccaagccctctgttggcatctctgtcttgtgggtccccattctagaattatttccgcgatgcctggaacatcttcgactttgtgactgttctgggcagcatcaccgatatcctcgtgactgagtttggggtaagtctccctccagcttctctctgggtgactctgggctggacgaggcaggcggcagggggcgggggagcggtcccagaggcagtgtgtcccggaagccatagctgcttgagccagcacttggccatgaccagagagggagaactggggccccggggacaagggcagcccctcaggagggcattgtggggagatgggggtaaccaaagcttggctgtagggccagcactgaggggtgggctttcctgcatcctggcctaggaattaataatgcagatgagtacactgagggaactgagacactcaaaagctctgaaagctgagccggctcccaaacaccaccctatgtcaggagcccagaaagaatgggtttcaagtcaattctgtttgaaccaaccctctcctagttagtgggcaggagagagccacagccctcaggccagtgtggggacaccactcccagggccatagaggggtccccagggtgtcttccctcctctagccccgggcctgggagactctcaacatgggagtctctggacctctctgtggtggccccacaggccacattgcccttctccttttctggaagactcagggccccagaggtcctgtcctagaccctctccttggccatctgccaatgagcccaggcttggggtccctcaggagattggggggagggtagaagatccttgcagggggaagcaatggtcaaaaaagggtgtcaaagccaagggtcaagggtgataccaatgtcatcttactaacaataaaaataacaatagctcacgagaatcgcagccttgctgtgtgccagggaactgtgccaagtggtttacgtggattggctcagggtagaggtcttggtctcagctcgtaagagaattccctcggagggttcaactgaaggcacccaaatgcagacctcactggtggaggggaagggaagggtacccacaagggtggcaaggtgtccagcgaccacccaccgtggggagctgtcacctgcccaggtgctgaagtggggagggaacctgagccggaggccaggagaagccaccaagtgggagctgtcctgtcaatgtggagagacagagaccagggcccaagcaggcagagagcaataggggagaaacaccccaacctttctctcccctcatcccttatctcctgccagagcctcccatggcccaaagtaaaccggaagcaagctgaatatgatgctcagagcaggcagggaagtcaggagaatagatctgggtgtggtcgggcctgaggaagagggtgttgcctcatttcacagatgggaaaactgacctcagctgggcacggtggctcatgcctgtaatcccagcactttgggaggccgaagccggcggatcacctgaggccaggagttcaagaccagcctggccaacatggtgaaaccccatctctactgacaatacaaaaaaattagccaggtgtggtggtgcatgcctgtaatcccagctactcgggaggctgaggcaggaaaattgcttgaacccggaaggcggaggttgcagtgagcgacggtcataccattgcactccagcctgggtgacaagagcgaaaactccatctcaaaaaaaaaaagaaagaaagaaaactgatcttcaatgcctggggaagtgagagacactcccaaggtcacaaagccaggcctgggtgactcctgagagtacactgacagctcctggggtgtcccagtcagatccccctacagaaaaggatctgtttgcctgctcttccgtcctagaaggccaggaggggctggggaactacacaaaagagggggccattctttgatatgtcctacggcacccgcacccaagtgatacacacttatttgccttcagctccagtgagccagaattttccccttcccctcaccctatccctgaaaccttcctctagagggttcttgcccacatgggggctctctccactggggtgcccccacctggtcattctcccctgtcctgagtttctagagagggctggagctccagctggcaatcaaaatatcttgccatccggctacatacaagacagccttgaaccaatgtccctttgggtcaagaggttagaaggatggtccagctccccagaagggcaggtggggtggaggaagttagctgaaaccttcaatcaccagtaagagagctgtagggacagactccaacagcctgttctcctggctggcaggaagatggggcatggggtgttcatgggacatcaggacccttgcagtagccaaacagcccccagccctccctaccagctgtttgatcttggacaacttgcgctatctcttctcatgtagagtggggctaaccattgcaaccaacctcagacacttgcaagactcacagtgatgcatgcactcaaaagacattcattgagcacctactgtgtgcctggtgtgattataagtgctggagacagaacgagaaggaggggtgccaaacaaaacagaccaagaatacagagtgtctgctcccatagagctgacattctaaggagagagacgggaactttttacaagtaaaagcatcaacaggccgggcatggtggctcacgcctgtaatctcagcactttgggagaccaaggcaggtggatcacttgaggtcaggagttcgagaccagcctggccaacatggtgaaactctgtccctactaaaaatacaaaaattagccgggcacggtggcaggtgcctgtaatcccagctactcaggaggctgaggcaagagaatcacttgattctcaggaggcgagaggttgtagtaagccaagattgtgccactgccctccagcctgggcgacagagtgaaactctgtctcaaaaagaaaaggaagaaaaagaaagaaagaaacgtgaagtgcttggcacagaacctgccaggaaaccaggagtttgaaaatggtggttgttaactattactgctgttgttattgttattgtgaatgggtgtgtagttttgttagccagccctgagttacagtcaatttgagggaaagatagggggtgggtgtttgggtccttctgggacaattaactcccaacctggagtagggagaggcatgtcctggcaggcaaggaggtctcagttgcccctttctgcctcccaggtaagcccactagttctgaggccagggcttggccaggctgagacaggaaatgccagatgcttgggcgggcaggtccctggggtttagggggcagagggcatgcggcagtactaaccagtgctgtctcagctgctgcccccaagtggctggggtgatgtgggtttgccctgtgtgcaatggataatgactgtgtttcttgtcttgtctcttttcatgcctgctcttaaaactgtatattggcgcaacgccgtctgaaaaactcatccaatcaaaatgcactatgaaattcatttgttcatccatgacatggtctgtgtgttcatacaccaatgacttatctcccaacccaccgccaccaccacccccactccccgcccgggaaccgaaacccattggttttttggcactggttacaaatcaacctaaaaaatgctgaacacgcctccccaactgcccccgcccgcccgctccccctcatcttcaacatctgcatctagaatccggttggtcttacttctttctgaagtctaaatgccttacattaactgtgaacgcatctcctcgcgtcggcattgcatgccacaccctgcctctccaacgtgggatgcctgacgctctcctcaaccctccgctctcctctgtctgtctgtcctcccgcccccagcccctgtgcctcccacttcctgtagactctgtctctctgtttttatcgggttctgaatgggggttttctgtttggggtggtttgcgtcttttgcagagaaagggatgggttttcccagcgcagcacctctctcttgccccatcccgcacacacatcccctacactcagagacaatagaggcaaatccactcccagccacctctcaccactcctgtcccccattcagctccatggaccccaggccccaggaaagctgccaactgtctcctcgcccctccagctctctccatcctgctgtccccaatcctccatctcaagcccacaagatctttggccttgaccagcagagacttgactctccaagtctgataaaggagacctgaaggccaggcagtgtgccggcaaagactctcaggcagaggaactcagaagtgccagacttggatctggtagcttcatgtggggctggcccactgaggccctctcctggagccttgaactgtacgtgcacacgcagtcacacagtcactgcacacagacactgcacacacagtcactgtgcacacactcagtcactgcgcacacactgtgcacacagtcactgcacacagacgctgcacgcagtcactgcagtcactgcacacagtcactatgcacacacagtcactgcacacagacactgcacacacagtcactatccacacacacagtcactgcgcagacactgcacacacactgcacacacacaatcactgcgcacacacagtcactgcacgcagaaactggacacacagtcactatgcacacactgcacacaccactatgcacacacactgtgcacagtcactatgtacacacactggcactgcatgtagtcactatggacacacactgcacagtcactgtgcacacatacactgcacacactgtcactatgcaaacacagtcactgcacacagtcactatgcacacacactgcacacacagtcactgcacacagagccactatgcatgcacacacagtctgcattcacacattgaacacacagtcgctatacacacacagtcactgcacacacagtctatgcacccacacactgaacacacagtcactgcatgtacagacactgcacatagtcatgacctcttctctttttctcactcattctccaattctctctctctctcgctcttttttttttttttttttagacagagtctcgctctgtcacccaggctggcgtgcagtggcacaatgtcagctaactgcaacctctgcctccccgtttcaagcaattatgatgcctcagcctcctgagtacctgggattacaagcatgtaccaccacgccaggccacttcttgtatttttagtagagacagggtttcaccatgttggccaggctggtctcgaactcctgacctcaagtgatgcacccgcctcagcctcccaaagtgttgggattacaggtgtgagccactacacctggcctctaatcctcattcactgttcctgtctctgtgtctctcacatacagtcatgcatgcatgcacgcatgcacacacacacacactggccctctctgctacatctacccaccctgtacccccactccagtacatactgcacacatctctctccctcccccacttctcagccccttgcacaccccttgttctgttaaatctcaactgcctctgcccctctcctacccaccaatgaggcccttagagggacgccccaatggcatctttgccctggaatcatcccttccctgctggcaatacacatgcattcacccaccaaacatttaatgagcccctatttggtgccacagatggaattatgggcagaagcagacaccattactgtcccctcttaccacatacagtcaggtgggggaggcaggcatcggtcaaataaccccttgactccacttaaaattatacctgcactgcgagctgaaggatgagcagcattaacaaggcagagagagatgcacagagcattccaggcccaggacagcacatgcaaaggccctgtggtgggacggaacctgtgaggggtcaggatctgcaagcgagggaatgtggctgatgcaaagacagccgagaaaggctggcctggagacagccgaagaaggcagaaggggacaggacccggggctggggagggcggggctatattgtggaatatgggctttctcctaagcaccaggaagggcctgggaggataggaagcaggggaggcgcgactggtcatgtgactagacaagctcgctctggttgcagggcagggaacagcttgacaggaggctgggctggaggtgggcaccaggaatcgcagcaagagatgacagtggaggagagagaacagtgggagggttgtcctctgcaggacccagggaaagatcaggtctgaactgagatgaggtgcctgggagcagtcgggtctggcttaaaactgggagataggctgagcacggtgactcaagcctctaatcccagcactttgggaggctgaggcaggaagatcacctgaggtcaggagttcgagaccagcctgaccaacatggtgaaaccccatctctcctaaaaaatacaaaaattagccaggcgtggtggcaggtgcctgtaatcccagatcctcaggaggccgagacaggagaatcacttaaacctgggaggtggaggttgcagtgagccgaggtcgtgccattgcactccagcctgggcaacagagtgagactctcttaaaaaaaaaatactgggtgatagaggtgagcgagtgcaaggaaaggaccaggttgggggaagagaataggtgtgggcatagcaagtttgaggtgcctttaggacatcccgaaataagtcagataggcaggtgttgtgggggctgcagcttggagctgaggtctacaagtagtaggacttttctggagcccttaggtgggtggtctccatatccttctgagcacttgaggaacatctgagcacagcactggaaaagaaaagaccacaaggacgctgtcctcatgtcttccaggggctgtgtcccacccccatcacattctagccaggaagttcaggggaggtgttgaagagaggaagctgcacctcccaagccatggattgaaatgtggaaggcaggaagagggaacttgtcagaagttctgggggcagtggaaagaattggtactgatgcaggaagagatggagggtggatgagggcagactagtacccttcccccactgccccaaacccttcccgtctccacccctacctgcctcatgtgtctcctcccccacttggctccaagaagggaagcatgttttctgcacgcatctccctgccagatccctggcttttttgcatggttgcaagcttcccctgctctcctccaaacccccctcctgaggctgcttccagggtccgcctgccttcgcatgcctggccgagtccacatgttatgatccgccccatgaaagggatggcttgtactctggggttgaacgggagggggctggggatacctgagccatcggccccatccccaggtggagctgggtggccaggcagggatgggggtcagggcagcagggcacagagagtgactctgttagccaagctgggtttggggcttgttcgaggcactggagacattctcacagcacttgagcccagtgtggtcagggtaggatcccccagcccccttccccatcctagaggcctaaggacgcactgatgtgtcccagagagcatcctagacattgccatcaaacccagaggcctcagaaattccttgaactccagtccttgcctctcagctcccaggccaaagccagcacaagacacagatctggcagccagaaagccctctggaagccaccaagtaggatgcccatgtcacccaaactaggacacttttgaaacaggagggaggctgtgactgtatggtcaccctgtgccatttggggggtgaaggttagaccaagttaaatcttgctacgtggcctgtagcaaatcctacaaatcccatagaacaagtctgattaagccccttcccttagtgtggagagaccctctactcctcctgccttcaccctgctgggtactggccagcgaaggagggtttccatgtctgcctgaggctggggtctcaaactcaaatgcctctgggggccaggcagacaccagtcaaccaggaaagcaagtgccatttctaaaacgtgaggaccctggaaaactggagatcatgtggcctgcttccagggagcaatcgcagcaggcctggggttgccagaaagccagattggtgggcaaaatctcttgatttttaaacaatggcaataatttttaattaaaaacaaggacaaatgaaaaaacactgctcgggcccaacaaaacagttttattagctagatttggcccactcgtgacttcgagagtcccaccccccccaccaaggtcccttgaagccccacaatggccacttaactctagctggtctcctccctgactctccaactctctggccccctggttcttctagcttgggtgggaggaggcagaggcagtgactagacagggggtttttgagcagaggcagtggccacccagggaggtcctgggggcagggatggccccacctcccggcccccagcacccgccccttggtgggcccgggctgatttctgagctcacccacccatgggagctgagtgcttcctgcttcctgcaggcctggtcccgtgctactccacccagccccagaagctgagaagccatccctgagaggggggaaaagggccccaaatgcatcttctccgactcagcgggcagcgaggactcaccctgcagccgaacagtcccagctccctcccgtcctccccattcccgctcgccaagggggtaagaaaagatgctcttccgcttctcccaattggctcgagccgctgctcctcttggccgtggggtgaggtcagggcgggcaggagcgggtgggcagctcggcagggcagggcagggcagggtgcccggtgagtcccgtgacagatgcatttctggcccggagcgtaacatgccctcggaacccgcacatgtccaccaggcctgactgtgctggcgacctccacccccacccccgccctggtgtttgtgcatcgtacacgtatgatagattccgcaacttgaccggcttgtgtcctttcgtctcagtgcatttggttgttgggagaaacaaaaaccatctcgatttttttcctgattggatgattcggatatattttctttttcttgttcttttgttatttcttccccatccccgttcctttttcctcctttctttttcttttcttttccccattgtgggtggggctggcagggagggcttatgcttttgagttgatgccttttcctccctcccaccctctctctcccaacattattcctttttcgagtttttcctctgcatcattgcattaatagtgctttctctctccctccttatttggggtctggcttgcttttttcctgttggttggcttcatgtaggggcctctgtgagtggtgacagctctgagccttttggggtgggtggatggtcacccctcttcctccatctccccagaataacttcatcaacctgagctttctccgcctcttccgagctgcccggctcatcaaacttctccgtcagggttacaccatccgcattcttctctggacctttgtgcagtccttcaaggtgagtcctcgtccctgctgctggcccagggctgagaagacaggtgaccctcatgctctggctgaatgtagaagtcagattggaagtgcctctgtgatgtagtcgtgcagagaatctgttatctccaaggctgttgtcaaacttcctgtccctggtgtgtcttcagagctgtaagggcctcatcctagagcccccagagatgcccaccagccctggaaggactctggcacgtggcatatggccacccaacccagtggggcagagcactgggacaagggaggaagacagtgcggctgagggacccccagcactcttcttcattgccttttttcccaccaggccctgccttatgtctgtctgctgatcgccatgctcttcttcatctatgccatcattgggatgcaggtgagtgtcgtgtccctaaggttcccagagcctcccaaggagggcagccacccttagaaaggggtgggtcagaggagcctggttcacagaagcagccatggaggttgagctgggtttcccagaagccactggaggaatggcagcccctggtcgtcaccctccaattccacaggtgtttggtaacattggcatcgacgtggaggacgaggacagtgatgaagatgagttccaaatcactgagcacaataacttccggaccttcttccaggccctcatgcttctcttccggtgagaaggggacctgctctgataattctgtttccgtggggtggggtgcctgccttcatccttctgttcccatagaggatgtaccctcctcttccaatgcaagacgtgccctcctccttctcttctggcaggggcgcgccctcacccttcttttccggtagggggcgtgcccttctcttccggtaggggacgtgccggccttctcttccgatagggggcgtgccctcctcctccttttctggtgtgggggtggccagatgtgctcttatccttcttttcccgtgaggctggaaatgggtgtcgtggggggcccaggaatcctagcagggcagaagcagagggccctgggacatagtcatcaaggtcattttccaggcattatctctgaatcttcctgaccaccctgtgaggaagggattcttggcagccctatccgacaaataagaaaacaggcttacagaccgtgaggcttgattctttggttcatcatcttggctgcacacaaaagttccttcactcgttcagtgtaggttttttgggggggctttttttttttttttttttttttttggagatggagtctcgctctgttccccaggctggagtacagtggcgcgatctcggctcactgcaagctccgcctcccgggttcacgccattctcctgcctcagcctcccgagtagctgggactacaggcgcccgccaccacgcccagataatttttttgtatttttagtagagtcggggtttcaccatgttagccaggatggtctcgatctcctgacctcgtgatccgcccgcctcggcctcccaaagtgctgggattacaggcgtgagccaccgtgcccagcccttttttttttttttttttagatggagtctctctctgttgcccaggctggagtgcagtggcgccatctcggctcactgcaagctcctcttgtggaggtgtattgagcacctacagcatgccaggcagggctgaaaaacgaggatgcaccaggaaatagagaaaagagacattttaagcactttggaagctaacatccccatggggaagacgaataatcaggaaacaaattatagaggatgctggaaaaagataaaattcaagaataaaggggaatagggccaggtgcagtgactcgtgcctgtaatcctagcattttgggaggccgaggtgggaggatcgctttagcccaggagtttgagaccagcctgggcaacatagtgagaccccgtctctacaaaaaaattgtttttaattaactgggcatagtgccacacacctgtagtcccagctacttgggaggctgaggcaggaggattgctcgagcccaggagttccaggctacagtaagctatgattgtgccactgcactccagcctcggcaacagagcgagactctgtctctaaaaagaaaaatatatttttttaatttttaaaaaaagttacagaggtagatagtggtgatagttgcataataatgtgagcttacttaatgctactgaattgtacacttcaaaatggttaaattgataaacttcatgctgtgtgtattttgccacagtaaaaaataataatgtttttaatctaacaacaaaaaaagaatagagggccggcaggttatgcctctctgaaagtgtgacatttgagagaaattggcaagggagggagtcagtgggtatatggggaagggcaggccaagccgaggggactgcctgtgtaaaggccctgaggcaggagtatggctggcatgtttgaggactgtgaggagcccagcatacctagaacagagtgatctagggagaatatagtatgagatgactgtcaccttcatggaggggagcttttttttttttttaatctgagacagagtttcggtcttgttgcccaggctggagtgcagtggtgcgatctcggctcggcgcaacttctgcctcccaggttcaagcagttctcctgcctcagcctcccgagtagctgagattataggtgcccgtcaccacgcccagctaatttttgtatttttagtagagacggggttttgccatgttggtcaggccgttctcaaactcctgacctcaggtgatccacccgcctcagccacccaaagtgctgggattacaggcatgagccactgcacccggcctgaagggagcttttttttttttttgcttttttttgagacagaatctccctctttgtcacccaggctggagtgcagtggcgcgatctcagctcactgcaacctccgcctcctgggttcaagcgattttcctgcctcagcctcccaagtagctgagactacaggtgagcgccaccacaccgagcaaatttttggtatttttagtagagatagggtttcaccatgttagccaggatggtctcaatctcctgacctcgtgatccacccacctcagcctcccaaagtgctgggattacaggtgtgagccaccgcgcccagccaagaggggagcttttaaagcataacagtgaccagcctgagcaatgcagtgaaaccccatctctacaaaaaaaaatagtttaaaaattagccaggagtggtggcgtgtgcctgtagtccccagctactcaggaggccgaggcgggaggatcacctgagcctgggaagttgaggctgcagtgagcagtgattgtgccactacactccaacctgggtaacagagcaagaccctgtcaaaaaaaaaaaagagagagagagagaaaagaaaggaaaagaaagagagagagaaggaaaagaaaagaaaaaaacatatcagtgtcctcaaatcccaccctagaccaactgaatccaagtctgctggggtggggcacgggcattggtattttttcaaagctctctgtggacttcagtgcacagccaagaatgtgaattcccttctctcagctcccagtaaaaggaggtggtccacctggggcttgcctggccagctccagagcccaagtgctcaacgtgtgtgctccacctcctggggaggcgttggtacccagtcagggctgggtgtccgagtctctgatttctccctgtcctcaggagtgccaccggggaagcttggcacaacatcatgctttcctgcctcagcgggaaaccgtgtgataagaactctggcatcctgactcgagagtgtggcaatgaatttgcttatttttactttgtttccttcatcttcctctgctcgtttctggtgagtctgtggacactgtgagggccgtctgggctccctaagcctggcttcctttcaggggagtgggtttctgtggaatgtggctgtgtcgaaggcttgttccctccaaggcttctctgaaccagcctgggatcaggtgaccctgagcgtctcaaactcagcactgttgacatttgggggtggctgattctttggggtggggccatcatgtgcactgcagtgtatggcagcatccctgtcctccccccaccagatgctggcagcacacgccacccgttcctcctgttgtgacaaccaaaaatgtctccggacattgccaggtgcccccagggggtgggggtggggttgggagtgggggccagaattcccccatttgagactcaatgaaatatttcagctgggcgtagtggccgatgcctgtaatcccaacacttcgggaggctgaggtgggagggtcacttgagcccaggaatacaagaccagcctggacagcatggtgtgaaacccatctctttaaaaaaaaaaaaaaaaattgaattagctgcacacgtggtgctgtgcacctgcagtcccagctactcaggaggctgaggtgggaggatcacttgagccttggaggtcgaggctgcagtgagccatgatcacaccactgcaccccagccagggcgacagaatgagatcctgtctcaaaaacaaacaaaaacaaacaaaaaaaaaaaaaacattgcgagggaagaaatacctcactttggccttgttgggggcagatgtgggaggatttggggtcacagtggttctcttggtgttggtccctgtttcagaagcctcccctccctctcactgactctgtttctttccatcattcttggtctttgtctctctctctcttttttttttttctttgaaatggagtctcactctgttgcccaggctaaagtgcagtggcgagacctcagctcactgcagcctccacctcccaggttcaaccgattcttcagcttcaacctcccaagtagctgggattacaggtgcacatgccaccacacccagctaatttttgtatttttagtagagacagtgtttcaccatgttgaccaggctggtctcaaactcctgacctcaagtgatctgtccacctcggcctcccaaagtgctgggattacaggcgtgatccaccgtgcccggccagtctttgtctctttgtatctctctctctccatctctctctgtttctctcttcctcttccccatctctccacttgatctctctctcactggacctccttgtgtgagtgagcatcacctctccattccccagtctctttctgtctctgtctcatttcctttccccatcttctctctatccctctctccatctgggcctctgtgtacatgtctttgggtctgtctgtccgtctgtctgtctgtatccttctcactcactcattcattccctcggtctctgcccccattctctcttggtccccggggtccccacagatgctgaatctctttgtcgccgtcatcatggacaactttgagtacctcacccgagactcctccatcctgggcccccaccacctggatgagtacgtgcgtgtctgggccgagtatgaccccgcagcttggtaagaagtcaccccgaatcctccagccacaatactcacctctccctggaactggaacacgggctaggtcaggccccagactctggagcactgaactcctggggtcctagcaggggtctcacaggttcagtcaggagagaagatataagaatcatcacccttgcataccccagattaaacacgtagggtgccaaccctgcccaaaccctggactttctgggaaatgagggagggcgtcaaccatgagatgtcctgaagagccctctcctcctacgagtctctcctgtctctcactgtgaagtctccagatggtgaggatgcattagccaggctccagggagaaaaccaacagcatcccagcctcagttctcttgagagtgtggggaggagggctggcctacccttggcagacaggattggcagcaacatcagagtagcagaactcagctcccactgggacccgtgaacctgggagtgagaggacatacaggccaggggaggacgcagagcctcaggggcccatgcatctttgtggccacaaagggagtgggcgctcccatctgggtagacaccagaggggtccctctccactgacgggcaatggtttcagagggtgggttccaccttgtgcacgtgtattgagtgcccacccaacaccaagccttgaaggacactcagaggctttatctgaatacctggaacccaccagccactaactgaggatttagttcaggctggtcttggggcctgaagaagcattactggggggccctcagcagcctaagccccatcttcctctggcctcagcaccagagaggaggccgtcacgaggaaggtgggcaggaggtggtcttggctattcccatagcctcaaacaagtactccatgagaccgagaggctggggagagccgtgggtctggggctgggctttggctggttcctaactcttcctcttttgattttaggtcacagcaattggatgctgtccccaaggcctctattccacaagcccccccccacccctgtagcccatgtagactgtggaggaggcagatgcagagagagccccaggggaggtgccctgcagtcccgaactcgactgacatcctacacccctgggtctccccagtgtctgggaatgtactggggaccttcacttgtccccagtctctcccactccttcaagccagggacaccccagcctcgggcatcatgacctcgctgtgtgcccagggagcccgtgtgaacccattgcctgcactaaccccctttcttctcctttcagcggtcggattcattataaggatatgtacagtttattacgagtaatatctccccctctcggcttaggcaagaaatgtcctcatagggttgcttgcaaggtttgacttccactaaaacctgctagcatccatggaatgagtgtggcttggggttcttcaatatatatatttcatatatatatatatatatatctctctctctctctaaaaaaacagagccatctctctttcttgcattaaactagaaaactctcttagccaacagaatgcagtcatgtagactcgataaagcatggaacatatttcctccttcccttcagccttcagccatctttgcttgctcttagctgaagctgcccatcctggggtctccacggcaccccaaatcagatacatcccctgggggattgtaactttgcatttctcccccaaccatcacctccactctctccccctccacccctcacctcccaaagcccctagccctcctcccctccctggcactggcccctgctccccacctaggccccctcagagaccagcctcagccaaaccagagaacgtgacccaactgtagaaataacagtgatggccgggcgcagtggctcatgcctgtaatcccagcactttgggaggccaaagcaggaggatcgcttgagcccaggagtttgagaccagcctgggcaacatagcaagaacccccttctctataaaaaattagccaggcattgtggcgcatgcctgtagtcccagctacttgggaggctgaggcagaaggattgcttgagcccaggaggtggaggctgcagtgagctatgatcacaccactgcactccaacccaggcgacagagagagaccctgtctctttaaaaaaaaaaaaaaaaaaaaaaaaaggcaatgaacaaaagcatggctctacgtcttccaaagtgagaattctccctcccctccgcatccctccagaactgtagctcagagcccacgctgaatctgacttttctcttttctctctctctccctgctcccgagcagtgaagtaatctttttttactgaccttttcttccattttttttcctcctcttttccattgatttgaaatatctattttatcattctctgcatctttctctctctattttttcggctcgtgtggatttcttttttctttcttctgtttctccccacctctcttcctttggttctctgttcccattcccgttttgtttttttgtttttgtttttgtttttttcattttcggtgctgccaggggccgcatgccttacctggacatgtatcagatgctgagacacatgtctccgcccctgggtctggggaagaagtgtccggccagagtggcttacaaggtagactacccttgccgaccaccgacgtccaggcactgggtttttttttcttcttcttcttctttttttttagtgctgaccagaaacacccggccgactctctttttccaacgtttctcttcttttttgtttttgattcttttttttcttttctcgagtcaactgatcatgaccatcccttgattctaagcagcacactgtgtccgtcctttctgatgagtgtcttcgtgttttgagactccattatggccgacatgccggggggagggggaggggagcgcccaggtccccttgcacctggtctcccaggtaccaaattggaaacaaacacgcttcttcagggagtcaaaacccatgcttcccacttctgcccacccagagcggcccccatgcccaggctggggcaggcgccttgcagagaggggctttagcccccgaaagcaggcgaggtcccgggtccccgcccctgccacgcacacctgaagctgatctctgacctagggccttggggattcgagaccttccaaggagcaccaagaacctctcttcccctcccttccttcccctggagtttcgtccccagcccccgtccctaatccccccaagacaccccaacatgcctctccattgttccagagtgggcaggcggccgcagctggacccctggacggtggcacactgatgcaggccatgcacgctgccttggcggggcctggggcgggcaggcaccatggccgacggggggtggtgcatgctggctgagagagcgagcgtcctgccgccaagcggctggcccgggccacccctccagatccctgtcctggaatctcccttggtgcccaaggacagatgctctgttccctccattcatccacaagaagttcagggatgacctttaaagattctccccacccaaaaagtattaccccatcatcctattctcccatccaccttgatcttccctgcgtccctatccatcaatgctatttgtacctgccccgtgttgccacctcattcctttccttcctctgtgcacccctcctcacctaacctatatgtctcccctccttctcaatcaaagccggggacaaggttgtcccaccagcatctcagacaatgagcctctcctggcacctgtcgctctgtgcccctccctgccgcccccccccccccccccggttttcctcaagtcgcttctctcagtctctgcttagatgaatgtgtgcgcatgtgcaagagagggagggcgagcccttcctctcctggtctttgtgcaggaccaccatgggtccataagacaactttgtgcaaatttgaaaaaggcaccctttccacagaacatgcctgttggaaaattgttgcaatctaccaatgtggtgagaacaagacactttttttctatcacctgggaagctgttatatttaatatacaaatcgggggctgggcgtggtggctcatgcctgtaatcctagtgctttgggaggctgagacgggaggatcacttgagcccagttcgagactagcctgggcaacatagcgagaccccatctctacaaaaagaaaaaatattttaattaataaataagtacataaatctatcatttccaagatgggagccctttgtgcggtgtacaacctgcacaactgtgcacagtggcccagtctatgtgtgtttctctatttcccacctccttccccaccctacccccagtgtcccctccagtgtcctgctctggatttaccatacccctccccatcttcaactctgtgtttcctgcccacttgtgtctgaatccccacccaagttgccctcaccccccttctctgtgccacttcagcctgggctggtgcacaccagcccagcatcctctcccatgccaccaagcatggtggacagagcccctgcctgggacatggggaatcttttcttccctgggctggaagggagtgcccctcaccccttccccctgccattgcacagagagccaagatctggacatgcccctgagatacacttcccacggagctatgaatgagtctcgagattccgtctgcatgcgcccctgtctgtgctgttctgtgtcacagcctcgctgcatgcctgcgaggggcctgccccgtcagtggggggctgcctgcctgctgcttctcagaggaatgatgtggtctgtgcccatctgctctgtcctggtctgggccaagccagggattgggtgtggggagccagtggcaccccccaccagcggctgtggtcctggccccctcagccttggctgttgcatgcactgctcaaatccagcttgtgctctttttctttggggtcagactgaaacggggccatccagaagaactctggggcagggcgggggtggggcaagggttgaggcaaaccctggaaatgccagctctcaggtcaagcaggtgggggaaaaaaggagagggcaggggaccagaagtacaagagagccttttgtgccctccctgcgggccaccaagagaaactgagtactgggacaggtaacctaagtaagagacacctcagccgccacagctttcagagttcttcctgggactccctgggtaggggcgggcgcggctcacgggagacccaggagggatgcctgggaatgactgcgcttgccttgggttttctgtagcggcttctgcggatggacctgcccgtcgcagatgacaacaccgtccacttcaattccaccctcatggctctgatccgcacagccctggacatcaagattgccaagggtaaggaagggacaggggcgggcacagacaggcgtgacagggtggaaccggggatctccctccctaccccaaactagaggatctgctgtcaccacccggatcttcattcactcttccattcattcgttccacagggttttttggggtttggggttttggtgtttttttttttttttttttgagacagagtcttgctctgttgcccaggcagcagtgcggtgacatgatcgcaagtcactgcagccttgacctcccaggctcaagtgatccttccacctcagcctccccagtagctgggactacaggcacacaccaccatactcggctaatttttttttttttggtgtgacaatttccctctgtcacccaggctgaagtgcagtggtgtgatcttggctcattgctacctccgcctcccgggttcaagcgattctcctgcctcagcctcccaagtagctgggattataggtacccaccagcacacccggctaattttttatattttgggtagagatggggtttcaccatgttggccaggctggtctcgaactcctgacctctggtctcaaactcctgacctcaagtgatccacctgcctcgacctctcaaagtgctggattacaggcgtgagccaccatgcccaacctaattttttatattttttatagagatggggtttcatcaggttgcccaggctggtctcaaactcctgggctcaagcagtcctcccaccttggtctcccaaaatgctggtattacaggcatgagccaccacacccggcccatttggcagatatttagtgcactccttcaatgtgccagagacccgtccaagcaggggaggacccagcagcttacactttagatggatggggaggccgccactgaggaggtaaggcagtgtctcatggatccctggggggaaggtgctccaggcagaaggactggcaaaggccctgacagaggggtgaacacaggacacccggggcattgagctgactcaccttctgagtgagggcacgccacgcaggttcagagcagaggaggaacctgacccaactcacatttgaacaggttccctccggccactgaggggatgggagaccgaaaggaggccagtgtgggggctgctgatatcatctgggtggagacagggcggcagcttagatctaggggtaggctcgacgtggtggctcacgcctgtaatctcagcactttgggaggccaaggtgggtggattacttgaggtcaggatgaccagcctggccaatgtggtgaaacccccgtctctactaaaaatacaaaatttagccagacgtggtggtgggtactgtagtcccagctactagggaggatgaggcagaagaatcgcttgaacctgggaggcggaggttgcagtgagccgagatcacgccactgcactacagcctgggtgacagagcaagactctgtctcaaaaattaaattaaattaaattaactggacatggtggcatatgcctgtggtcccagctactcaggaggcagagatgagagtattgcttgaagccaggagtttgaggctgcagtgagtcatgatcgcaccactgcactccagcctgggcgacagaacgagatcctagctcaaaacaacagaaagaaaaagaaaaaaacattttttttaaagctgagaaggggctgggcgcagtggcttacgcctgtaatcccagcactttgggaggccaaggtgggtggatcacgaggtcaggagttcaagaccagcctggccaacatggtgaaaccccatctctaccaaaaatacaaaaagtagccgggtgtcatggtgggcgcctgtaaccccagctactccggaggctgaggcaggagaatcacttgaacctgggagacagaggttgcagtgagccaagatcgcgccactgaactccagcctggatgacagagcaagacgctgtctcaaaaaaaaaaaaagctgaggccgggcacgctggctcacgcctgtaatagcagcactttgggaggccgaggcgggcagatcatgaggtcaagaaatcgagaccatcctgggtaacacggtgaaaccccttctctactaaaaatacaaaaaattagctgggtgtggtggcacgcacctgtagtccctgctactcagaaggctgaggcaggagaattgcttgaacccgagaggcagaggttgcagcgagccgagcttgtgccactgcactccagcctgggtgacagagtgagacttcatctgaaaaaaaaaaaaaaaaaaagccgagaaggctggacatggtggctcacacctgtaatctcagcattttgttgaggccaggcacagtggttcacgcctgtaatctgagcacgctgggaggccgaggtgggtggatcatttgaggtcaggagttcgagatcagcctggccaacgtggcaaaaccctgtctctactaaaaatacaaaaattagccgggtgtcgtggcgtgtgcctgtaatcccagcactttgggaggctgaagcgggtggatcacttgaggtcaggagttcaagaccagcctggtcaacatggcaaaaccctgtctctactaaaaatacaaaaattagccaggtgtggtggcgggtacctgtaatcccagttactagggaggctgaggcagaagaatcacttgaacccgggaggcagagattgcagtgagccgagatcacatcactgcactttagcctgggcgacagagcaagactccatctcaaaaataaaaataaaaataaaaaataccgagaaattcccccaaagacctagctcagggctcactctccatcattagggggaaagaagaagaggaggccagggaggcgggcagagaccagggcagtgtgggctcctggaggcagcttctatgtttaaaagggcggcttcaggaggaaggggaccaaccgtgtcaggcactgcccagagaccaaggatgacaaggatcacaagtgactggtcatcatggtcactttgaccagtgcagctttggcggaggggtcaggggtcccctgtctggagtgcatttcggaggcccgaaaggggatgtgatgtgatttggcagctgattaaggacagcagggcagagagacaggcgcacaattgccagaagaaacggggacctgaggctcacgcctgtaatcccagcactttgggaggctgaggaaggtggatcacttgaggccaggaatttgagaccagcctggccaacatggcgaaaccccatctccactaaaaatacaaaaattagccaggcatggtggtgcacacctataatcccaacaacttgggaagctgagcacaagaattacttgaacctgggaggcagaggttgcagtgagccgagatcaaaccattgcactccagcctgggggacacagcaagactctgtctcaaaaaaaaaaaaaaaaagaaagaaagaaagaaaagaaaaaacaaatgggaccagaaaaaaggagtgggtgggagaggagcaggtggatagtcccacacatgggaaggtgctgagcccagctgaaaccactagtaagtcaggaggagggaagactgagcctcgagacatatgtgccttccagggtcttgagggaaagaagggaggaagagccaaggccacgtggcaagactcaaggaggaagtggcagggaaggtgggggactggaggggtggaggacagatattgttaatgccaggaacaaagtgaaggtaaagagagcacaaggaagttgggagcagtggctcacacctgtaatcccagcactttgggaagccaaggcaggaggatcacttgaggccaggagttcaagatcagcctggccaacacagagagaccccatctctacagaaaattttaaaattagccaggtgtggtgatgtgcacctgtagtcccaactacttgggaggctggagtgggaggatcactggggactgggatgtcaaggctgcagtgagctatatgatgaccacagacatagcagcttaagacacacctatttgtcagctcacagtcctgtaggtcagaagtccaaaaagctggactgggctgtctgctgagggtctcacgaggctgaaatcaaggtgtcagccaagctgggctcctctctggaggatctgggggagaatctacttccaggttcattcaggtgttggcagaattgaagtccttgtggctgtaggactgaggtcttgttttatcactggctttttagctttttgctcctggaagtgcatgtaatcctccatgtgctctcattctctctgacttccccatctgccacccagcagagacaatactgtgcttttcaagggctcacctgattggggcaggcctaccctgatcatctctgtattttgaggtcagctgacttgatattttttttttttcttgagacagaatttcactcttgttgccaaggctggagtataatagtgtgatctcagttcactgcaatctccgcctcccaggttcaagcaattctcctgcctcagcctcctgagtagctgagattacaggtgcccaccaccacgcccagctaaatttttttgtatttttagtagagatggggtttcacaaggttggccaggctggttttgaactcctgacctcaggtgatccacccgcctcagcctcccaaagtgctgggattacaggagtgagccaccatgcccagcattttctttctttttttttttttttttgaaacggagtcttgttctgtcacccaggctggagtgcagtggcgcaatctcggctcactgcaacctccatctcccgggttcaagtgattctgcctcagcctcccaagtaggtgggactacagatgcgtgccaccacgcccggataattttttgtatttttagtagaaacggggtttcaccatgatagcaggatggtctcgatctcccaacctcgtgatctgcccacctcggcctcccaaagtgctgggattacaggcgtgagccaccgcaccgggcctccggtattttaattatatctgcaaagtcccttcatagcctgggcaatggtccctagattagtgtttgaataaacagaatcttggcagaagggcagcttttgaattctgcctaccacagttccttcgtttgtacaacgggtctaacaacacccccactctttgtatgtaatgccatcgtaactcagcttctgtggcactctgagaatctgtgttcaggggtcccaaaaccacccacaggttcagtgattccctggaagaactcagaactgagaaaagtttttatactcacagtttattacagtgaaagaatatagattaaaatctgcaaagggccgggcacggtggctcacgcctgtaatcccagcactttgggagggcgaggtaggcagatcacttgaggtcacgagttcaagaccagcctgaccaacatggtgaaaccctgtctctactaaaaatacaaaaattagccaggcgtggtggctggcgccagtaatcccagctacttggaaggctaaggtaggagaatcacttgagcccaggaggcagaggttgcagtgagccgagatcccgccacttcactccaggctggacagagtgagactctattagaaaaaaaaaaaaaaaaaaaatctgcaaagggcctggcatggtggcttacgcctgtaatcctggcactttgggagggcaaggcgggcagatcacttgaggtcacaagtttgagaccagcctggccaacatggcgaaaccccgtctctaccaaaaatacaaaaattaggcatggtgccagacccctgtaatcccaactactcaggaggctgaggcaggagaatcgcttgaccctgggaggcagaggttgcagtgagctgagactgtgccattgcactccagcctgtgtgacaagatcaaaactctgtccaaaaagaaaattagccaggtgtggtggcatacacctgtagtcccagctactccagaggctgaggcacaagaatcctttcaacccaggagatagagctacattaagccaagatcacgccactgcactccagcctgggcaacagagcaagactctgtctcaaacaaacaaacaaattccaaaaacataaaatgcgcaaaggaagggcatctggggaagggtccaggagacaccaggtgcgagcttccagttgtctgcctccagtggagttgcacagacaacgcttaattctccctgcagtgtgtgacaacacgcaccgtgtactgccaaccagggaagctcacctgagccttggtgccccagggtttttattgagggtttgtcatataggcagggctgacgtagttactcagtctccagtccctccagaggtcaaactgataccacgtggcccaagaccccaacgataaatcgcattgttagaatgaactgtatggaaaattatccaggcgtggcggcgggcggctgtaatcccagctactggggaagctgaggcaggagaatcacttgaaactaggaggccgaggttgcagtgagccaagatcgcaccattgcactccagcctgggcaatagagcaaaaacaccatctcaaaataaataaataaatagaatgaactgtattggccgggtacagtgactcatgcctataatcccagcactttgggaggctgaggctggaggatcgtttgaggccaggagttcgagaccagcctaggcaacatagtgagaccctatctcttttttttaaaaaaaaaaaaaaaaaaaaaaaagaatgaactatacagtgtggcccaaggccccctgctaaataaagacactcttcaggcaggacatttcaaaggcttagagatcacctcccaggagcaagtcaatgggccagtcctttcatcggaatgtgcagggtttggacaacactagcctactgagctagtccttactgcttagcaccccagcttctatgacacctactggattcccttcctgagggtttcaaagactcctggagatgtctctgaatttggctgtcacagttgttacttgtaccccagatgccactcagttccctgaagacaatgatcccccagatttctcagccaggagcccctccacctcttgtcctcagtgggtgccaggcctcatcctggagttccacagctgagccaggctctcggggttacggaaggtcaagagggtgtggggacaacaatggaagagtgataacagtggcagccctttgagcagatgcgggtctcaggagaacataacgcgctttcttttcatagttcagctcactttctaagcacactgagcttcctttccagcaggctaaggggctgcaaagggggtacagattaacctcattcttcagattctcaaaaatggtgtcaccattcattgctggagactgggagaaagggggcaagtccatctcattctctctgtctctgtctctctctctctcttccctgtccatctgtttctctctcccacccacccctctgttctctctgcccagaagaatctctattttggttttggttttgtttgttttgtattgttttgagacggagtctcgttctgtcgcccaggctggagtgcagtggcgcagtctcaactcaccactgcagcctccacctcccaggttcaagcgattctcatgcctcagcctcccgagtagttgggattacaggcgcacgccaccacgcccagctaatttttgcatttttactagagactggtttcaccatgttgaccaggctggaccctatcctctttcaagccccccaccccaggcattgagggcagagccaactacctgcctgaaccaattagcatattaaacgtaaacccagttagcatatccaaatagcagcccacagtgacattctgactgtcagaatgtggattgcttgagcccaggagctcaaggcttcggtgaacaaagattgtgccacagcctgggcaacagagtaagtccctgtcgatcgatagatagatgatagatagatagatagatagatagatagatagatagatagatagatagataaatttttaaaaaaaataataggccaggcacagtggctcatgcctgtaatcccagcactttgggaggccgaggcaggcagatcacctgaggtcaggagttcgagaccagcctggccaacatggtgaaaccctgtctctacaaaaatataaaaatagccaggcagatgtctgtaatcccagctactcaggaggctgaggtaggagaatcgcttgaactctgaaggtggaggttgcagtgagccgagatcatgccattgcactccagcctgagtgacagagcgagactccatctcaaaaataataacaataataaaaataataataaatgctctggccccaaagtggcacattacatggtgcacaccccattagcaaggactcatcacatggccctgccaaccacaggaggaacccccccatgtactcaggtaggagggccaggaaacaccgtcagagagctttaatgactcaccccatgactggggtgagggacgagggactggctgcaggccaagggcatgtccgtggcagtggagacttgggaaaggggaaaagacctcctctgagccacgcacagtggctttcatctgtaattccagcactttgggaggctgaggtgggaggatcttgagcccaggaggtcgagactgcagtgagctatgtttgtgccacggcactctagcctgggcgacagagcaaaaccctgtctcaaaaatcaaaataaaaccaaaaccaaaacttcctctgttggggatgctccagggcgtcccagccttgaacagatgggtcactgcagtaataatcctatggcagacactgtcccaaggctgcacgcacgttactttgatcatcaaacaaccaggtgatagccaggcatggtggtgcgtgcctgtagtcccagctactcaggaagctgaagcgggagaatctcttgaacctgggaggcggaggtaacagtgagtcgagatcacatgactgcacttcagcctgggaacagagagagactctgtcaaaaaaaaaaaaaaaacaggccagacgcggtggctcacgcatgtaatcgccagcactttgggaggctgaggagggtggatcacctgaggtcaggagtttgagaccagcctggccaacatggtgaaaccccgtctctactaaaaatacaaaattagttgggcgtggtggtgcacacctgtaatcccagctactcgggaggctgaggcaggagaatcgcttgaacccaggaggcagaggttgcagtgagctgagattgcaccattgcactccagcctgggcaacaagagtgaaactccatctcaaaaaaaaaacaaaaaaaaaacaaccagccaggcgcggtggcttacgcctgtaatcccagcactttgggaggccgaggcgtgtggatcacccgaggttaggagttcgagaccagcttgaccaacatggtgaaactccgtctctactaaaaatacaaaaaattagccaggcatggtggtgcatgtctgtaatcccagctactcgggaagctgagacaggagaattgcttgaacccaggagtcggaggttgcagtgagccaagctcgtgccactgcactccagcctgggcaacagagcaagactctgtctaaaaaaaaaaaaaaaacacacacacacacacacaacaaccaggtgaggcaagtactcttgctatcatctccatttcacagatggagaaactgagttactaagtggtagagtaacctaagtcatgcagccgataactgggagacaagattgggacccaggtcgcccagctgttctccatgccgggctgtctcctgcacagctgctccatggtcctggccccaccgaaaaccagagcccacaaggtcattccagcagcactgcccagggcctcctctgggccaggccgttggggaactggagaccccatggggaccagaaagattggggtctcgttctcgggagcctatggctttgcagctgacccagagtccagctgacacccaggcaggcagtcagggtctgtctacacccccattgcaggaggagccgacaaacagcagatggacgctgagctgcggaaggagatgatggcgatttggcccaatctgtcccagaagacgctagacctgctggtcacacctcacaagtgtaagagctgagcccagccctgggatccaatccaccaggacagatggagggggagggaaaggggaggcctggggagagtgttggcctgggctggtatacacagggacccaggacaagggccccaaagaggcctgcccttggtgagctcaccgtgtgtgtgcccccagccacggacctcaccgtggggaagatctacgcagccatgatgatcatggagtactaccggcagagcaaggccaagaagctgcaggccatgcgcgaggagcaggtgcgctgttcgccgctctggggacatctgggctggggacagtggcttgcatgtcaccacgggaaccaactggaatatgagggtggctgagccccagggcaggtccctgaaaagtaggggctgtgcacagcagctcacacctgcaatctcagtgctttgagaggccagggcagagggatcgtttgagaccaggatgagaccaccctgggcaacacagtgagactccatctctacaaaataaaacattagccaggcatggtggtgcacacctgtagtcccagctatttaggaggccaagatgggaggatcacttgaggccaggagtgggagaccagtctgggcaacatagaaagacccatatctctacaaaaaaaaaataaaattagctgcatgtggcgccatgcacctgtggtcccagctacttgggaggctgaggcaggagaatcacttgaacctgggaggtggaggttgcagcaagccaagatcaagccactgcactccagcccgggtgataagagcaggactctatctcaaaaaaaaaaaaaaaaaaaaaaaaaaaagttcttgccaaggacacatcatgtggattcattcttcattcagctgctccaccaacacttattgagtattactgtgtgcagggcgctgttctcagtcctcggggatgcacccatggggaaaataggccagaatccctgccctcagggagcagacattccaagtggggaaatgccaatggtagcaaatgactgaatcgtgcaacatccagcaaagagaaagaaagtgtcgtgggggaaagtggagaagaatccagaagataggagtatccaggggaggaggggatgcggtgggaaatgggtagttggggagcctccctgagaaagtgacatgtgagcaaaggcttgaaggaaaaggggagagggagtgagctaagcaatacctggaagggtgttccaggcagaggaaacagccagtgcaaaggctctgaggctggaccgtgcctgggttgtttgggtaacagcaaagaggccagtgtggtggaaaagagcagggaggagacaagggcaaggaggtgacagggcagatccttcagggccatgggagctgcaggaaggactctggctttttccccaagcaagtgggagccatggagggttctaagcaaaggagggataggacctgactcaagtgctcatgggcgccctctggtggctcttgtggaacagtggggttgaaggtaggagcgggagacctgggagaaggtgcctgcagtgagagatgaggacgtgggaccaggctggggctatgacttgggtggaggagtgagaagtggtccagttctgcgtggaattggaagggtctagatggatgagacctgagagagtgtgtgtgtgtgtgtgtgtgtatactggggatgtcgcaatgccttctgggtaccaccgtcccaccaccccacccttgtccacacactgctctctgccccattccccaggaccggacacccctcatgttccagcgcatggagcccccgtccccaacgcaggaagggggacctggccagaacgccctcccctccacccagctggacccaggaggagccctgtgagtgtcacccctgccagggaggtggagtgtgggggtgccgtggtccccacgttctggaagctgcccaagcgcccactgctaccccggcctctgtcccccatgcaggatggctcacgaaagcggcctcaaggagagcccgtcctgggtgacccagcgtgcccaggagatgttccagaagacgggcacatggagtccggaacaaggcccccctaccgacatgcccaacagccagcctaactctcaggtgcctctgtcccccaactccccaatggctcccagggcccgggtggttcaggtggaagggatctgggccccccacacacacacacctgcagctccctccctctgcagacaccagggatctggaggtcaggccccagagctcatctggctttgccatctgctccgcagtccgtggagatgcgagagatgggcagagatggctactccgacagcgagcactacctccccatggaaggccagggccgggctgcctccatgccccgcctccctgcagagaaccaggtgagggctttcaccactgccctggggctggacccctcactctgcactgggtagggccaggcccccccacaagcagcccagtgcatcccctccctgccggactcaggcctgggtagggactccttcagtctctgaagcagtctgcaggccccacccaccacctggtcacacctggagcacctgcagaccctcctccctcacagaggacagagaggaaagtgctccccctggggcagagggcagtggccactgcaaaatggtctctggctgccctggttggaggctgcagacaggggaggttgtggaagatttgtgggtgcagcagggttcaacagggccagctgagacctgccacgaagatcacccctacacaaacacacacacacatgctcaacatacatgcacacacatgtgcagctgtgcgcctactcagatgcttgcatacacacacgtgtgtgcacgtgggcatatacacactgcacatgtactcacacatgcacacatgtacgtgcacacgtgtctgcatatgggaacttggcaggtcctaggatacagtagcagagtctggggtgggtctgggggcagctgggctcgtattttctgtctggtctctgtgggagtcattggggggcacaggggtgtgtgcttgatgtgtgtctgtgtgtggccgcttcacccagctgccaggcccacctgcaggtgatcccgttgccttggactcatgggacagagggcccagaggcatagctggctgcccacccggcctgaacagcgggggcccatgcacgcagcccgcctctggaggagaacagggcatggctgtgagagcctggcccgggtgcgtggcatgtgtggctgtggcgagctttccgtgtgccgtgtgtggcgtctgcacggggcaggaggctgtgctgtgcctggctggaccagggtcacctgagggcctggcctctggctgctgggaacgtgggttggggagcacccagcgtgcatgctgctgctccctcaggaccgagctgctgggccccaggagagggttgggacaagcccagctgacggccaccacatggaagctttgagcatcggccggagccaggggttggggtgtgcatcgcatgaggcagagcccagggccaggggctcgaggctgcgccgtcctgtctttcggtcccatgcctctgccatttgtctgtctgcatctcctgtctgtctcctctgtacccatgggaatagaggacgcccagccccgggggcctgggacacccacccgccaggactttaacttttcttttcctccctgccttctccctccgatttctcttgatgccagtgccactcccctccttggcttcttctccatgcaccacctcctcactctccctcttgccttttatatttattttcttctttctgttttttctgtgtgcaccatcccatggggctgtgacagaggagaaggggccggccacgtgggaataacctcagtgtatgtaccgcgcctgcccagcgcccagcagggctccggccccctcttcctccccaccccccctccagggagtcccgtcatctctcaccgtccccggaccccaccctttctttggcaatcgcaccctctcccctccatggagcccaatccttgtgtgtggtgtcctgtgtgtgcccctcacccataagccctggtgggcggggccatccccatcctcacccctacccccttttcttcagggccccccacgccggaggacactggctctccaagagcctggcccactctgcacctctttctggggggcttcttctcctgacaccaccaccaacccctggtcctgcagctcctacctggagcagggccaccagcgctcagctgggctggaccctgggaggcgggcgtctgccccatctccctccttccctcctctgcctgctgcagagaaacctgtgtgtcagggcttgacccagggatgaagcaccagggaaaagagtgggcccccagagcctccagtgcctgggtatcccccacccccacccagagctccctagcttgggcctcaccagaaggactcagacttgtgggggcagcgagcacagccccgttagccgggaggacccaaagctgccatgccgggcacctggtcctgagcccataggtcagccagccacagtcggaggcttctcaccctcccaggagagcaagctggggcagggatgagtgcggcagtccagggctcccaggtttgcaccctggatgtggagagggcttccctctggccagcctgagcctgcccaactgtggctgggcccccaggactggagagtgaggatcagatctttctggtcagaacccaggatgggctcaaaaggagcagtcctgtctctgagggacagaggaatcctcaggctccaccctcagaggcctggccacacccagagccctgattgatcagggggagccaaggccccatggcatcccctggcccctgccccaggatggtcacaccgcagtcaccgaaggccaccaccaggctgccacaatggggcaggaaggaccgggaccacttggtgctagctgctgaccccagcccaccggcctgtcccctcccccagaccatctcagacaccagccccatgaagcgttcagcctccgtgctgggccccaaggcccgacgcctggacgattactcgctggagcgggtcccgcccgaggagaaccagcggcaccaccagcggcgccgcgaccgcagccaccgcgcctctgagcgctccctgggccgctacaccgatgtggacacaggtgggcagccctgtggtgctcagggacaagcagaacagaggagaggagaggggaggagaaggcagggcggaggagacactaaggaagaagaaagggagaggcctccatggagaggggacagagggggccaggcagcagctgcaggaacctgggtactaccccctccccccaacccactgacctgcctcggttcaggggatctctagggcccccacaccttccaggtggcctcctgtgtgtgcatctgccccacctctccctcacgaccacctgtgtgtctgtctgaccctcacccggcccaggcttggggacagacctgagcatgaccacccaatccggggacctgccgtcgaaggagcgggaccaggagcggggccggcccaaggatcggaagcatcgacagcaccaccaccaccaccaccaccaccaccatcccccgccccccgacaaggaccgctatgcccaggaacggccggaccacggccgggcacgggctcgggaccagcgctggtcccgctcgcccagcgagggccgagagcacatggcgcaccggcaggtgggtgcggctgcaagtgaccccaggctgggctcggccgggaggcggggaggagagaaggggataccccatccaacagccactctaggcaaaggtccccggatcccggctgtgaccacctcccatcctgcccccaagccaccggggtgcccggcggccggagcggacacggatccccaccacaccagctgcctatgctgtccccccagcccccttgcccacccgccgccccctccccgccgcccgcagctgcttgctcctcggttgtggatcatatttgagttctgggccgtgccgcccgacctttcactttcctttaacccggcttctgtttttgtttcaattatgatttctgtcctctggacgcctgtgagtaatttttgaaacttctgctatttttaaccccgaaacttacaaaactccatttctcatttctcttttcactttgttgtgttggttttcgactcctcccctccctgtctcactccccctcctcccctccctcctccctgtggctgttgcttttttccattcaatgtcctgtgtcccccctctcctcctcctcctcctcctccccctccccctcctccctctcctcccggcccctctcccttcgctcccctctcttcctcccaatcccgtgtctcctttgattttgttgtatctttttttttgatttcctttgtttcaattttcgtgtagggcagtagttccgtaagtggaagcccagccccctcaacatctggtaccagcactccgcggcggggccgccgccagctcccccagaccccctccaccccccggccacacgtgtcctattcccctgtgatccgtaaggccggcggctcggggcccccgcagcagcagcagcagcagcagcagcagcagcagcagcaggcggtggccaggccgggccgggcggccaccagcggccctcggaggtacccaggccccacggccgagcctctggccggagatcggccgcccacggggggccacagcagcggccgctcgcccaggatggagaggcgggtcccaggcccggcccggagcgagtcccccagggcctgtcgacacggcggggcccggtggccggcatctggcccgcacgtgtccgaggggcccccgggtccccggcaccatggctactaccggggctccgactacgacgaggccgatggcccgggcagcgggggcggcgaggaggccatggccggggcctacgacgcgccaccccccgtacgacacgcgtcctcgggcgccaccgggcgctcgcccaggactccccgggcctcgggcccggcctgcgcctcgccttctcggcacggccggcgactccccaacggctactacccggcgcacggactggccaggccccgcgggccgggctccaggaagggcctgcacgaaccctacagcgagagtgacgatgattggtgctaagcccgggcgaggtggcgcccgcccggccccccacgcaccccacgcacacaccccacccgaggagccgcgcagaggccgcgggggcccagcacagagggcccgggagagggccagccgggagaccccagactctggagaggccagggctgggccacaagggtgtcccgcagagaccctcggccaaaagagaccctcctgggcagccacggcgccccccaaccagccccgatccccccacccacgacaggggctctcgggtgggaggcagggagcagacaaaccacacagccaagggatttgaattaactcagccatttttggagaactttggggaacatgaaaaaaaaaaaaaaaaaaaaaaaaaaaaacatttttaaaagaaaaaacggggagaaaaaaatagcttctattgatgagttttatcatctcaattgaatctttcctttccctgatgaagacagctggtggccgagtgcggcaaagaagccagaaggaaccagaatcccagtgccctacacccaccaccagacacactcacacccacacacgttctcagacacacacaagagtgcttgccggttataccaaaccctactattactgcctgcagaaatcaatttaaaaaaataataataacaataaacaattttaaaaaggacaaaaaaattaatgattgagaaaagaggcatttttttctgacatttggtcctgcttgaaacaacaaaagaagaagaaaaacccaccatcaccaccgattcctttgcttcttttttccttttttcctaccttgtttgaaaaccgtgggcttgggactgtgaattattgcatgacattcaaaaagaaaaaaaaaataaaaaaaagttgaatcaaa

SEQ ID NO: 4 - DNA, 127817 bp, Homo sapiens
  source 1..127817: mol_type = genomic DNA
ccctgggatggaggatctgtctctctctctctctctcctttttttttttttggtggagatgaaggggtgggtctatggtacatcacctgagttgtggggtaaatgtagagagtgtcaatcaaaggcagagctctcagagctgggaaggaggctctagatggcggctgtgccttagagagagcgcgctctgctccctgcctttgcctcactttacgcaactttccctaactttcgggcagcctcagggggcccccgtagccccctgcctttcctagggacttactggggtcgattcgaacctttttttgggagaaaagcagcttttaggagctttcttttcgtgccttgttggaaagaagcagccgtactgagagcccaggtcgttgttttttccagcttagaagccatggcgcacctccatttttgtgcgctctcctaatgaggttttttttctttcggacctgttttagtattaattattgctttatttttttgaccagttaacatatttgagggttattttatttatttttcgttttttaacggaggattttgcctttatttttaattatttgggatctgatatttttctactagtagataggactcttggtttggacatactacatggatcaggtaagttcacgatcattggtgataattttaaagatttatttgtttaagtttgccttgttttctgtaaatacgagaaattcttggatgacgcaataagatacagagattgttatttgtatctagtgtgctactttgagaaagtttccttattgatagtgatgcttccactgttcggtttatcctgttgttttttcttttaaggaaaaaatagaaatatttagttttttggtgcttaccgttgttgtgttataacaatatcgttaacatcgtcaggactttgttcctgataataaaaagcatcgatagaagccgggaccttacctttctttcaacttttgacagtaaatacctgggcacaggacttcaaagcaaacacagattccccctcccccttaatatttaagaattaaaagatgatgagaaataaggacaaaagccaagaggaggacagttcgctacacagcaatgcatcgaggtatgagctatcaactttcttcctttttgtctttttttttgggggagaaacctcagcttacaattgtttaccttgacagacatggattgctgtctgttttattgtgtttttctaatttggattcgttttttaaagcatgaccttgagattgctaatatgccacaccctaattttttggtagcaatttatgaaagttgagttgtgacttaaggcctcttacagcagtcaaaaggtaaggtacctttattcaaaggggcctttactgtaatgtacagtttttctgtcagtaaatttcagtttttaggtttttgtactgcagaaaaatgaccttgtcggtttagccattgctgcattgcaccattttacatacaaggcaaattttttctttgaagaatccaggatatctaaacttgtaactgagggccatagagaagccttgtagtagtaaattatagtaaatagacatatcagaaagttatatgaatgaaaaaatgtacatttaaaaacaaaatcacttaaaggaccctttgactgatgcctctcagtttatatttttatgtgactttatatttcttttgatacacttgacattttaggaaattttgatgtgatttatcaaaacctttacttgatggttagagttcctgcatttatgaaatcaaatctgtaataacagaaatcctggaatactcttaatatatacttctattttgtgtttgttactgtgattaatatttgcagttgtatattttacatttaaattattttaaggtttgcatttgtatgcttaagacattgatttcctgttggtagatgtattttatcctcacaatttagatgtagctgctttaaatttattgatgtatttcgacagagtcgtctggaatgctttatcttctgaagcttaaaaatgtactgtttgtgcaaatcatgatctgtttcacattccttggagtaccttgttagtgatgaagtaataaagcctctaagatgtttttgttgtatgacctctgtatattaatttttaaaagtacatatgaatgcattttttgatgtgttctttatgcattttcatattataaattttaaatcatgcagtttaacaaggatgtgattcattatgtggttttccttcccaatttttacttttctaatttttataaataatacacttttctattaggctagtgaatttgaaagttttgaacatgatgtgttactaatatgctgaattctatttattttatttgactgaaagcatattgagccttgctttagaaaataagttaccaaatttttttgcattgagttgtcacccagtttgtagtgctgtcttaattgaattgcccatgtaaattactagattaaattgaggacagaaaagttttttactcatcctaagctgtttttttctggaaagtaatgacaatttgaagaaatgagaacctccagatatatttggcaaattattaaagattcagcactaaaattgttgctcccttgagtgtatcatttgcataggtctcacatgggttttggctctcttatgcaaggtttgtggttaacatcattgatcagactgtgctttctaattctaaaaaattgagcagtgttggtattctttcagtatttttactctcacctggaaaactacctggaagttgtcaggcatttgcttactggtagtggaggttacagctgtacatgaagcatgtactgactgtacttttaaattggtttgtcaagtatactttgaatcatatacctgatggatgtccaaaaatatttaagactctttgaaaagaagatagttacttttaaattagttaccctaaatttcatatcttaatacatgtacataattatgacatcacttccttttaaaatgtgcagctgtagaatgttagtggtgttttaatgtggtagattaatattacttctactgagctgaactgtccctgtaattagtacttggttccttctgccatcagagtttttattgcccaaagtatagtgtttagggaatactacgaaaatcacctttgcagcctgagccacagaagaggaaatgagtttgcaggtcaagtaaactttggtctgagaattactttagtatctggaaagaatgagtgcaagtttaggtaaatctggtaataccctgtttttggaaatagtgcagtagttaatagtggttatataagtttgtattttaatttgaagttaatgctaaagtctgttatactttatcacgatttttgaaaattaaaaactttaaaaaacgcgattttaaaaacatttgattgatatttgtaaaatttctaagtatttaaaacaaagttctaatgatggacatacgagaagtataccatactttttatctgaataatttgcagcttggggataacttaagtaacatcaaagaatgaaaacgggactgtgtgcacacaaagagttcagtgtgttctccacggcaccacgttagcaatttatcttaagaattgaacgagtttattaaatttatctccaaatcgtctgcctttgagccagatttatttttataacctgaggtgcgggtaaatcctacaattttcaggggcgctttaccagatattctaaaaggctggggatgattagaaatggcataatgcagttacttgtgtactagaacaggcagtttaactggcagccattttatgacgctgataatacattaaaaaacgggattttggagaagactgaatctaaactaatagaaatctgaaataccaaagcctatttccttccccctctctgctcttctggggaactctggtgccgacataaaaggcagttcgatagggcacgcagcagctctttgagcccctggcatcttgatgcaggtccagctcagtcacaaaatggctgttcctttgtgccgcagcgctgacagacatactgcattgcactgtgtactcgccaaacagcaggaagttgccgtgccgagttcaaaggccggccggcgccggcgcggggtgctgattggctgtgcgcgcgcctggtaacagcagggtcaacggcggcgccttcggcagcctccgccccgtgacgtcagacggctcccctggggggcggggagagaacgcagtgacgtctggccgcgtgcgcatgtcgggcgctttctcctccccctacccagggagccgcacgccgaggggaaaaggaagggaactctagttgggactttccggtgggcggcttctttcctggacgcgtttgctcctggcagtcttgtccgcccttgcctgtagcggtccgcaccctgtagtgtgttcttttgcccatttccgggaatggtttatcctctttgagaagcggctgcttttggagaaaaagtgcaggcactatttataaattttaaaggcactatttggaaatcttaaaatagaaaatttgcccagttttacattttcccttttcataccttagcgtcccttctccccgcccccgttcagtgtgaagagatgagtgggtttaattttgttacaattgaccaaaacgtttgagtgtcagaggcggatacttttattttagtgaaaacctcttgacgggtgttaacagctgtttaatacatggctcataaacaaagggaagattatttgaacttgtccccatgcgtttttacttggtaccgtacattttctcagttggcatttgatggagaaaaactcaggtcagtatgtgctaagtactatatatttaagattcacagtgggatagtttagtagaaaatagaaaatttcacgttcaataacattaaaaagtggcagaatacagcgttaggcaaccattactatgtaagtaaatgtcagaaaactactcttttaagtgttaatagcacttgctaatgcagggtgactgacagcttggctgatagtggggtcacttggccaaatcttcgcaattatcttccctaggcctccatttcgggaattctgagtcccggtaaacggttgggtttatgctcactgatttgccttgtttggaaacctttacaaggatttctggttaaaacttcatcgttcagcaacgatgtcttaataattaaattacacatactgaatttaagcaagcaagaaattcagtggatttatctactgtggacaaagtttttttcctgccatactagagtttttttagcagttggagtaggctgtcctgtagttagccatagtttagagttattttagtaaagtgtgttacttcaaaggagatgttgacccttcagtgcaggtgatatttgcttgggcgtatgtcaagtttctgaatacagtctgtgaaagttagaattcactatgatagtgagttttgtaggttctcataatctaggttctttgggaagaattatttggatagtttgtgaaaactagctgaaattgctttttctgttacagagaagtgttcatcaaataatttgtacctgattttaaaattatatgctcaaatgtatattgcgtataaaatgctaacagagaattaagtgtttatagaacttgatgaacgtttaactgtagcttccaacttaaagtatacctgccacaagaacgaaagtaataatctcacctccctttttgtgtagagactgaattctaattagttgtgttaatagtatttgctgaatacctttcaattcctaaaactggggtcaaagtagtcaacattgcagttaattatttttgaagaggatatgaactattctgttatttaagatattttaacctaaataccattatgagttaaaatgcataccatgatataacaatttacctattaactgttgacaatcttgcagccaattaagttttttatagaaccagtgttcttaggtatgtttgttgagccttctactttttttccctttgatgtggggaatagcatcaagcagcaagaaaagagtgttgatcgatttctctctctttctctctctctctctgtatccttgccgtttaaaatatgcactttccaactagtatttggccgttagggagttagtatctttgtaaagattaagtcagcagaggaaggtgggcaaataatatttttgataaagacttttggttgtgacagttgtagcaagttattgcttgaggagtgaatctggaagtttatttgaattttaactaaaactcacagattttatcattagtttactctcccttacccccaaataaaacaactgacagttatgagagacctcctgagaccacctggtatttccaaactcctatcatttctcccataaaatttgatacactaagtttgtttctggtataaaaattgagtgactgctctgtgtcagccattaaattttttcttgctatgagccatcttttttttttttttttttttaagatcctttagtttttagctgcttcttggtaaccttagaactttgcttccttgaagaacttggctttcttgatatggtgtcacttgaacaaagaaacttaaaaaaaaattcctctaagagtattttgtgtacaggtgaaagtaactttgtggcttggttacactgggtgtgtcacagctgagtaactccctcctgcacttcagcttgactaagcgttgagttcacatgtatacctttgcaaagctgccattcacaacttgttttggaactttagggttatcagtataaagcctgagtaacaaaacttagtcatccaatgtccaggctggattgtatttttattttgtgatcagtaattcagcacaatgctggaacacattactcacatttgtcttatgacccttttctgtaatcaatggaatctttaattgataaagcaagtctagggggagagacattttttaaaaaaagctcctatatactgaatatatttgagccctgattatgaagtgagggacaaggcttttctttttgaaataaatgatggaggacatagatatgtggtagccattcatgctacataatttagcattttattgttaatatgtttggttatgggtcttcttgtttggtatttcaacatgttctggactggatatcatactgaaaagtatttcagttctcattactgagtccctgtagtttggggaaaatgtgatcactgatcttgaaggagagaatgtttcagaagcatccggctaaggcaggattgtagagatagtcttgattttatactttggatttaattctgatgagtcattttgtcacttgtgtatgcttaactgttacctctgtgcctggcaagagctaggtatgagttcagcttttactttagtcctgaaaatttttgttcccagtttaggccagtgaagaagcacttatgattggacttgtaattttctcattttaaaaatgtagataatggtcatcttcattgggtcatgaagattaaataatatagtgcccataaaatgcttagcaaagagcccatcacattaaaagtgctcaataaatgtaagcttttagtaaggttattttattcttactgtttgtttcatcttactttcttgcacccctccttcatatcctaagttcttcttcaggagctaggttggccctgaggaactcgctggttgtcttggcctaccaggagagtttgtttaggccagttacaggagagatttgtgagaatgattttaggaggcaagtcctcatttagtcagcttgggtgcgttttacagttcatcctctcttagaattttttttttttttttttttttttgagaagagccagccttttgagagagcatatgactcttcctggactacaacagcttcttgtgtgaatcacagcccggcttttgccagttagtctgagtagataactacccacccccactcccccaagctgataattattaccctggtttatcctctgtctcatttcccctctcaagctgttagagaatgaatactgaatactgtggtgcactgctccatggatataaatgtaacagcagtaatatttacaaccaatgtctaattggctgtagcttgctttcagtgttcagtctaaaccataggactatatatttgtcttagcataatgccgaacatgcaagtctgcttaaactatagtcttaagatttgtgtgttttgggtttcctctacttcctctatttcctgtcttttttgggttataggtcagatgggttctactttttattcccatttcagactgtggagagcttctaaaaataccagtgtccatccctgcccctaggatctagttaatttttaaaagctctctgtgtttcaaatttgcatgtgtttctgtatgtttgcagtatctccgtgtgttttcaaatcttctgatggagcacttcgtgtactttaacccttggtctttccattgcctgtcccatttttaaattccctttttagtcttaatagctgcttgagttaggacctctggaagcaaaagtgggataggatgctgacggggaattgtaggcttgatggaagaggatgtttctatattaaatgtcatggcagatccagttctaggcatacctttaaaatgtatacacaggctgggcgtggtagctcactcctgtaatcccagcagtttgggaggcccaggcaggcggatcacttgaggtagggagttcgagaacagcctggccaacatggtgaaaccctgtctctactaaaaatacaaagattagctggacatgatggtgggtgcctgtagtcccagctgcttgggaggctgaggccggacaatctcctgaagctgggaggcggaggttgcagttagatgaactgacacaccactgcactccagcctgggagacagggtgaccaaaaaaaaaaaaagaaaaaagataaaaaatgtatatgcaggtgggctttctcccctcaagattctgaattccttgtaagtgtcttctagtcgctttaagctcttgtggtcgtctcttccttagtgtactctccttacatcctttggaagtttagattctagaattatttacttggaatgcagttacattccattctaaacttcctttcccttgggtttataaaaacattggtgggttgtgaattgtgaccgacattgaaaaaatacaaaagaatgtggtaataaactccagggtgtatcccatttgtatgggttgtttctaagtctagcagtgcctgctagctggtaatctttcactttggattttttgttgttgttgggacagagtctcactctgctgtgctgggattacaggtgtgaaccatcatacccagcctcgtggtggtattatagatgcctgaggctggataatttgttattgtggggagcgtctcatacacagtgcggtgctgcaatcccagtctcaggtgggattttcccacctctgcctcccaaggagctgggaccacaggtgtgtaccaccccacctgtctaatttttgtagagatgggtttggaccatgttgcccaggctggtctctaattcttgggctcacctagacctccgaaagtgctgggattacagatgtgagccaccgtacctggccttcactttggattttatcaggaaggaatattgtacatggtgaacattttgtagaaaaataccaaagtagatttatatttattgagtgcttactctgggtaagggactgttttaagggttttacgtgtgtgtgtgtgtgtgtgtgtgtgtgtgtatgtatatatgtatatatatacacatatatacatatatataaattttttcttttgagacagggtttcactcccatctctcacactggagtgcagtggtacaatttcggttcactgcaacctccaccctccaggctcaagcagttctcctgccttagcctccctagtagctgggactacaggcacatgccactgcacttggctaattttttgaattttttgtagagagggggtttcgccacgtttcccaggctggtgttgaactgggcatgaaccaccatgcctggctatatgtatattttatttaatatgaaagtcagtatagcaaaaatgttagtaaccctcctaaagttaaccaactcactaaatgaatgattacatagtcctcttcctttaaaggcctgtgggtgaccttaggtcctgctgatcttatttatttttttgagacggaatctcactgtgttgcctaggttggagtgcagtggcgccgtctcagctcattgcaacctccgcctcccaggttcaagcgattgttctgcatcagcctcccgagtggttgggatcacaggcgtttgccaccatacacccagctacttcttactatttttagtagagatgggatttcaccatgtcggtcaggctggtctcagactcctgacctcaaatgatcttgccacctccgcctcccaaagtgctgggattacaggggtgagccactgcgcctggtccctgccgagcatttactacccatgccgttctgttccttcagttccattgtgtgcttaccaaggattagtagatacatcttgaatttgtttatgctggttgtacggtcatgtgttgcttagcaatggagatacattctgagaagtatgtcgttaggtgatcttgtagttgtatgaacatctcacacaaacctaggtatagcctactgcacacttatgctgtagcctgttgctcctaggccacaactgtatagagcatgttacagtactgaatgctgtaggtgattgtaatacaatggtaaatatttgtgtatctaaacagaaaaggtacagttaaaatacagtattacagtcttatgggatcactgttgtatatgacaccagtcattgacctaaacttccttatgtggtgcatgatacttgtaactttgcattttaattaaatagcaagtcagtaggcgaaatgattgtgagagattgtttcagtgaaaactaagttgaatgctttaggaagactaaataatagcatgtatactacctcctaagaatctagaacttgttctgattgctttgtatgtgttagtttatgtaattctcaccactcctgaggtacatatgcttatcgctatttgctagatgagaaaattgagtcacaaggagagtagatggtagaattgggattcaaacagtggcagtttgactccagcattgattaagcatcttgtgaaaagttgctgtcaaattaatgggtaagaggaaacttagccgggtgtagtggttgattcttgtaatcccagcactttcggaggctgaggctggcagatcacttgaggccaggagttcgagaccagcctggccaacatggtgaaaccctgtgtctactaaaaatacaaaaattagctggatgtggtggtgcactcctgtaataccggctattagggaggctgaggcagagacgcttgaacctgggaggcggaagttgcagtgagctcagatcgcaccactccactctagcctgggcagcagagtgagactgtgtccccccaacccctgcccaagaaaaaatcaacatcaacaaaaaaagaggaaactaatgtatatgagactgcggaaaatagtaaaaatcttgcataattctgtagtttgcttctttttaaacactttgcattttaaagaagcagactcaaaatcacagtgcactgtgggtgtgattgatgccagtcacacattctgctgttcaaaaggccatgactctacatcaaaagattctagttaaaatgttgccctgaagtgatgctcatggggatagtataagaaacaaatgtgcaaagatgggtagatgggaggtactggaggcctcggaacttcacctttgtgcagtttgtcgtccattggcacacatgaactttggatttggccacacgttttgaagatttgtgctttgcttcaagtttgtttttttttgttcgaaacttagttcccagacaggttttgcatgagaatcacttggagaattttaaaagccaagctccctgtctgattggatttgggagccatgtagtaggtttgaggaattgtccaaagctctgggtgggtctgtggcatagctaggcttgagaactgttgtgtttatctgccgtctcggggaatagttcttgagtgtgttgtgtgttgacaatcttgaggcggagtctcgctctgtcgcctgggctggagtgcagtggcgcagtctcggcttactgtaacctctgccccctgggttcaagtgattctcctgcctcagcctcccaagtagctgggattacaggtgtgcaccaccgtgcccagttaatttttgtatttttgttttgttttgttttgagacggagtctcgctttgttgcctgagctagagtgcaatggctcgatcttggctcactgcagcctccacctcctgggttcaagtgattctcctgcctcagccttctgagtagctgggaccacaggtgcccgccaccacgcctggctaattttttgtatttttagtagagacaggggtttcactatgttggccaggctggtctcaaactcctgacctcgtgatccgccaaccttgtgatccgcccgcctcggcctcccaaagtgctgggattacaggcgtgagccactgcgccaggccctgacaaactaaaatgatcagtgtgtcttccatttagatgcaggttggcattcaaatagaggcaatatatgactggtgaattgtaatttcaaaggaaagcagtaatggatcaaactcttgcactgttctctttcccttgcttaaaaaaaagtctgttccctctgaatctagctttatatagacgtttaaatccttaagtttacttgctaaaaatcacctggggtgcttgttcaacatattcccaggcttcttgcttgaaagttaaaaaattcagcaattctagggttgtgtccaagaatctgtatgttgaacagcaacctcagttgattcttgtactgaggcaagtttgggaataaggtcagtgtgggacggggtttcgatcttttctgttctgttctgctgctttttagctgtagaatcttgggcaggagtgtctgagcctgtttcttcatcttttaaaatagagtaagggtagtacttgtctcttagggaaggaagttcaaattaaataaaatgatacttctaggcagtggtctttaactagtggcaggtttgtccccttccattaccctggacatttttgcttgtcactctgggggtgggggtgttactggcctctagtgggtagaggccagagatgctccccaacatccaagagtgtgtatgagacagctccccacaataacaaattatccagcctcaggcatctataatgccaccactaggctgggcacggcggttcacgcctgtaatcccagcactttgggaggctgaggtgggatcccttgagctaggagttcgagaccagcttgggcaatttagggagatgccatttctacaaaaaatgtaaaaattagccgggtgtggcagtatgcacctatagtcccagctatttggaaggctgaggtgggaggattgcttgagtccaagagcttgcggctgcagtgagctgtgatcacattacgtgcactccatcctgggcaactgagcaagaccctatccaaaaaaaacaaaaaccctatgattgagaaaccgtgcttgccttggtaaatgttggttgttagtaataaagttgagtccctttgcggtttcttctctggcctgatccagggacccctcttactcccatgacgttatgggcatacgtttcacatttattattgggattggtaatcagatcttttaatctcctttgaactttgggagttgctgaaagcaccatatattttataaaagtctaaagtttataacctaaacaatagctaactaaagacaagactcacagggctgaaaggaactcttggtcaaattggtccatctgtccttagggctttaatgggtgtaaatacattgcccgaggtggttaagtattcttttgttaatgaattctggggagaactccccttgtaactgcttttcacagcttggttatttacaaagacttttgattttacctgaatagaaagcttcttttgtcttttgtgtattagcacattgccagatcctgattaggtaggtatttgtgaagtgccttaactaatttgtaccttaaccaggcttcttgctagaatacatgtttctctaatgtatgcctgggtgctaatagtttggtgctatggaaactacttatatttggttattggggagcagaagtagtatgcatgatgaggctaaggtgatgcctgcctggcttcagctgtgaattttagaaatacactgattaaaggtaaatttttttttctgtccttactgctggatttcttaatctgggaggtacttgatggaatttagcctttttatcccttgaaattataagcagcattttgtgtgcactttttcttatacatgtacctttttctgctgtcaaaagacaacatttcaacacattgagtataaagatctaattggattttattattgattaacaaattaggtagcaccccatctataaaaaaataggtgcccattgggcatggtggaacaatcggtttttataaggttgagcaggaacaggaaaacaacatagtacaaaaatgtgggttaacatcaggttacttgaggttattttccttataagggttaaagcagagggaacttccttatgccagctcacactgtctgtctggggatttgggtatcttctttcctgaaggtaaggtaaacaatttagaagtttaacatgagtgactctattttggtttggtctgttagggtctaggagctcggtccaaattagtggccttccatagattctgtttaacactggaaggagggtccgtagtgttgcgtgtgttagggtgactgctgagagcactgctgaatcctggggaggggcctgcaccttagaactgatcagttctacagtgttagaaacagacctcttttgtcagaaattaagaattcagaaaagttcaaaggatataattaaagtttttttttttttgagacagagtctcgctctgttgcccaggctggagtgcagtggtgcgatctcagctcactgcaagctccgcctcccgggttcacgccattctgctgcctcagcctcccgagtagctgggactacaggcatgtgtcaccatgcccggctaactttttgtatttttagtagagacagtgtttcaccgtgttagccaggatggtctccatctgaccttgtgatctgcctgcctcggcctcccaaagtgctgggattacaggcgtgagccaccacgcccggcctaataaagttttaaaataaaaaagttagacatagctagggtcacttttatgattttggcatataaagagttggcacttataaaatgtacatggttatgtaaatatgttttgtgttttaaaaatttaatagttttgaaattttctttttgatattgtgaaaggaaaataaatctcggtatctccaaattactaagccaaagggaaaagtcaagctgggaactgtgtcaggcaaacctgcctcccatttttttcctaaataagatagctagaaaaataaaaatgctacatacctccctaacaatttgcccacagggaaattccttgtggacaaagaactcaaagccatcccctctgttcacctaagacaaatgcgtatctgattgcttcctctgccctgttgttttgctaagccagactgaggcataaatgactatgcctctactctcttctcacatggaacttgtgtattcagtgaaaggctaatcaagagacttaaaagaatgcaactgtttgtctattatctacctatgacctggaagccccctcccctgcttccagttgtccggcctttccaggccaaaccagtgtgcatcttacacatattgatgtctcatgtctccctaaaatgtgtgaaaaccaagctgtgccccatcaccctgggcacataccatcaggacctcctgaggatgtgtcacgggcacgtccttaaccttggcaaaataaactttctaaattgattgagctctgtttcagatacttttgggctcacagtatttacagacataattcagccctaatctagctgctgcatttagttgcatagtgtgaatatttcacattttacttttacattttcataaatgggtatatggattatttaggttttgttatgaacagagctctgaatatttatttgcctcgtcctatacaagtttgataatttgtctacgttacatgcccacaaattgaattacaggattcatacacttttttatttttttgagttggagtctcaccctgttgctcaggctggagtgcaatggtgcaacctcagttcactgcaacctccaactcccacgttcaagcgattctcctaccttggcctcccgagtaactgggactacaggcgcgtgccaccacgcccagctaatttttgtatttttagtagagacggggtttcaccatgtggtccaggattgtctcagtctcctgacctcctaatctgaccacctcggcctcccaaattgctgggattacaggcatgagctactgctcctggctgattcgtatacattttaagggttactggctattcttacaattatttaatactaagagactttaatttctgcaaagcagatgagtgcaaaataaccagttataatgtttcccaagttaacagaggtttagttatttttaaaaatgagtttattggccatttcagtttcttctccgtaattgcgtatccattttctttgtgcagtttttggttggatttttgataggtaattcttcatatgttgtgtatctatatactttgttatgtgtacattgaaattttgtttcccagtccgtctgggaaacaagttacttgtcttttaaccttgtttatagtaataacttattctgaagaagcacaggacttgaaccaaaggtggagagtttaaagaactacatccagtattctttaccaataagaaatgtgtggccaggcgcagtggctcatgcctgtaatcctagcactttgggaggccaaggcgggcagattacctgaggtccggagttcaagaccagcctggccgacatggtgaaaccctgtctctactaaaaatacaaaacaattagccaggtgcagtggggcatgcctgtaattccagctactctggagactgaggcaggagaatcgcatgaaccctggaggcggaggttacggtgagccgagatcacgccactgcactccagcctgggctacagagcgcgacttggtctcaaaaaacaaacaagcaaaaagaaaaaaaaggtgtgaccagtcagtcttctttgcttttccatcttaagacacatagaagtgactgagaaggaatagttatgcaatgacatcggtttaataatcagttcaactgaagaatgtatgtaaataagggcagtgatacctaacgctgatagttgatagtgtggattgcataattcagactgtggggtgatatcttacacacgcacatacacacacacactcttgggctttgtcttctttataggtaaggattaggagaattttgacatatgcctgacacaaaagtgctccgtaaatattagctattgtatcactggcaggaagttagcctggaaataagttttatggaattccagtgtagattgctttgtgattgttttgccagattttgctttcacccacaaaaacactaagctctgccaaccagttcggccattttgtaagttagcaaaataaacactaaagtgaaatggcggcttttgggcggggctcccacaggctggctccttttaagtggaatgttgctgtgctgccctcttgtggccatttgggaaaccgcgattaaaaatggaacagtaagtgttaatggcacttcgtttcaaagtccagttccaagaaggttaatcactccgtttttacctacttcagaaagtattttgaagagataccaaattctttttatccacaagcaaaaggaagtggtaaacctttttctcatcagcatttatttttgattggaatctgaattcccagttttgacttgtttttttatctgtgtgttgtattttccttttaattatttgttaagtaaaaaattataaaagttgtttgcaatttagatgttgaataattttcagatagttgtttttcgtgaagattctgtatatatgttggatagtcattcctgaaaatccaatgtttaattgccctgtaactagtaagccactggtagtcagctaattttattactttgttatttaggtgaaggcttaaaggactccactcactaactcagtttgaccctttctattagtcttgtgggctttctgcctcctctactaaaccagcactaaagctacagcttagtactaatagtatttactattataattattaggtattaatggcaattctacatagtcttttaggaaatgtcgtttttttaagggaataatatgaatatatatatacgtatatatacacatgtacgctatatatacacacatatatacacatatacatatatatacatacacacatatatatacatacatatatatatatattttttgagacagagttttgctgttgatgcttgggctggagtgcagtggtgtgatctcggctcactgaaacgtccacctcctgagttcaagcgattctcctgcctcagcctccaaagtagctgggattacaggtgcatgccaccatacctggctaattgtttttttagtacaggctgggtttcaccgtgttggccaggctggtcttgaactcctgacctcaggtgttccacccgcctgggcctcccagagtgctgggattacaggcttgagccaccatgctcggcccataattacactttttttttttttgagacggagtctggctgtgtcatccaggctggagtgcagtggcacgatctcattttccatttccagtttatttagtgattattcctcttacgagaagtatgaaaattaagtaatgactttgttaaggcttttttttttcttctttaagcagttcccctcattagtacttgtattcagtcttacatctgattctggttccaaaaacaatttaaaaacacttttttttttttggagacggagtcttgctttgttgcccaggctggagtgcaatggcacgattgcggctcactgcaacctctgcctcctgggttcaagtgattcttctgcctcagcctcccgagtagctgggactacaggcacactaccatgcccagctaattttttgtatttgtagtagagatggggtttcaccgtgttagccaggatggtctcccatctcctgacctcatgatcttcccatctcagcctcccaaagtgttgggattacaggcgtgagccaccgcgcctggcctaaaaacactttttaaaaacactcattcaaatctttgctggttttgtgtagggtgggatgtacttgccgcccttggtttggatttggctctcatgattagacttactttagacaattaactagtttagacattaaaaatacttaaggtatataatgaagtgctgtgaattcactattaagcttcactactaagtttcagtcataaaatgtcactagtatcattccctgagagcatctgcctccctcaacccctaaaggcaaatatagttgtgaacttggtgttaatcttttcttgggtttgattttcattgttgttatttttgaaattacacaagtaatccatggaactcacaagtatacttcaaataacccatccctaacagagtaaaccagtgttagcaatgtggtgattaaaatgcatttatacacatagatatatgctgacagaaaaacggcttttttttttccccagaaggtattgttgtgtgcattgttacatttctaggaatcactctcctacacaaactcaaaaacacatagctgcacaagaagatacgtagaaagaaagatatttatggttacagtcaacagtttccaaatacaaatactctactcagaaatatggaaagtgtatcagagatatttgcaacttattgattaagtgaaaaatctgaaaataacctaaatgtaccgttaataggggaatgttatataaaatgtagtgaatttatagtataaaccagttcaaagggaatgagatgggcatccatatagacatatcctgatgcgggcattggcattccattacatcctatctgcagtgcttcccacttttcaacacagaacactataaacatttctagttgggctgttctagttatcttcagtaaactaatgctgccttttgtgggtctctagttggtaaagattttcagtctttttgttgctgttggagttttctgtttcctagtagtgtgtagacctgttgtctgtgacagttttattggtggtgattgccaaaacatgattctattcttaaacttttgtctggagttaaacattatagtagttgaaaaactaaatacgttatttcaaaggggaggcaaattgcacattctagcaaatgaatgtgcaattgaatccttctctaatataccaggcacaaagaacatcaaaggagatatgcttagtttgcaagtttattggggaggttgacaagcggccagattactcgatagtatgggacaagtggaggcaaggtagtgtagatgttaacagctgccggagctttggagtgagtctttctaggtcagcatgtgtgtcattgctaaaagtatagagagccagcagggcatggtaattgaagctcagacttgagatgtggctgcctgttttccatctcggtggtggtaactgctgtgacatatgtcagtattgtggaagtatctgataggtattgagcttaggataggagaccaaaggatgttttctgggagaaggtgatacctaagcccacaaaattagagaggtatttaatttgctgtgtccgcagtgggtgcaggagctagaggggagcaatgctaggtctagagtctggagcagtgggggtgagggaagaaatgattaagtcatgtgccttgagaaattgtcagaggccaggttttatagggcatgctgaaattggatgttatcagtgaccagaagacccggatgcctgggaggtgaacaagccttcagctgcctttgctatgggaatacagtttccaggtactgccttgcctaacatccctttcaagtagactgccctttctattaaataaatcccttccttacttacaaggaaattctggagctgtctctgtacctgtctgtccatgaacaaatagtggaggcaaaactaataaattccagctagtgtcatggattgtggggtaacgactcactaatgggtgttagctggggagaattttgtgttagaaggggaatctcagcttggatgtgatatgctcagatttcctgtttgggtagggctttggcatttatagggcactgctttcatagctgccattagatgttcttatgacactactggtagatgtcacataggttgacacaagttaaaagatgacacaggcctgaggtgagctaggactgaaatggaagctgcgatgccagagcccacagcttttaagtgttcctatcactatccagctctcctcttccttttttctttcctgttgacaacctgcctggtcacaggtataaagtaaatgactcagatgctttagtcacctggactagtcagcttggactgtgcaaggggttaaggagtcagtaattgtaatgaggtcttgaaactgttgagtcacttgttacaaggaagcctgttttgggaccttgtgtaacagggataagagttaataatgttttctgagtctctaatcttttggccccctatggtaaaatagaaagaaatgagctttagatccacacttggattggaatcccggcccctcaccctcttcctcaatttctagttttgtccattggccaagttacataaaagaggtcagtttttttcgtcattcatatggtgataataatgcctaatagtattgtccttgggaataagcaaaataatacatataaagtacttagcctagtgtctgatacctgttaggtgatcaggaagttacatggtttttctcatctttccccacttcccagtattgagaacctcccctcgacccctgctctcccattttttctcattgcttcctcatggtaactgaaaggcctccgtattgtaatgtgctgtggatcgcatggtgttatttgcagcagtcccagtttgcagtgtactgccctgtgcacctctagaagatgcagtgatggtaaatatagaacttccccttaccctttcaggttttgtgccacgtgtcttatctcctggcttctgaactcagggacttttctgttaatgttactgtaggttctgggtttttccttgcccccctcagagcaaagatgggtagtttttaagcaagagtaaacagtccacctcttgctgtagagtccatccgtttgaggtctttttgcttcagagtatcttcccctctaccagcatgcccctcagttgctttttcaccattagaggaagatgaggatattgttttctctgtgcttgagattgatactctatcacccctcagtctctgtggtttctgttttgttcctttagatgacatctacctacttaggttgctgctccctatgggatgtttggaatgaagaagggaagggagatgtgtggaggccagtagccgtctttattgggttgggtgttctcattagcatcagagtgccctttttgtttacttacttctgttaagtctaccacttctggatctcactgcagattataaggcagggcctctggattgaagttaatgtgtataaatttttataaagctcctcagatgagcctaatttgctcctattagtgagaaccacgattggataattgcaaccagtttgcattcttcctctttgggtgagatgctttgttttttttgtttttgttttttggagacagggtctcactgtgacacccaggctggagtacagtggcgtaatcatggctcactgcatcctcgacttcctaggctcaaatgatcctcccacctgagtttcccgagtagctgggatcgcaggcatgcaccatcatacccagctaatttaaacattttcttgaagagatgggttttgcatattgtccaggctggtcttgaactcctgggctcaagcaatcttcctgcctaggcttcccaaagtgttgggattataggcttgagccactgtgtccagcttgttttttttttttttttttttctggagaccaagtctcgctctgtctctaggctggagtgcagtggcgtgatcttggctcactacatcctttgcctcccaggttcaagcgatccttctgcctcagtctcccgagtagcttagactgcaggtgtgtgccaccacagccagctaatttttgtatttttaatagagatggggtttcaccgtgtggtccaggatgctctcgatctcctgacctcgtgatccgcccgcctcggcctcccaaagtgctgggattacaggcatgagccaccgcgcccggcctgcttggtttggttttgttctgtgttttgtttttttcttgttgagaggggaatgatacttaacagataagacttcgtggattcatatatatctggtttcaaatcttactgtgttaactaggtgtgagagttaaatacttatgagcctcagttcagcctcatttgaatgaaggggacagtaatatccatgttcagagtttctgtcaagagcctgtccatagaaataacctgttctgtagcatcatgtaaacattcaggaaagggtagctattggggattttgagaatggtagcaataacgttatttggaatgtaaaagtataaatgtgaatttgaagattttggtcttatattactaaaattactatctgcaaatgttttaccatgagaatttttttttaagcagattcatgtgtcagttcttaaatatttttaaatctctctctctctcaaaataagtcactcagcctctgaagaagcttcgggttcagactcaggcagtcagtcggaaagtgagcagggaagtgatccaggaagtggacatggcagcgagtcgaacagcagctctgaatcttctgagagtcagtcggaatctgagagcgaatcagcaggttccaaatcccagccagtcctcccagaagccaaagagaagccagcctctaagaaggaacggatagctgatgtgaagaaggtatctactttgccctgcagtacaaatgtgctgctagcctaggacaagctagcagacctttgttgttcatgaaaactcattagtatatcttgatgatgaaacctacagccattttttctagtaatatacagtagtatatctgaggatacaaatgaagacttctttctgctctattaaggaaaataaatgacctgaaccatccaattatagggaggaaagacaaatttttatacgcttggtttttaactttatttatttatttttgcaacagagtcttgctctgttgcccagcctggagtgcgcagtggcacgatcttggctcactgcaatctccgcctcccaggttcaagtgattctcctgcctcagtcacccaagtagttgagattacaggtgtctgccaccacgcccagctaatttttgtatttttagcggagactgggtttcatcatgttggccattctggtcttgaacttctgacctcaggtgatccacctgcctcggcctcccaaagtgctgggattatagacctgagccaccatgcccagcctaaaatatatttttaaggttaaagtgagcagttccggaaagttaataatatgtagttataggttggatggacctacaagccagtcagaatgattgcactgtgcctttgataatcattatcctaaaatgagaacttctaaggaaggctcttggttttctatgtacacctccttttcacatggtagctctctgtccccctccaaaagcttattactcatgtaagagtactcagtagtgagtaactccacatagtagatttttcatggaggagttgacttagatatcggctctcaaaaggacaaataagaacacaagataattttaggatgtaaacattataatatatgctgtaataaagtcataatagttgagctagaatgcctggctggtatcttgaagtgataaaactagttgatgtagtaacactgaaatgattttgccctcccagttaataagggctccataaaaacctgtgttgagtaaaaactttcatagctctagcagagggccaggtgtgggcatggatagacaggctagagtaaagcgcactttccctccttcctttctctgccaggttttttcagagtgttttatgtttactgcctctacctatatttcctaccatttggttattcctaactccttctgtttggaccttttgtcctttaactccaaggtgatgctaaggccgttacagaatctgtggactttgggttatgtgattacattggattctagttgtaaaatgcctattctgggccatcttttcttttgaagccttgattttcttcagcttacttcatcatttttatgttgttgttgttgttgttaaagtcattgttgataatgtcctttcttagtgacattgttggatcatttttcataaagatgagacagggtcttgctctgtcccccaggctggagtgcagtggtgcaatcacagctcactgcagccttgatcttctgggttcaagtgatcctcccacctcagcctcccaagtagctgggactacaggcacgtattgacacacctgtctaatttttaaattttgttgtagagacaggatctccctacgtagcccaggctgatcttgagctcctgaactcaagccattcttctgcctggacctcccagggtggtgggattacatgcctggccctacacttttaaatacaaacatttcacaagtctcagctagtggcttcttttgtgcatgttctgaaccttacttttccaaatattctcatgacgttagctgtcacctgtaatttgataacccatatttctcatctcagcttttgctacttgcttaatttctgttacaccttttcatgtcagtgttccacaatccattcaaattccttttgcttatgtgtgattctgttaaaagaatacagaatatacttagtagtagttatctctggggaagaaagtgaaaatgatttttctcctcaactaatctgtcttttaaactttttaaatcactggtgaggattgttacaggtcttaaaggttgttacaggtctacaaaaatcaggtcttaaaggcaaagggctaattactgctacagaataaaaaatagatgtgttagagaaagggtggcagtggttctcattctgagaacttctagctaagtgttagcaatgcctcatctgcgtttatctgggatgttacatgacctgaggaacttaaagaaaaatacaaattcctgattcttacttaattagacttaatgggggctttgccgcttgtattttcagtttcacaggtgtgggttagtgcagtcaagactgaaactcaaagcagtagggaatttaaaatgtatcagtaaatactttgtctttagtggaagcagccgctgtcttacctttctgtattattcagctgtatattttaatgatgggtaagcggtgtaccatatagatttatagctgttaagtaatgaagacattgttaaactaatatttcctaggataatatgcctattttaaaaaaaatggcgctttattgtctcataaatagaactagcaaaacaacccttttgatacttggttacttgaattctcttcaattgcaataaacgtttgataataataatgggggtcaagaaaaaagattaatgcgtggtctcttaattttacagatgtgggaagaatatcctgatgtttatggggtcaggcggtcaaaccgaagcagacaagaaccatcgcgatttaatattaaggaagaggtaaggaaaaaatgttttaagggcatgcatttaaactccctatcttacttcattctttctgactctggtatgtattaccattaaaaagactgaacttcaggcatgagggttaagtgactctaatatgagctatctatgaccagatacagtaaggcaagaagttaataatcaaataaaagaatctaaccagaaagatcatataatagtgaattttttagtagagtattatacagaactgacctcaaaatggtttattttttaagttgtctctcatagtgaaaattgattatatatagcaagaagtttacctttttaagcccctaacttctaaatctcctagatatttattaaatgggtaacttgtttggtaaacaaacagagcaatagaaatagtttgggatttattcctgaaagaggagggagtgcttaattaatgtatctacttttatttaacttcttaaatttggtttccttgctcatttttagtgtgagatataataaaatgagtttcaaacatacttactctaattgtgagagattgatcagtgatttttttaaattggtattctataccaggcttggttgtctatagaatcagacttctttcacctttctcattttgtgtgatatttttgtggattcttattctgaattaggtttatagactagatcctgaagagagattcttttgtctcaatgaaatgtctactttctgctttcttgggaggactttgctagtcttagctatataacgtacttctgatgaaagttaaatattgatagccacaggtcagtgagttgggtgtgggtttttaaataaatgtaccttaaaaatctaattcaccctaacatctgcattacatttgtgatgttttattttgagtgacctctgagctgttttgcctttgcttttgttttccatagtgtctcgcactaggttactgagccatgtttgttaaaaccaatcacatagttgtagaaatctttccctcttttacatattaattaacacattctctgtagggtacaagattaacagcaataggaatagtttgccattttccttaattgtggagagaaagagctactgaaatgtctgtgactgtaagctttccttggcctagtgctgttagcagagcactgttggctcatgagtgaacatactcttaaatgagtctaaaatgaatacatcagtagttggtgcctttaaggcacactgactaaatgttgtggcatttttatttgatagtctcaatctgcagtatccagtatggtccccactactcacatgtggcttttaaaattcgcattagttaaaaataaaacttccatttctcagtcacaccagtcacattttaagcgcttggtagtcacatgtggctgatgggtactgtattggacattgtagatacaggacatttacatcgttgcagaaagttattggatattgctgttctggaagtcaagctgagataaatatttcctggctttagagataactcagtgatagcagagagatattaattttcaaatcaaaagaagagggagttccaccaagcaagtgcttaggtttctttgtgtctaaaagctcatattgaataatggtatattgagtagactgttgatccaggagatagtgttgtcccgaagaactgtgaattaaagtctgtaatcatttttcccccctcacacactgaaggcaagtagcgggtctgagagtgggagcccaaaaagaagaggccagaggcagctgaaaaaacagtaagtctttcatgggggaaattattcaatctagtagtttcaaacttgtcagcatttctaggactgccttcgttgtgtctttagtctactccaggtcccttagtctgcttctgtctctcttactagctcgggtgactgtctaccttgacctgttgcaatagcagcagcagcattggaaactcaagattctcagtttaacacatggaaggggtccacgtatactcgagcttttgcttgggataaatctcagcttcttccatcgggttaacccaattagcccattgatttttttcagaaaaatatgtataaataacaagtacacaggtatttggtattgtagtaagcaaggaacaaatgtagatttgctatttttatggcaaaattatattggctgaacatccattttggtaagaaattacatattgttgtttctgtataattttaatgttgcagttcataagccagaaaaatttaatttgtggacttaatgtggagtttctttataacatagatttatatgttgattttttaatttaaaaagttcgatttatatgatatgaaattatttgattttttttgagaaataatttttaaagtcattttttggagagggtgtggatcccgttgacaatctgaattctatagcttctctcaaaaatgtagatattcaaaactttgtataccagttcaggggttctcatgttaaacagttgtccatggcttctattaagagctctaggtacatatgctctgttgtaaaatattattactctttagtaagtggcctaaggcaagtcatttgagattttaaaacccatttcctcatctccaaaaaaaaaaataataccatctacccaacaggattattagaaactatgctaagattttgtgacattaaataaatgtagggtattacagagccttacagaaaagtacttaattttgccctgctagagcgcattcagttttcatttgtgttttggagaaatagtaactgtaagcaaacctgcacttggcatcttagaaggcttttgttctgccccagtctcctggtctgcttgggagactattatctgcttactggtctaatggccttttgagtatctttcctgaaatgtccaccttgattacaccctgggaaatccatgcatgtaatcattacttcaccatctggctacattcctttggtctcttgactgcaagttaaatggtgctatgcttgaattcttgacttcctattttaatggccttatttgtgtgtgcagaagccagcgtttttttcagtcactgtataatacattgcgcttactctggttactggctcatagtcttgtcagcctttttgttttgttttgttttgagacagggtctcactctgttgctcaggctggagtgcagtggcttgatctcagctcactgcagccttggcttgctggacttaattgacccacctaagccactcgagtagctgggactacaggcatgtgctatcatgcccagctaagtttttaaaaatttattgtatagatggggtctcactatgtttctcaggctggtttcaacctcctgagctcaagcagtcctccagcctcggtctcctaggattacaggtgtgagccactgtgccccgccacttatcagtcttaagaattccccaaagttggcaaccttcagtagcatatatggacctttcttttcctgagtagaacctcttagttccttgcagagtgggatctgtcttctttttcatattgcttccctaccctagggctgttcataggaactgccttgggctgagatagttcccctcatgttcctgtgtttgggcactgggctagccttcgtttctgctattctctggccagctggtgagtattgtggatttacagagagctcttctcctgagtcaccagttgagattcctgaaagattaattaggggaggtcttgtagctgctgacactcaagttgcaaggcactttaggagccttctgtgatccaagctgagcaagtgtaacataacctaatgtgtggtcacatgcatttcagaattcagactcactcagagagtgaaaggtttgaaatattggcacaaagaaatgcttttctgaaaccctgcagattttattcacacattttagagtttttaaaaagggaccattttgtaaaattggtttaaaaaaattaattccaaactttaggaaagttgcaagaataaaagtgcagtacaaaggacaccttatatactttacccagattaccatttttcctccatttgctttattattatgggtgctgtttatttaagagagagggtcttgctctgtcacctaggctagagtgcagtggtgcaaccttggctctctgcagcctcaatctcctgagctcaagtgatcctcctacctcagcctcccaagtagctgggacgacaggcgtgcaccaccatgcctgattttgtatttttgtagacatagaggtctcactacgttgccctggctgttctcaaactcctggcctcaagttatcctctcaccttgctctccaaaagtgttgggattagcatacgtgagccactgcacccagcctgtgtatatttatatatatacaaacataatgttttttatgaactatttgagactaaaattcataaaattttaccttttatccctttaccttaaatatgtaaggtgtatttcttaaaaataaggattttctcttttataagcacagtacagtacagattcaacttagatttaaaacattgctgacgtacttttttttttttttttttgagacgcagtctggctttgtcgccaggctggggtacagtggcgcaatctcggctcactgcagcctccgcctccggggttcaagcaattctcctgccttagcctcccgagtagctgggactacaggcgtgcgccaccacgtccagctaattttttctatttttaatagagacggggtttcaccatgttggccaggatggtctcagtctcttgacctcgttatcagcctgtcttggcctcccagagtgctgggattgcaggcttgagccaccgcacctggctgctgatgtacttttgtctgattcatatttcagttttgtcaattaacccaataaagtctttcataatatttttccatctctactacaggatctagtttagggtcagttacatacaattagttgcacatctttttttttttttttaattgtactttaagttctagggtgtatgtgcacaatgtgcaggtttgttacatatgtatacatgtgtcatgttggtgtgctgcacccgttaactcgtcatttacattaggtatatctcctaatgctgacccttccccctcccccccaccccatgacaggccacagtgtgtgatgttccccaccctgtgtccaagtgttctcattgttcaattcccacctatgagtgagaacgtgcggtgtttggttttctgtccttgcgatagtttgctcagaatgatggtttctagcttcatccatgtccttacaaaggacatgtctgatttctttaattgggagcactttcacagccttcttttgcttttaggacattgatgtttttgaagaatgcagtcttgcaagggactgtgttctttgcagaattacgaagagaccaattaccccgtcacgatttgtattaggtttttattttttgggatggactctcgctctgtcgcccaggctggagtacgatggcgcaatctcagctcactgtgactcaagtgattctcctgcctcatcctcctgagtagctgggattacaggcatgcgccactgtgcccagctgatttttgtatttttaatagacatggggtttcaccatgttgcccaggctggtcttgaactcctgacctcaggtgatccacccgcctcagcctccctaagtgctgggcttataagatgagccaccgcgcccggcccctttttttttttttttttaagttaaagagacagggtcttcctctattggtgcacatgtgtggccatagctcactgcaaccttgaactcctgagctcaagtgatcctcttgcttcagtctccccagtagctgggactgtaggcacgtacaaccacatccagctgtattcatacttttaaagcttagaagaagttatacagcacaatggacctgcacaatatttaaaatatttttaaattagttagcatcatttaattgagagtgcataacaatctgtgtttttagcttcttttgagaaaatttggtaatgctggcttatgtaacagtgatggaccaggagttctccattttgccttgtttgcagttctcatctggcccctgtgagtatttgagattgtaatctctgacttagagtcatacaaacaaacaaaacattgaactttttttaaccaactcagatgctgttttgattaaactctttttttcatgcattacctcttaatgttatccaaattgcgcagtgttgtataagatttttgttgacttctggtcctggtggttttgttttgtttttgtttttgagacggcgttttattcttaccaggtgggagtgcagtgcagtagcacattcacagctcactgcagctttgacctcctgggctcaagtgattctcccaccttagcctcctgagtagttgggactgcaggcgcacaccaccacaccaagctaatttcttaattttttgtaaaggctgggtctcactctgatgcccaggctggccttgaactccttggttcaagccatcctcccaccatggcctcccaaagtgttgggattacaggcatgagccactgtgcccggcccttttccagtgttttgaattggagattgtcacatacctgtaacacagtggaagggaatccctattagcctcagatttctgttgatcattggaatttttttttcaaaagcatgctttcttggggaaatctactgaagactgaggaaacaaaagtagctacttccctcttccagatgtcttctaagtggaggaaaaaggagttttcttttttacagacagttaatagcaagccttaccaactcttggtcaaagttctggctcattatatttaaaagtagcttttgttcatttcctactttacagttgattagatttgatttgtctgtcttaggatttgtgtctagccaaccaccttttcccaataaaggaagaaaactatacacatttaaattgcattttgactttttccatgtctatttacattgccttggggcctcttggctaaatcttggtatttttctccctagttctcaaaatttcgggaaaaatttagttgaattatgtgtttttacagtatctaggggggactctgttaatggcctctaaagctggatattgtaagtttcctttgatagacattttttgctcacgatctcatatcttaaactattctttattgtagactgacttacaatgtatggcttagtggtggagtcttgataagatttgcattttataagaggccagtaatgtaggagaggacagcagtttcacatgtgggagagccttatacatctgtagggttgggaagtaatttctttgtaacagctcagtcacttttttcacttcacccattcttcacagtgacttagtattgctggtccttactatcttttttctcgttcttgaaaatgaaaagaaaacgtgaaagaatccaaccaatttcaaatatacatacacacacacttaggccttttaaaccttgagtttttcaaatactcccaggacgtgtaagcctggctttaatgtttcctgattctttggtcctcagtgagttatgattgaaagtagcagggctgagggttggtgatatggccaagcaactcatttcctcactgcacttcagtttccttctctgggaggagaactttggactagttgatttgctaagttttttttttctttctttctttcttttttttttttttgagaacagagtctcgctttgtcacctaggctggagtgcagtggcccgatctcggcccactgtaagctccacctcccgggttcacgccattctcctgcctcagcctccagagtagctgggactacgggcgcccgccaccacgcctggctaattgttttgtatttttagtagatacggggtttcaccacgttagccaggatggtctcaatctactgacctcgtgatccgcccgcctcggcctcccaaagtgctgggattacaggcgtgagccaccgcgcccgaccttttttgcattcttatattgggagattctaagtcctcctggttgttcataagtctgtaaatctgtaatctaactggaaaactctagcctcaacacatccattctctgtgtttgctgtctgctatacttatagaagtggacctcattggtggccctggtttaggttctcaattcctgggggagatatggtaattagaatttattggtgaatctttcttatctgaaggactagctgttcatattccttcaagcatgcttctacttctctccagtttgactgtgtaagccccctctgaggggtaaactgttgtggacttggtctgagggagactgcagactcatgctggtctcccacttactgtaaacatcttcctttcttccttcctggtgatcaccttatattccttggattcttagcaaacatttattgtactatgctccggggaagcagaattagaccagtgtccagagtgtatatacgaaggtctttgttttaaagagactgaaggatattaggcaatactaacaggcctttctgtcttaccagaagcacccctacccgtctgactgatagactaattgcgcattctttcattgatttttttttttttaacctaacaaagaaacatctccatttgcctgactttggctaaactctggtacaaagacgaacaaaaagtcttggtgtacaaggacccatctactggggaaatgcatatggaaacacgcagtgctagtagaagttgaataatattcataaaattgctccactgaccgtccgtggaaggcctgaattgttgttttttccccctaaggtctccaccaattcaggtttagggtgaccgttgtagcttttaggaaggttctcaatctgcacatcagccacctcctttcaataagctttcaccattacttgacctgttctcccatgaagaatattgatttgacatttgtcttgttgtagctgttgtctttagtatgacctcattccctataaagtgacccataggcaaattggtaattgtttgatttacagagaagccccaggcacttgcctgtcagttttttcctaggtatttcatgcctagcagctattacatgtttcttccctcttctctgtaggtgagaaatgagtggggtccctgcaatatcttgttggattttcaagtaaactaaaactgtttgggatagtaggacgcctgtaggttatggctctttcaagccttctaagaattcaaggagcaaaggaacatctactgtatctaataattattaaaaactacatctttagctgaacagattagttatatgataggtttattgttgaaaaataattttagggactgtttccttaaatgtattctagagacttaaaatatctagtatagtggttctcagagtttctacccagtatcagcattacttgaatttgttgaaattcatattttttaggcctcaactgagacctactgcatcaggagctctgactagggcccagaaatctttttttttttgatggaggaggggcagataggggcagggtttcactcttaaccgcctagggtggagtacagtggcaaaatcacagctgactgcaacctcaaactcctgggttcaagtgatccttccgcctcctcagcctccttagtaactaggactgtagacatgctccaccaggcctggctcaattttaaaattttaactttaatttttctggagaggtgtcttgtattgctcagcttggtcttgagctcctggactcaagtgaaactcccaccttggcctcccaaagtgctgagattacaggcatggaccatctcacttggcccagaaatcttttttaacaagccctttaggtggtcctgataacattttaaaattttggaagcactgatcttgtgcatgttatggtttcaatcttgtcaataagagtagtaaatgaaaaaagtacatatatatccatttttatttatttttgttactggagataaaataggaatcgatattatgtagtccaggaaggatcacaattcaagtttaaatggagctagaatctcttttagcatgtctaaaatgtgcatgttctgccctttggatagtaaaattgaaattggttttgtcggattatttatcttgaaggattcttttagaaaaaaattactttgttttgcttttgatcacagagaaaaatggaaacaggaaccctcagaagatgaacaggaacaaggcaccagtgcagagagtgagccagaacaaaaaaaagtaaaagccagaagacctgtccccagaaggtgcactgtttgcttaagatctctacttgggatgagcttaatctgctgtagattgggaaggataatgtcgtgctgaaatgagagctttaatgagatgcattgtgttttgattctgcgttttagatatctgtggttcactttcagccagcctacattgcaggtcttactgcttctttcttcgcagactggctatcgtggggcaaacatgtcttccgcttttagtaaaactccttatatgtttggccagggtacagtctctttttgggagaacaaattgtttaaaacactgtttgcctggcttaaagcatacttgagtggtttattaccttgttcataaaatctatataacattaaacaaataatctgattgtgtagagaaggaggtaggctgaaatagcagcaaattatgctaatttttgataagacagatggcagcctaagatagtgatgacaggaaaagggagtcagaagacaggccccagggaaaattacctccttgtagtattgcttagaatggactcagcaaactatgccctttgggccaaatttcatccaccacctattttcatatggcctgtgagctaagaatagtttttatagatgaacatttctaatttacagtttaaggatagagagcactaaatttgaactccaattaagtgaaatgttatcccctcaaaaacaattctgttctcattagtagatatatattgcagtaaatgtacctgattatttcattttgaattatttaaaaaaatttgtgaaaatttattttctttcattatgtaaggacctatacattggtccccattttgcctcttggctggcagagcctaaaatatttactctctggccatttacagaaaaagtttgccaacctctggcctaggacattgtacttaccccccaacaccagcaggggaatttgtcaactgaattttatcttattttatctcagcttaataagtttatctcagaactgtcacgccagttctgtcttttagaattttgctcattatttattacatcgttgatcatctgtttaggtttggttatgagaaaggtatgggaggtatgagagaaagagataataaatgtgatcatgagtatccatttctctccctctctgacttctttcacctttttatcactgatggaatatttggggatttccttaggtgagcttctagactgtggctttcaatcctggccatctccctggtctgtccaagttaattctgtgatagggcacacagtctctcaggtagtattccaggtatattttatacacatacagtaaaaacttatgtatagttacttcttgtgctttactttcttcacacagataatagcatcctctgctgcttgttctgtaggtttctttatcctggaaatcctttcgtattagtatacaaaaaactctttttttttttctatgagtacatggtactgtttagtttccagttgaagaatatttagagttttcttaatgttttgttgttgcaaataatgctatagtgaatactttattatgcctgtttaggtgtatatcaataggattaattcctacaagtaaaactgttaattcctacaagtaaaatagtttgatagctatttccagtttgcccaccaaagagatactatcatgaacaacatgctgtgtatgtgtttttatatcaggtaatcctgatgaacatttgtgaaacattcacgttctttcccataaatgattgaggattatcagcattagaatgaccttcctgttggaaatccagatttctagtgaattagaatttcagggagtagggcccaagaatatgcatgtttaacattccccaagtgaaatgttacattctgatgtatgaaccactgctctgggaaatactgttatataaagtagacaccaaatgataaagtgaagacttagccttttgtttctcttctcattttagaacagtgcccaaacctcgtgttaaaaagcagccgaagactcagcgtggaaagagaaaaaagcaagattcttctgatgaggatgatgatgatgacgaagctcccaaaaggcagactcgtcgaagagcggctaaaaacgttaggtaagttgtaccccagaagtgtttcactggtgtgatgtgataaagtagttggttagattttggttctcataagtccggggttgtgcacttaatagataaaaataacagcctatgtcctgaagttgttttcagaaatctggttagctttcttgcaaaaagagtggtattgagccaaggggaataggaaaagagtagcaatagctcatttgaagccttcattcctaaaaaacaccacaagttcgtgtcctgtccaatggtgacttagtggcattatcttcatttcataacatttttttccattaaagatatttggattatattcctacttctgaattgctctttgaatcacagacgtttttctgaggttcagcttaacgtattgctacttgaatctgattttatcaagtactaataggatatgaagcattaataggaattatcattagtgaaataggccaggctcagtggctcatgcctgtaattccaacactttgggaggccgaggcaggcagattgcttgagcccaggggtttgagaccagcctagacaacagggcgagaccctgtctctacaaaaaataagaaaaagccgagtgtggtggcggcatgcacctgcagtcccagctacttgggaggctgaggtgggagaatcctgggagatggaggttgcagtgagttgagatcacgccactgcactccactccaggcaaaaaagctagatcctgtctcaaaaagaaaaaggaaaatgaaataaaggaacagatatatgcaaacactagtagtttactttatagaaatcaagtatttttttttttagattttacagatttgttcttcatagagatggtgaaaatgaatcctagagatattcataacttattcaatgtatccagttaataattccaaagctaggactgggctttgagtatgctagtgtatagcctagcactttttcttactgtaactgtactacatccaggattgtttttctttcttgtgactcaatcattcattgttaatatgtgataggaagttacatatataaaaatatatataaaaaatataaaaaatatataaatatataaataaatataaatatatataaatattataaatatataaaaatatatataaatatataaatatataaaaatatacatataaatatatataaaaatatatataaatatatatataaatatacatataaatatatataaaatatatataaatataaatatatataaatataaatataaatataaatatatatataaatatatatatataatttttttttttgagacggagtcttgctgtgttgcccaggctagagtgcagtggcgcgatcttggatcactgcaacctctgcctcccggattcaagtgattctgctgcctcagcctccagagtagctgggattacaggcgcccaccatgccggctaatttttgtatttttaatcgatacggtcaccatgttggccaggctggtttctaactcctgacctcgtgattcacctgtgtcagcctcccaaagtgctgggattacaggtgtgagcctccgcgcctagccaatatgtttctttttttaaaccaggaagtatttgtgttgaagcttccagcagtctgggaatacttaaatttcatattcttattactgggagacaacatacagggttgacatttttaattttagaaatattgcttctctttttgcctgatgaaatagtagcaaattttttcttccattatggtttttctttttttgtgtggtagtctacttgtttacataataatctgatactaaaaaatgaaaaaaatagaagtgtccttatagttttctatatcttgcttatacaaatcagtataaatatagaatttttattttcaaattgagttagactccctacagttgtttaggagcattcatcagcactttaggaaaaaaaagtaagctttgagcctactgtaaatggcagatctataaaacaacatgcttttggaaccaaaagggtatggtttcttattctagtgacggttatgtgtggcagtttaattctgaagagatcatttctcatttattcagcattattcctcttgcagttacaaagaagatgatgactttgagactgactcagatgatctcattgaaatgactggagaaggagttgatgaacagcaagataatagtgaaactattgaaaaggtcttagattcaagactgggaaagaaaggaggtatgtgtatttggggagcaaattacattttatgtatgcttagtaagacttagattttaggtattttaactctaatgtgatgaattttagtctactgctgtatttgttgtgatatgtagaagtctttctgacccagtgtttcagagctgaggacaaaggtatgtgtacactatgtctttaagattttaaattaagctagtatagataagtgtcaatgttttataaagcagtgatatagcagagatacctgctaattaacattaagcaaatccacctttggttatttgtttcttaagctccttgtgaaaatatcaaactggttaaataaatattgtggtaatattgaagatttttaaatatctaatttagatatctcataactaagttgcattaaagtaaactttctgtaaaggaaataccaaaataatacttaatgctttttcttttggcttttttttttttttctttttttcattctggcttcgattgaggttaagaaagttaaccggggacttcgagtaggggaggttggaggaggatattttggtgttctatccttagtcttggagagagggatttgttttccgagttagtaagggaccaaaacaaaaggatgttgctgctctgtttttattgtttttgaataagggatttctttgatttcacctgcaaatttaggaatatgtaaaaagtggtttacatttttaaaatacttgaaatttttgattgagtccgttctgtgttgtttgtgagtttgtacttatttcaagttgaagtattttggtgcttcatccacaaagggagtcttcagataattgcattcttgggaagctttttaatatctggtgtaatatactctctttcaagtgtacttaatccttttgcagccactggagcatctactactgtatatgcgattgaagctaatggcgaccctagtggtgactttgacactgaaaaggatgaaggtgaaatccagtacctcatcaagtggaagggttggtcttacatccacagcacatgggagagtgaagaatccttacagcaacagaaagtgaagggcctaaaaaaactagagaacttcaagaaaaaagaggacgaaatcaaacaatggtatattttccatcatggattaaagaaatgtatttgcagcctgaaagaagggaaggttttaaaataatgcatggagatcacagctatctagaatctcagattttgctttgatcatctaaacatggagccatttacaattctattttataagattgtgaccttcagatactatatttttatatgtggctaccaagtttttggagttaactagcttatggagcgttattcacacattctttagttttcacaataagtgcatgagatttgtactgttattacccattttgtagatggggagaatacggcacacagcaattctgcaagtggactcaggttttgaattctgatgccctgaatccagagcttattctcttaagcaccttgttattttcctgtagttaggctggggtggcttagatgtagagagttaatattctggaactctctgggttatgatatacttaaaacaaattctggttttatacaatttgcagaaatgatgtgaaggaaattattaggttaactactgaaactgtgatagtcctcgtgtgtttagtttacttacagccttgaatgtctgggtgttgtatatgggaaatatgtggagctatagcacacaaaaacctaaactgggtaataatggtatcaagctcagcctgaagacatacctgtctgtgtggtgtgattagcctatttttgtgtctggaatgtgcatagatttttgtgtctggaatgtggacagtaattctggttttactactgtgcaaaatgtgctactttagtaaattacatgttttttctttgactcaaaactgaaaatatgtaccccttagatggtgaggtaggcttgtaaagcagttagaaatttgaaatcctctgaaatataataattctaatattaagttgctgctgttgtcatctgaaaggttttggtaataagaataactagttttccaagtcatgtttaatcaatcctaaaacccatatatatataagaaaaggcgtacagttttattatcctgatttgttgagatgtatgaatttgccacatgaatctatcacataaaagagttatttttgggtctctttttagacaggacacatcagaggcaggtaactggtatatccttctatgagtgtaaggttttcagtgttctctaaaagtgttttttttgtttgtttgttttgttttgtaaaatctctggcgtaattactagtaaagattacttaaggggcagatgggagtaaaaaataggttttcttttccacctttgacttttgctttgatgtatgtggatccccagactttagtttatgtgtactttttctgtctgtctgccattcaggttagggaaagtttctcctgaagatgtagaatatttcaattgccaacaggagctggcttcagagttgaataaacagtatcagatagtagaaagagtaataggtaagtacatggtaactcacttcagccatatttgaacttgaggaatagtggcttttgcttttggaagtaatgtaaattttaaaaatgcactttggagactagacacgtgctaggtttattttaaaggaaaagctaagaagatttgctggtaaatttggatgtgggggatgagagaaagaggtgttaagtatgacctcaagatttgtggcctaaacatgtagaagtttagaggtaccatttaccgaagtggaaagatgaagggaagagctgatcattggagtggagaccaagagcttagtttgatatttgtaagtttgatttacttcttagtcatctaagtggagaatatagtgaaggctggagcatatgtgaacctggagcttaggactctttagtctgggctggagatttaaatttggaaatttatcagtatttagtatttaaaggccaagattgaacaggaccatcagaaatagagtatcacgtggtaagaagaagtagtctgagagcatttcagcttttggaagtcagaaagaagctagcaaaggagactgagaaagaacagtcggtgagacaggaggagagctgagagagagtggtgtactggaagccaagtgattcacatagccaggagagaggaaatgctgtcagtcaaggacgattaggactgagacttgatctgtgaatttggcactggcaaaacgcatccatggagtggtgagggtgcggcctgattagggtaggttcaagagaaaatgagaggggatagcaagtataaacaactcgttgggggagttttcttacaaaggggaacagagaagtggagtgtcagcctgagagagagatgagaaaaagaatttttttcttcttcttcttcttcttttttttttttttgagatggtgtcttgctctgttgcccaggctggagtgcagtggcgtgatctcagctcactgcaacctctgcctcccgggttcaagtgattctcctgcctcagccttcccagtagctgggattacaggcaccccccacccccaccacgcccggctaatttctatatttttagtagagacagagtttcaccatgttggccaggttggtcttgaactgctggcctcaagcaatctgcctgccttggcctcccaaagtgctgggattacaggcgtgagccactataatcccattttttttttttcttttttaaggtgtgaggtagtagaatatatttacattttattcatagaacccaaaatctttcattcttcattgtgtttataacttttctgtcttattttttatttgtttagctgtgaagacaagtaaatctacattgggtcaaacagattttccaggtaagcaagaaattttatttataaatgttcttcaacatttcagaacagtgtatgttttgcagattattttgttttgccacatgatgttttattgattatgcataaaacagaatgtcatttttcacttttaattgacagttgctaatctataaattttttttatatgaaatagctcatagtcggaagccggcaccctcaaatgagcccgaatatctatgtaaatggatgggactcccctattcagagtgtagctgggaagatgaagccctcattggaaagaaattccagaattgcattgacagcttccacagtaggaacaactcaaaaaccatcccaacaagagaatgcaaggtatggtgatggttggcttttgttttttcagggagaagatatactgataaagaggattggacacatatgtgctgagaaaatattacaaaatgaaatgatgattgccattttgaagtgaaagaaggtgatttaaatatgacattaaagcaaaaggagagaatgaattatttcatggctttgctgacttgtttaatcttgcaatttacataattagaaatagagatatttgagagaatacttgaaaggatttaggcacttttattttattttattttattattttattttgagacagagtttcgctgtgtcgcccaggctggagtgcactggcactatcttggctaactgcaacctctgcctcctgggtttaagtgattctcctgcctcagcctcctgagcagctgggattacaggcacgcaccaccacttccagctaattttttgtatttttagcagagatggggtttcaccatgttggtcaggctggtctcaaactcctgacctcaaatgatccacccaccttggcctcccaaagtgctgggattacaggcgtgagccaccatgcccagttgcatttaggcactttaaaagagaagtgaagccagttgcagtggctcacacctgtggttccagctacttgggaggctgaggcggcaggattgcttgagcacaggagtttgaggccaacctggggaagattgtgatacccgttctctaaaaaaaaaaaaaaatagagagcgggaagtgatagaaaaggcgagtgtctttgaattctaagttagaaattaaatatataggcttatttgctagattggctgaataaatcctttccttggaatttattccatcaggaaactgatgtgcttgggtcctcagtaatgaaatatcagacaagtgatacgtctctgagaagttgacattcatgttaatggcactagaattctatctgtgaaaaccagtatttaattgccaaagagtgtgatagggaaaatgtggtcagagaagcaccaatgtagaagtctctgagctccagtggtcattgaatgggttttaagaggaagttgtggttgttgaactgcatctggcccttgtataatggattggtgctgctggctatacagacaagagggggcccagggtattgccctcctgtgaaaggtatcaagagaaagattcttatagttcaataggagaactactagaccccaggggtgaggagaagaggaatgatgttgacaagtacatcaaggtcaaagtgtgtgtgtcttggctacctcgaagggtattttgactttatctcctaggtattcgtacagctgagtacagtggcattatgaaatagttttatttagaaagcttcatgtaatagcagtatataggagactctggagtaagtaattattaaagccagaaggtccagccagtaagatgtcattgaagtccacgaatgaagaagtagtgtgaggacaagggaagtaacagtggcgtggaaggagtggatgggagaacagttatggggtaggtttggtaggagtggatggatggctgggttttggagttgagagtaagcagtcggattccattcactgccagccgccctcatagagaactgaacacatcaataaccttatcaaatattcttattagaatgatacttctcataatgtgtgctatagagcactaatcttcagagaaaagtcccctgaaaaaagactttttggccatgtaactttgagatacatccctgaatgaatttctcctgtaaattcacgctatggacacacatttcagactttgaaaagtcatgagtaaagaaattgtataactttttgatcggttgtttcctaaactgatttggccacagaatccacattttatgcaaaccatagagactgacctcactagaatgctatcctttaagcttctgggggtgaaaacaaccttcccttcagaagcttgtttctgaagggaaaaccaaattcacgcaattaaagggtttaaggtagatgggcggcatttctgaatttacaaatcctgttatggtgaagatcaactgtatttagcatatgacagctggaggcaatgttttgtactctttagaatcagataacagaaagatagttgtttctgaaaaataggagactctgactgccatataatagacaagacctaaagtgctatttaatgatgttcatagatttatttcaggaaaggggcaagttaactaaaaatattttatttgaggatgaactaactctggcttatggaatattaaccatgaagaaaggggtgatggagtgaggtggtgattcacacacatgaaatttaagtttttggccaggcgcggtggctcacgcctgtaatcccagcactctgggaggccgaggtgggcagatcacgaggtcaggagatcgagaccatcctggctagcatggtgaaaccccatctctactaaaaatacaaaaatagccaggcgtgggtggtggcgggcgcctgtatgtagtcccagctacttgggaggctgaggcaggagaatggcgtgaacccgggaggcagagcttgcagtgagccgagattgggccactgcactccagcctgggtgacagagcaagactccgtctcaaaaaaagaaatttgagtttttatgctttgatgccgaatatgtgaattgtggctagcgttttaacatagtagcagtaagaacattttctcagacttgggcttttgtttttcaggccctgaagcagagaccacgatttgtagctttaaagaaacaacctgcatatttaggaggggagaatctggaacttcgagattatcagctagaaggtctaaactggctagctcattcctggtgcaagtaggtagaaaaatatgagtgcaattttccttactgtttctggcttctttattgttagatgtcaagaattttttttttcttttttcacacccttattgtatctcaaccaagaaatctttatgctgcatattacagaaataaaagatgattgagagaaatgcttcctgggagtttttatgtatgtgtaataccattttattctgatctaaagaatactttatttcattatttggtgggtaatttgtcatagccagaaacctgtatcatcatatgttactcatgagtgtatatagcaagttaagtcactcaaatctttaatgtggaaggagttactcagaagaaagaagaagatgtctttttcacatgtattttctttctaggccagggaagcctttaaattaatttcctacagtagtgctgtagagagtgtgattcccctcccttcactccactccctacctatatagtctgtaggattatcctgttcagaggaaggttgaacctgtgaaagtatcctttttataagaccacgttaatcttgggggggtgaaaaaaagatgagacagtgatagcactggaggtttaaaggtacttttgggaagtacttacaaatttccttcaccaatttcaagtagttcctaattactaagtgctaggtgttagaaacaaatgcttgttcctcggtgctgaaaagaactagtgctcaaggaattttctcagcaaggcaattttactttctgcagaaagggtgcttcttggaagcctaattgtcatgagagcacaccgaacaaagaaaagcagaggtttttatccctgactcattgggttcttactgctgcgtcctgtctccattggctggagctggaccgcacaatctagactgattccgattggctaaaagcttaaaactttcctaaatagataaacgcgcagtggaaaacaaaggaagggggttgtttacaggaaattaggagaataataacatttccaaataaggaaggggtgtaggctgtaagctgggaaatgcctgggcacgttcggacatgtctgagcaggttatagtccagaacaaataacctggttaaagtacaaggacatagaatgtacttattcccttactatatttaacagccacatagggcttaacaaagagttattagcaaaaagcaagggagcttgaaggaagttaatttctaaaagaaactgttatttctaacacttgttatttattctttaacaaaaagggaaactttgaagaggaactttttacttttcacatgcggatccattagtcctcgagaatttaacagtgaacctatatagatgtattttgctgtccttacagaacatgcagtgtaagaagtacctttaatgccaacctacacacttctttcccgaagtacccaattaagtgcaaatgcttaatgtctttagtgttttatagtaaagcaaaaaatccttatttagaattagaagtacaggcctgtgcaacatggcaaaaccccatctttaccaaaaaatacaaaaattagctggacatggtggcatgcttatgtagtctcagctacttgggggctgaggtgggaggatcgcttgagtccaggaggccaaggttgcagtgagccattttcgcaccattgcactccagcctgggtgacaaagtgaaacttcaccttaaaaaaaaaaaaaaggacagcttaaaaaatatttttcccctcattgctgaaaggaagctttctagttatagagatgcatttacagtgactttttcccaagtgaaccatctcctactttttatctgataaaatctagtacaatatttaatactcagttgtgaaaattaggtgtcttgagaagattgagaatgtgggtttgatataatgattctgaattgcttaaaaatgatttttccttttagaggttagtgggacctaattcatctaaatgacagttaataaaagttagatgaactttaattgtgatctaatcctctcattttataattgaagactcttaggaacaaaggtgccgtgtacccatccagagtcacatggtgttttgtgtacagtccttggccagcattttttagactttttattttttagtttttttgagactgagttttgctctgttgcccaggctggagcgcagtggcatgatcttggctcactgcaacctccgattcccaggttcacgtgattctcctgcctcaggctcttgagtagctgggattacacgcacgcaccaccatgcctggctaatttttgtatttttagtagagacggggtttcaccatgttggccaagctggtcttgaactcctgacctcaagtgatctgcctgccttggcctcccaaagtgctgggattacagccatgagccaccgtgcctggccagcatttttttactttaaaccaaaggaataaaaatcagttgaaaagggctcaagcacctgttaagccctggtcacaggaatgttactacattacataatgtgctattttggtctggttccagaaaaacaggtgaatcaattcaaacctactgtagtctgtatatgtagacaatggcattttctaggggcaggaaatactggagaaacttaactgtgcttcctcctgaatagtattgaaaagtgagggaaataagaaggaaattactcaaaggaatatactacatcgtttaaactgtgtagaaaattaggtgtacctgagatgtataggggtatggcttcatcattctccctttcccaagtgtgatcttctttgtttctgtattttaccctttaaactagctagtttgtagaacacagaaggtatttttagaaattatgtctttttggtgaattaaatgtcttgttttttgaatcagttaggttgcctttaactcataaattacttttagttctttctgatttgctgattaagcacatattatatatacgtgcaaactttcagtgtccttattttccagaacctttttataatgtttgcaatctgatgtcttacatgtaatcctaatttcctgccaaaatgactgtattctgtttcccaaatatattttcctaactctggctgtttcttcaattttaaatgtttttcttagatattctttttccattaatatcctgttgaaatctagcccattttgtagagtagtgtttctcaaactgtggttttaaggtagtgcttcccaacctttttggcactagggactggtttcgtggaagacaatttttccacaggctggggaggagggagggggatggtttctggatgattcaagcacattacatttattgtgcactttatttctattattattacattatactatataatgtagaatcagtgggagccctgagtttgtttttctgcaactggacggtcccatctgggggtgatgggagacagcaacagatcaccaggcattaggttctcataaggagtgtgcaacgtagatccctcacatgtgtagttcatagtggggttcatgctcctatgagaatctaatgccgttgctgatctgacaggaggcggagctcaggcactaatgccagcaatggggagcggctgaaaatacatatgaagcttccctccctcacccgctgctcaccttctgctgtgcagctgggttcccgagtggggaatcctggtctggtctaaggaatacctgagtcagaatctccaaaggtgtttgtcagcccttttccatatattgtttagtatatctagggtggggtccacaagtatgatctgtagcctacccctgctttagaccaaagtgtatttaaaacaagccccatgcacctatacatgtaggtctaggaaatagtgtgggtggcattaaacaacccagtggcctgcagtggaatggggtgggccagccacaggattcaccagcggtgctgatagctttctctattgatggagtctaaggttacatgcttgtcttcactttttacaaagcctgtcttctctgtgataaaagatagcctatggaaggtgatgtgaaaagcctaaaggtaaagagtctgacaaggctgtcatagtaatccaagtctaggtaggccacttgttattctgctttttatggtttctactttcttccttatgttgaaagctgaagtaattgcagatgagaagaaatacatttgaggcttatgaatgacaccttgcttggctgttattgtgaagcattggtgtcgttgctgtttatgcacattctgtgttttggtgaactaatgatttttttgtttttatttattttttctttctgcagaaataatagtgtaatccttgctgatgaaatgggcctaggaaagaccatccagaccatatcattcctctcctacctgttccaccaacaccagctgtatggcccctttcttatagtcgtccctttatccaccctcacctcatggcagagagagtttgaaatctgggcaccagagattaacgtagtggtttacataggtgacctgatgagcagaaatacggtgtgtaaacaaaaagagctgggttagaatctgtgttataaatgtaatttagaaattcacttaaagccttcagtagatcatcagtaaaatttgtggttattattctgatactgtgctgtgttctcaatattaggaggtttatctatcacaaaagtgcaactcagatgttctttaacaaatatgcttactagttaaaaagcaacagcagtatgtgagtgggaatctcttttagctgggttgcaatattaaatttttcttctctctgccctttttacttctaagattgctttatatgagataatatggagttaatactttgtgtaatattaatattatttttgctttctcaatagacatattactgaaaataatcattcttcgaatttcttaatttcttaaacagtgaggttgcataacttataaaaaaggaataaaagtaaaggaaaacaagctattttaggactgtagaaataagaattatcctaaactgttaccaaactttatttgggcatcatgaatttagaacacagtgacttaagtttatctttgtttagcagatcttttctttatagtaactttttttaaagcacctactgtgtgctagatgttgcgctgggtgctttacgtataatacctgtaatcttcatgatagtcttcaaagctgatggcattctttcctgctactgatgaagaattgactcagagagtcttaacacgcgaccctagcgagcaagaatgtggcagagctcagattcggacacaggtgtttctatctagtctagagctttgctctttcatcactgtatataaactatttctgggaaattgcttgtaataagagcaagccattagcaatgtttaaatatttgagttgcatgttgtaaccatatattttcatacaaattcaaatttatttttggtaaatactttcattaaaattgtgtaacttaaacactggctgatttcattggcctaattttgagtttctaagaatatagttttagctttgttaaatcattagttaaccgttaaagacgaaaaaagagaaatttataggtttacaaaatagcgtaaagcactacattccaaaaatgattgcaaacaaagaaaatgaactctaaaaaattgtagtcagagaagttttccttgctatctccagttctccttttctttgttctttttacccccacttgggggcgatcacctgcaggcacttactgtcttgttctccagttcctaacttgacagccaaactgcaagagcgttgtcatgagtcttcgtgcttgctgagtgtccagttatacttcagtatgaatgtactcatctttgtgttcttttacattgacgttattatacgtattgcattatattttcatcttacaagcctccctttttgttgggggacatatctctttggtctatggttgatgaagttccaaaggttggaatttgttttacttgttaatatatgtattttcctattcaaaaagtaaataaattgcatttttaaaagaaatttctaaggatctgggagatcccttgttgagttccaatcaccagggttcagtagctgatgaagtgcattttcttcagtagatgtatttctgggggccagtttcttctgattctggcaataaagcttttgctgttcggtggtcagtgttttaattctaactcttactgctttatagtttggttgcttaggtcattttagaatgtgagatattcattgaattctaatcagatttattttttatttggcatgtttctattacatcaatcacaaaacttatgtgatatagaaaggtagaagtagaaattatgtcttaattatgtttttttcttatagatacgggaatatgaatggattcattcccaaaccaaaagattgaagttcaacgcacttataacaacatatgagatcctcttgaaagataaggtgtgtaattaatatctaaaaggctaaatcttttccagtgcgacttgtccagatggtagggtctgttactgttctgtggagcatgttagaaataaatacttgaaagttaaaaataaaaaacaaatggtagggtctgtacctcctacttgccatgttacttttcttctcttatttcaaaaagcaagcaaatgaacaaccagaaaaattacttttcaaaggatattaacgttataaatagaaaacagaaccctatagatgaggggaccttaggtcaccaagtccagttgaattaaacagaatgaaagggtattgaataggtcagtaacttacctgagattattgtcagtcattggatgccatctcaggtatttcccttgaatgtcatcttaggcatttcctattgtatcattgttaaggcatttctccagaaaagatgatgtgaatggtctttgtgaggaggacaaaaataagaagctctttaaataccgcctttctgctaagaaatatatgtggtaggtagatcccattggtattaagtgcaaacaagttgagtttggtggctcttggtgtttgtgtgcttcagggttggggtggagaataggcaagagaaggaccataattaaggggagaatacagaatcatatggtttttttgttttatttttgcccagcatagcaatttttgtgttcttgctgtggggcatgcagtaatagctggtataagaggcccacctataccttttagatgatgatactctcttttgaatagctaccaatctggcaactaacagaataaacagaagaggcctaatatatattgtcagtgaagaataaatgtgtcaatttatacctttgtaatggtatttatacagagataattaacacttgaaagcacttgtgggttcccttctgacctggtggctcgttctgttttgtttttactttagactgtgctgggcagtattaactgggcctttctgggagtggatgaagcccatcggttgaagaatgatgactctttattgtataaaactctgattgatttcaagtccaaccataggctcctgattacggggacccctcttcagaattccctcaaagagctctggtccttgctgcactttattatgccggagaagtaagctccttcctgtgtatttcaaaagatgctagaatgtctgaaatgccaatgctttttaactttcttagtagaccttagggaaaacagatggcatggtttggggaaagcaaagcgtcaaatggaggcagggatggcggtagtaaaatgtttcataatcaatgaaagaaggcacagaaattagcctgttaaggaggaaagcagtattgtctgctgaaaggctgaattagttaatgcacttgggaaataattgttaaatagataacatcagaccttttcactgttggtataagataatcaatataagtaaaatgaaatatacaaggtacacaagcactgaaaagtatgttatactcaaatatctgataaccgaagcatcaattttacatcttattcacgtattattaaagaactatggaatgtgtttattgaaaagatttttatgggagagatgatatgcacatttcataaaacttaaaattatccaatggtattcagcgatacttagaataacatctatattcattaatttggaggactccactcagtctggccccttgacaatagtctgattcctctcatccactttctccattactcattatgcttcagccattctggctatctttctgtcccttaaacatgccaagccattactattccttcttgactagaattatatttcttcttgtcttcacatggccaaccaccttaatgtttcagctcatcttaaacgaccacctcctttcagaaatcttttgcagattgcctaacctaaagtagccctttagacatcttatccctaacctgttttagtgtctatatagcatctctttttacatttatgttctcattcatctcatgtcattaaattatgtatgaaaatcgcagggattttgtttgcttgattcattgctggttcccattgtctagaatagcacctggtgcacagtaaacaattcagttaatagttgttcagttgatagatatatgctctacaatctttttttttttaattcaggattaaattttattttttacttttatttttatttttaaattttaaatttaaatttgtttagtaactttatagtttgcaaccatcatcattgtccagttttggaacattttcctcatcccaaaaagttcccccttgcttgtttgcagttaacctctgcttccacatatagccttaggcaaccagtaatcagcttttgtctctagagatttaccttttctagaagttttatataagtggaatcctaatatgtaggcttttgtttccggcttccttcacttagcatattttttttgagattcattcatgtcagagtctgtcagtaggtgttctctttcattgggtaatatttcattgcatccagttaccggttgatggacatttggattgctttgttttggggttattatatctttgtgtggacatatgtttttctttctcttgcttagagacttaggaatagaattgctggattgtttggaaagtttatgtttaacattttagaaactaccacgctgttttctaaagtgactaccattgtgcagtcctaccaaaaatgtttgaaggttctagtttccctgcgtcatcaccaggacttggtgcattgtcagtctttttgattctagccgttctggcgaatgtgtgtcattgtggttttgacttgcatttccctaatgactaatgatgttgaacgtcttttcatgtgttcattagccatttgtatgtctttggtgaaatttctattcaaatgttttggcattttaactcaggcgtcgtgttccgtcattggaactctaagcatgtgggaattatttatatcctactgctcaaggtcattgccaaggtctgattgcaaaaaattcaaaaaattgcaacctctatcataaatgggttaaaaaaattggattgtttgtcttattatgagttgaagaggttttttatttcttttaaaaaaattctaaagacaagtgctttatcagtacagtccccaactttctatagtttgatgtaaaatgttttgacttttcagtggtatgaaagcaatacactttcagtagaaagtatactttgaatgaacacaaccattctgtttttcattttcagtgtaatattcgataaattacatgagatattcaactctttattataaagttggctttgcgttaggtgattttgctcaatatcctcatgataagcgttctgagcacattcagggtaggctacggtgtgatgttctgtaggttaagtgcattaaatgcatttttgatttaacaatgttttaaacttacgatgggtttctcaggacataaccctgttgtaagttgaggagcatctgtatataatttgaacatattttatcccaatctgtggcttcttttcactttttgaatgttgtctttcaaagagaaaaagttattgattttgatgaagtttaatttatggatttctttgtatggattgtgctttagatatcatatctgacacagatttgcctaacctatggacacgaagacttgcttctttatttccttctagaagttctagcttttgtattaagtcagagttacattttgtttatagtgtgaagtgtgagtgccttagttcatgtttttgtagtagaatttgggaaattgttctagtatcacttgttgaaaagaatatctgttcttcattgaattgccttgacactgttgttgaaactcagttgacaccataaatgtcatgctttgtttctggactgtcagttctgttttattaatacatatttctgtccttctgccaatgtcacactgtcttgattaatgtagctttcgactgtttttttattttttattttttttgagatggagccttgctctgtcacccaggctggaagggaagtggcgcaatctcagctcactgcaacgtctgcctcccgggctcaagtgattctcctgcctcagcctcccaagtagctgggattacaggcacgcaccaccatgctcaactaattttttgtattttagtagaaatggggttttgccatgttggccaggctggtctcgaactcctgacctcaagtgatccaccgtccttggcctcccaaagtactggtattataggcgtgagccactgcacccggcctagactgctttttaaaaatggagaagtacaagttccattttcttctttttcaaaattgttttggttattctagaattcttgatacttccatgtacattttaggatcaggttgttaatttctgcaagaaaaatatggaattttgatagaaattgtgttgaatcatatatcagttaaagcaaaattattaatattgagtcttctaatccataatcatggaaagtttttctccatttatttagatcttctataatttttctcagtgtttagtggtttttagtttagaaatcttatacattcaaaatattcttttaattctgactatatttggagtggaatttttaaaaatataacctattatagaactacaattgggttttgtatattgatcttacatcctgcaaacttgataaacttactgttttctactgtgtgtgtatgtgtgtgtatattgttctgtatttcttagtatttttctatagacaggattatgttttctgtacctaaagatttcttttccaaaatggatgctttttatttcttcttcttgccttattgtattggcaggaacctccatcttaaatagaaatggtgggagcaggatgttggctatagatgttttttgtagataacctttattgggttgaggaggttttcttttcttcctagtttgtgaggttttaataaagaatggatattaggttttgtcaaatgcttattttctgtgtctgttgagatgaccatgtggttttgtcctttaacaatatagtatattacattaattgctttttagacattaggccaactttttttttcctagcataaatctgacttgttaacagtgtttgatactttctatgcattgctagattcagttggctaatattttgttaaagatttttgcatctgtttggtgtttttttttttttttttttttttttttaagacagagtttccgtctgttgcccaggctagagtacaatggcaccatctcggctcactgcaacctccacctcccaggttcaagcatttctcatgcctcagccttccaggtagctgggattacaagcatgcaccaccatgcccggctaatttttgtatttttcgtagagacagtggggttttgccatgtcagccaggttggtctcgaactcctggccgtaagtgatctgcatctgcctgtctccgccgcctaaagtgctgggattacaggcgtgagccactgtgcctggccgcatttgtgttttttattttaattaggattttagtctatagctttttgttttgttttgatgtttacgttgctttggttttgggatcataaaatgaattggagagcgtttcccttctgttttctgaaggagtttgtgtaagtttagtgttatttcttctttaaatatttactagaattcaccagtgtagccatgtcaaccttcactttgtgggaaaatttttaatgactaacctggtttccagttacaggttcacttaagttttctattcttcttgacttagttttgttaatttgtgtctttctaagagttagtctgtttcatctaacttgtcctaatttgttggcataaagttatagtactctcttagccttttaattttagttttcttttttaagagacatggtctttctctgtcacccacgctgagtgcagtggtacgatcatagttcactgtaacctcgaactcctgggctcaagggatcctcccacttctgtctcttgagtagctggggctgcagatgtgcaccacaatgcccagctaatttttaaaatttattttttgttatttgtagagatgggttcttgctgagttgtccaggttggtctcgaacttctgggctcaagtgatcctcccgcctctgtttcctaaaatgctgagataataggcatgaaccactgtgcctggtagattcttttaaggatcaatagtgattaaagttaattttcttgattatggtaatttgtatcttagctctttttcttggtcagttctagctaagggcttaacaattttgatgctctcaaagaagcaacttttgacatcattggtttcttcctctgttttttcttctctttttttttttttttttttttttgagactgagttttgcatttgttgcccaggctggagtgcagggtgcgatctcggctcactgcaacctccgccttccagtttcaagtgattatcctgcctcagcctcttgagtagctgggattacaggcacctgccaccacgcttggctaatttttgtatttttagtagagacgaggtttcaccaagttggccaggctggtcttgaactcctgaccttgtgatttgcctgccttggcctgccaaagtgctgggattgcaggcgtgagcccccgtgcccggaccctctgtttttctgtttatttccactctcaaaggttgccgtcctttgcttgcttttcatttaattttctctttttctcttaagatacagtttagattactgatgtaaaacttttttcttttctagttgtttaaaggtatgtttacttctatgcactgctttagctgcatcctgtaaatactgataattttgtgtttttgttttcatttgatttcatctattttctaaattctctgtgatttattctttgaagcatgggtttttcagaaggatggtgtttaatatccatatatttagggattttccaaatgtcttataattcggttttgtcttagagaacatgctttaaatgaatttattatgacttattaaatagtcttagtatgctttctttcctggagactgtccgataagtgcttgtaaagaataatctgtattctgcctttgtttgagtagtgttttgtaaatgtccgttcagtgtggtgttaatggtgttgttcaagacttttatatcttttctaactgccagtttagttgtgctttgaattattgagaatgaaatattttaatttttaactgtagttgagtttttgtcttctagtcattttttgcttcattattttggggttgttctgttaggtatgtatccattcataacttttgtatgttcctgaggtattgacctttttctggtcaatatcagaatgtcccatttgacctctaatgatatttattgttttgtaaatccattttgtgtgattttattatagctcctcagctctcttctgattcctgtttgcatgatatattgttttccatcattcgaactggttaccatttgcatggtatactgttttccatcattttactttcaacttacttctttctgtaagtctaaaatgtgtcttatagacaacctgtacttggatgtaccttttttatccaggcaaataatccttgccttttgattggaatatttagttcatttacatttaacagaattaataatatggttggatttatttctgctattttactatttgttttccatatgtcttacatcttttttgttccactttctcctttattgccctcttctgtttcagcaagtatttttcagtgtgtcattttaattcctgttaattttttgctattaaaaaaattgtaattggttgctgtagggattgtatgcatcagtcttcttcaggttagtactgactcagttctggtaaaatagggcaactttgccccgctgtagctccattttcacttccttatgttataaatccaagaatacaaggaaataattattgctttccacaggtttgtcttttaaggacatatagaaaagagaaaaaaaatatatactatctttcatatttatccatatatttgatcattttcagtgatcttcatttcttcctgtgtattcaggtcgctgttgggtattgctttcttttagtctgaagggcttcctttatttacatattgcaaataagaatatgctggcttagatgattaaaagatgtcccgtatgacacagtcaataagtagatagacgaagatcaatagcaaatcttctgtgaccaaggccagtgtcctttgaacttcaagttctaggagaaaaaaatacatccttcataaaaccattgagacgaagtaaggtcaccctacgtagtaagagttatgagacacagtgggaacatctgtgcttgtttttatagaaaaagaattgtggtatgtagtttctaccagtgaatacttagccatgatttgcttttgtgtacctacctgctgaagtggatggtagggattttgctcctaagtggtcataattagctttttcctgccattaagtagctgtggcattccactcagcatgggctatgtttggaaaaatgtcatatatccttcttttgtaattggagagaggaactttcaattactttatcattcagggagtctcttccaaaattttcctttggccagttgaatcaattatggaatgataggttagagttagagatgcaagtttttttctgtgaaagagatctttttttctttgaaaattttgtgtttaaagcattgtcattttcaaataaagtttcaaaattgttgttcacaaagatatgtatatgaaaaggaaaccaattagttaaggagttcagatttgcccttatttctgcctgagcttgctggatgggtaactatagtcttgtgaagtattttgcctcatcctcagcagaagttcctgaggtaccttaggactctacagagcttttgaagaaaggatccactgaagaaaaactattgtaaaggagagaattaggtttagtcaaatagctttggaacttccccactcaaatgttacaggctattgtttcaaaatccaaaagttagtcctctttttaaccaactgaaattctgtttccttagtatagagtctaagtgcctttcctgcagggtggctctgacagggagtacacatgactaaccatattgggaatacttatcaatcaatagcttcattttgtacatactgtttgcaaagcatggaacttggtattaagggtagaaaaagatatgacaagattgaaaaattcggcttataaagaccatcatgtgcaaatatatacttcagacttaccgcagaaaacaagtcagtttgatagcatgtatttcagagattacatcttttagtgttgggatgattttttaaatttttacttctgtcgtctaggccaatctcttaattttttttgcacttttccttttacatatttactgtgtgacttttagcataccattttcactgctttggtttaatttccgttgttggtccttattaaagtaacctatttttctaaaattccgtgttctgcaaagctataaagatcagaattttttctagttctgtgagagacaaatattaaatacagaagttgatagcagggatttatctaaaatatgaatctttagatgtaacatggtgtctttatacatcaccactatgaccttataccttttctatatctaatattataaattaataattgttttcagggcagcagactttttctaaagaatctgatagtatgccgggcgtggtggctcacgcctgtaatcccagcactttgggaggctgaggtgggcagatcacgaggtcaggagatcgagaccatcctggctaacacggtgaaaccctgtctctactaaaaatacaaaaaattagccgggtgtgatggtgggcgcctgtagttccagctgctcaggaggctgatgcaggagaatggcgtcaacccaggagcccaggaggcagagcttgcagtgagccgagatcgcaccactgcactccagcctgggcgacagagccgagactctttctccaaaaaaaaaaaaaaaaaaaaaaaaaaaaaaccaactcagaatctgatggtaaatatttttggttcatagcccacacagtcattgttagccactcatctctgctgtttagaggaaaagcagccatagagaattcataaacaaataaatgatacttatatctcctcagtgtgtgtagatcaagaactagtgtctcatattaactcccttaatataataagagtacagtaggcaggtgaaaatatttgttgcttaaaacatagaggaagtaaatcttggaaataaactttacatttaattttttagattagtaaagttttaatttattataacatgtgttaggtaaattagcttattgaaattgtctctcaggtattcagaaaatagcctgatacagtgatatttctacttctactgatttccggtcacttcacacatttagtgtgtgaggtatcatctccagcattgagatagttcagttttctttctttcttttttcttttctttttttttttttttttgagacagagtctcactgtcacccaggctggagtgcaatggcatgatcttggctcactgcaaccttcatctcctgggttccagtgattctcctgcctcagcctcctgagtagctgggattataggcacttgccaccatgcccagctaatttttgtatttttagtagagatggggtttcaccatgttggccaggctggtctcgaactcctgacctcaggtgatccgcccgcctcagcctcccaaagtgctgggattacaggtgtgagctacttcgcccagccagagatagttcaattttcattgtgcatttgaattattagttttaattcctcacctattttatgttcttggagtatttgcttaatagcatagcagtgtgagaaaatacagtttaccttaggtttatcaggctgtaggctttaatgacgactttagatgtctaccccaaaagatcatataatctgcttccctgtagattgtttcaggccataccgggtgttactaaggctgatgttgattcacttaacaatacctgataaaatgtatggctggatatggtggctcaaacttgtaattccagcactttgggaggccgaggcaggcggatcacttgaggtcaggagtttgagaccagcctggccaacatgatgaaaccctgtctctactaaaaatacaaaaattagttgggtgtggtggtggcacctgtaatcccagctacttgggaggctgaggcaggagaatcacttgagcctgggaggtggaggttgcagtgagctgagattgtgccactgcattccagcctgggcgacggagcgagactctgtctcaaaaaaaaaaaaaaaggaatgactatttatgagttcagaaatgacggtgactttcttgaggctgttgtatccattggcagtactggcaccagctatatctgacgttccatcttaccagagggcatgtgctttgagtagttactgagtagttctagatgatgttggttacatgatagactgaagtattttattaactctgaattcagtctgagaattggaaacgtgctattatccagtgtagactgatggagttgatttcattttacttttcccctttttgttttcccttctatttaagagctctagtgattgataatgtctttccttatgggaaagattcatttttttacagttttttttcctattcttcttttcctcaatgtggctaaataacactatactgtttcttccctaggtttgaattttgggaagattttgaagaagaccatgggaaggggagagaaaatggctaccagagtcttcataaggtgctagagcctttccttctccggagagtcaaaaaagatgtggagaaatcccttcctgctaaagtggaacagattctcagggtggagatgtcagcccttcagaaacagtattacaagtaagttcttgtttgggttaggcctgaaggggttgagatcagtaccatgaaactattagataggagatatatatatatacttttgttttttttttttttggagacagagtctcgcgattctgctgcctcagcctaccgagtagctgggattacagggatgcgccaccacgcccagctaattttttttgtatttttagtagagatgggatttttccatgttggtcaggctggtcttgaactcccgacctcaggtgatccgcccacctcggcctcccaacgttttgttgttattaagcaaaatttcaatactgttgttatgtctaaaaaattttaataattccttaacagtttcgtaatatctagtgtttacattttcctggttgtcatatacatgtatgtatatctccgtttgtgcatgtgccattttgcttgttttgggatcgatgtaagctccgtgcattttgcttgttttgggatcgatgtaagctccgtgcattttgcttattttgggatcaacgtaagctccatgcattttgcttgtttggggatcgatataagctccatgcattttgattggttggtatgtctcttaagtatattttaatcaatttatttttctttgccttataaattttttgagtcaggaaactgaatttatgttttgtagacttttctcacagtctggattttgctgattctagctccatggcattctttaatattttcagccaggtgtggtggctcacgcctataatcccagcactttgggaggctgaggcaggaggatcgcttgagcccagtagtttgagaccagcctgggcaacacagtgagactccatctctataaaaataaaaaaatttttaaaaaccacttttcctctgaactgtgttttctgtatactcataagtaagtgtaaaggcttgattagactcagattcagtgtgactttagaggcagaggaatattgtttcacaggataaatgtccttttttgtgatgttagtgactaacgatgagcattgcctagatctgttaattcattagagagtacaaaagggtgatattcaaattttatcactcacttgtttattaggtggaatacttttataaaaagaaactttcccatgtcagctgaggaacagttcatgtaggaaaggcagaataagattcttttttacttttgccattttcaaaggaaaagatctacttttcttcaaaggttttgaccaatgagatttactttgatatgattatgaactcatcaattacacctatttatgtttaattctgttggagttaatatccatattcatgctctaacagtcccatttttagctagtgggaactcattcaagttggttgttgtagtccttttgacataaccgtaatagtagttgatagtttctttgctatctggaatgattaagtgttccacatccatcttgtacatttcctgccccagaactagagtcagccatttatccaagaagttctgcatactcctttactaggaaatgatatttgtttgtttctgtttttcctctgaaaatagtttaatactgtaaaatgtaaaaggggaaatagtgttaccttagtaacaacatgaatgtgtcagttggtcagtgctattttgggtgttgattgatcatatgatttttctggcaactctagatacttccagtttacttaagttgatttagttgagtttttatcacttgcaatttaagagtcctggctaatattctgttgccttcaggctgcacaacatgcaggattggggaaagcactagagagccaaagaaagtgagcagagttacttcagggccaccagcgttccccgcaatccctgtcctcaggcataggcccttctgctcttcccactgtagagcagcacccatccccaccaaacctcacttctgggtgtgacttcataggctgtcgtgttctgcagtaccctcgagtccgaggctgttgagtctgaaggatcctcagaagactggcctctttctgatggtttatggactatggcaaagatgaggaaatggtatttggagaccacatactgggccctaggggtgctctttgcaactgcaacaaacatggacagaattgggaaatttgtttttaatggtaaaaatacatgatgaacagtaccacagagattttatttgatcttactgatcttatgccatactaaaaatctcacttcccaaccacaccaagctaattcattctatacatacaacaaagctaatactaccaccaacaataagaatagtaaaaacaggttaagattttctttttttttttttttttgagacggagtctcactctgttacccaggctggagtgtagtggcacgatctcagcttactgcaacaggattttctttttacaggttttgtttttacttttttttttgctttttaaggttatataccacaagaagtggaaaagagttttaaagtactcaagatagtttttcttctgtgtctttaggcaactaatggttacatagatttatttatttcattttagttttgatttttagggattgctttaattttgtttttaaattatagtatttgtagatttccaaaggcaaagctacaaagcctggtatgttcaaagaaatgtagcttcagtccctcttccctccattctagtccatctttccccataggtaattattattattattttttgagatggagtttcgctcttgttgcccaggctggagtgtgattgtgtgatctcagctcacctcaacctccgcctcccaggttcaagtgattctcctgcctcagcctcccgactagctgggattacaggcatgcaccagtacgcccagctaattttgtagttttagtagagatggagtttcatcatgttggtcaggctggtctcgaactcccaacctcaggtgatctgcccccttcggcctcccaaagtgctgggattaacaggtgtgagccaccgcacctggcccataattattattattttttaacattttaatgcttatccttcctttaacttttaattattaaataaaagcaaatgcattttaactttgaatatcctcctttctcttaggtaagtggtagcataccgtatacacttttctctgccttccttttttccttaatgatacatggctgaagagcaccccatagtagcttatagagataggcctttatgatgcatagtgttccattgaggttatatagtatggtttattcaaccagtttccttgtggtaggcacttagattgttttacctacttttataaatagttctggagtgaagaccttgagatagattcctaaagtgtgatttctaagagaagcatgaagaaattgcgccactcaggaaaaaatgtacttttactattttggagtttgtggttaaggaatatacatgggtatacatgaatatatctgtatttctcctccaaatttgggtagaaaacatactgataagttattttgtcagataaaatactcttttacaatgttaaaatgggtatgtagcctctattttatggtatatttacatttatttaacctcataatgttagcttatttccaatttttatatttcagtgaagagtgtttcagtgacagtcattttccattcacacatgcacacacaggttgagtctcttatcaaaaatgcttggggaccagaagtatttcagattttgggatatttgctttatacttactagttaagcattccaaatctggaaatcagaactgtaaaatgctctaatgagaatttcctttgagcgtcatactggcactcagaaagttttgagtgccattttggaacattttagattttcacatttaggattctcagcctttgtgtacacacacacacttaaatatgtataaagtacatgtgtgtaaatatgtaaaatgtatgtatgtatgtgtgtgtgtgtatatatgtaaagcatatgtgtgtgttgtgtatatgtagagagagttgttttcttctagtattcctgtgttcagtgaggttgaaatatccagcagaatctttaacattcctaattctgactggagatgtgaaagatgtatgattagatggcaggagatacaaaagaaaatattctttgcttcttaaacttttttaggcctctttttttctccacaatactactactatctcttatactcttctggtacctacaactttctgtttttttgtatctagtagtatcattatcattttaatttgcaggtggattctgaccaggaattacaaggctcttgccaaaggaacaagaggcagcacatctggttttcttaatattgtgatggaactgaaaaaatgttgcaaccactgctatctgattaaaccccctgaagaaaatgaaagggaaaatggacaggagattcttctggtaggtagttcctcataattactttctcaaaaaaaacgcttagtttctctaggtgcttttcatcagaatgctctatttccttgttggtgacctatcaaggatcatcaaaggaagctttaaaaatgggagagaaaaggtaactaagaatgatttggaaagtaaagtatagtatcaacagatactgggaaaaagaacatttcgggaattgctggtcaagcaggttgctaagggcttcagaaagctttaagatgatttttaaaatatggatttgtagagattagggaagattaaaatttgtgtttcaacataattattggaatgtcttttaaatcttcagtccctcataaggagcagtgggaagttgattttattagacaaactgttgacaagacttcgagaaagggggaatcgagtgcttatcttctctcagatggtgagaatgttggatatcctggctgaatacctaactattaaacactatcctttccaggtaaggtgatttcagtaattgctgtggggggaatcaatctctctctccgcctcccctccccaaccttcctacactgggttgtatgctttgcttgttaaagtaggaagtaagagttttcttgtttcaaagaagttaaggttaagattccagggggccgggcgcggtggctcacgcctgtaatcccagcactttgggaggccgaggcgggcggatcacgaggtcaggagatcaagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaagattccaggagggtcttaatttttacttgcatgcctttaggctaccatatgaaagtggtcatgaggagacgattctttttttgaaggtgggtggggaggattagagaaagtcaaacggggcaagataaaaaaaggatgtcagatggcatcttattgcatgtgtatggtgaaagtagagaggaagtaagtgtgagctcaattccaggagcccaaatcctagaaggagagggcagtatcagacattccccccaaaagttgaccctggctgtgaggctgggaacatagcagaacactgctacttaaaaccttgctactccctgaagtaagtgatgatggcttcccctattttctgtggagttccttaactggagttactgtcttcacacagttatctcctatggggaaaatttcttccgcatagtaacatttttctaggtgtatataatctagtagaaacttattctctgatctatttatagacacatagacatatacgcaatttaccttgtctcttggcatgtttatagtgctttgatttttaagatttattacattttttttaaaactttgaatggatgaactcttctaccaactcacataattatgttgggattgaagaaacttggaccaatgattatctcctaagaaggcccacctttgagactatcagattgattatctttcaaaataccctgaaaggcattgttatatccataatatcttatatggtctttcagttgctgtcttagaatatagcttaaggctgtgcttgttatcaagaaacagcctattgcaaaaagtcacttctctgtcagtgaatcgaatccctatgagctttcattcctaggaaatcccgtgataccaagtaaatcaagaatgcatcgtttttctctctagggaatagataagcttggtcagtgacttttagataattaatgccctctactaatgggaatattaaaaggcggcattaggttttctgatttcaagtaaaggctctgaatctcccattgaatacgtcttcggtttaaggctctgagtagagtagtcagtgagaaagaagtaagggactcctcacctgtcagttgacttgagttaggtctggtgggcagagttctgggtatgtaggcccttccacagagtctgctgccagccaagtcacctttcaggttagttttgccttctgtaaaatgaagtattttgttcatctcaagtggtgattgtgaggggatgaaatgcaaaaatgattttaaagagtaagaaatgctttataaaatgtacagcatgcaggtgataattctttagtattttatgtgtcaatggtttctctatggtgacattgtattgcatgtagaactgacatatgttctaataaaggaattgtgtatgctaataaatgccaggggctttcttgaattctcatgtagtttagctgcttgaacactttactatgatttcagagtgtaatttttggcaaagctgggatatatgatcaattttaacattttcaatgattcagcaaaatgtttttcaaacaaaattattatataaataaatttttggtttgtgtgacactttaagtgatagttttagccacattagctaagaagcatcatttttctgcaggagcttattattgggtgacccgtggtcctatttcctaatctctgcagtacctacagaaacagaagtaaacccagcctccaagcacaggttgggttttcgtctttctccttttaggtcctggcagccattctgatccttggctaaacctggacagccctttgaatcagaagcttgtaaccttgagtctgtaactggagagctcaggtcgagtagggtagggtgtgcttcttaagcacagcttcttcatagcgctttgccagtgctttgcagttatttttactcagtgggtgttcaggtgataaaggttccaagtctgctgttctattctgagtgtagctgatcttcctatcttacagttttcttgtggtttatttttacagcgtctggatggttccatcaagggagaaatccgaaaacaggcactggaccacttcaatgcagatgggtctgaggtatactatgcatggctttgttatttgagcaacttgggctctgcatcaaggggaaagtctctctcgcttaatgtattctgtttcagaaacaatttatagtgcaattcttttgccttgagaagaaaatgagaaatctctcatataaaagatggtgttttgttgtcactccagaaaaataaatatgtgcttatttatctcccctgttctgggttgacaacagagtggttctcctggtagcttccagataccaaatccttgggcgtggaagagcagtaaggcaggagtaggggagagttgggcaatagaattaatataagaaggttctgatctctgtactcttttggtgactaagtcctgaaaaatatatttgccatgtctcaaatttgttggacttctgatacagtgtggcttaatgttcttgctctcgctaacagcaacattttacaatcagtgtcgagcttggatttggcattatgaagtattttgtttggggggcacatatagaagagctacttaggatgaaatagaaggtatgacaacattgtagtttgtgcatatcaaatcatcagatgccatgggatttgagagaagtgggagagaaaagttttggtgtgaataaaactgtaataatgtgtagagctaaaggaagcagtggagacaacctgaagtagaagtgtttcacagagaatgctaatttctggagcctgagccactacttttttttttttttaaacagatagaacagacttagctttctgaagagctttaaaaactcttgatgcctgtgcctgttactacagaatgctctgctgtctgcctttagagtgtagaaatcctagttagactagtattctggctacttctgtagtctaaacatttacttcttgaggggcttggggcattaatctattcagagccaaggctctcgttcattaaggataagaggaatggaataattaaagacatcggtcatcaactaattcccattcctcctttccttgctccttgtttcctcagctgtaaaatcacaatgattctgataccccacttcataatattgctctgaggattaaatttggtaatcaacataaagcactgatcacattgcccagtgcatagtaagcgctctaaatatctgctatttttatcatgtagtgttggttgaaattggttttgtgttctccactcttagtttaaaaaatagtatgagtcgaatgtttcatattgccctgtctcaggggaaaaaaaaaattgctttttgcatagctctcagttgattcccactcactatgatggctatatagaacacaagttctctaccatttctgcagtattttaaaaattcctttaaaaaactaaatatttattgtgggacaaaatattatatgcttacttagaatattgggaagatggtaaagaatacaaagaaaaaaacaattgtacccctcattctagacacaacttgctgttcacgtctttggggtgtatttccattcctactagatggaaccatttatatgtttacctaattcggatcatgttgcatacagttttgttcccttcaaaattatactttgaggctaggcgcgcatagtggctcacacctgtaatcttagcactttgggaggccaagatgggggaggatcacttgagaccaggagtttgagaccagcctggtcaacatagtgagacctgtctctaccaaaaaaaaaaaaaaaagtttccccatgttattaaagattttacaaaatttaatttctaggcccatagcaagaccctatctctacaaaaaattaaaaaatgagccgtgcatagtattgtgtgcttgtagttccagctgttcaggagacaggcaggaggatcccttgagaccaggagtttgaggctgcagtgagccaggattgccccactgcactccagcctgggtgacagaatgagaccctgtctcaaaaaaaaaaaaaaattttttttttaaatttctaaatttttcttatgcttgtaccatttatttatttaactaccttaccgttagtggcattgagttttataattttttaacctttttcaacttgatcatagatgcagacgacatattataatccacgttatccttgctaaagagtgatatagcagattgttggttgataggatctttttgactccagatttcatttgttttagatatctcatcttaaattgtccactgtttatctttagacttctctttggagtgtggtggtgcttaatatttctcttaagaatcacagattatgtgcctggacactcctgttgatcacttctttattggaattgtttaattaaaattcttgtgaagcagctgtctccatttttatttctatggcataatgttgttgaatgtgactattagaacatggagaccttttcattgcatctctatgtgtatgctaaatatacccatttatcaagatggaactcaggactaccagtttttcaatgctgcttctctctgctacaaaggcatcagcttttgacatatatgattaaattccctgaaaatagaaatatttcaccttttccccccggcttatatattttattctttttctcctgcccccatatttttctgagcactcagacgcaggcaggtgtgctgtgcttgcccagtgtctactgtcattgctgtggatactgcagtgtcagtgcctgggtggttccacacatcgctctccagccaaacctgttttgatttttttataattttggcatgttttgtggtaattgaggatcctgtggttctcaacacttaccatatatgatctctttagtgcagtgtttctatatttctcgccagcctaacaaacataaatatttatataataaagtatctctgtttatactaactgacttacatggcataatctaccttttccctaaaaataattatacaggtgacttcctggagttaatgatctccatgataattgtttgtctgtttttattattgttgctgttaacttcttgtatattagttgtagccgggaggtagcactaattctctcactcccattgccttattagagtctactctactcctgttcatggcactgactttgcctcttaatcaaatgaaaattcattctaccatcaagtccctgacattcttttagcctccataaagtttgtccatcatatctcacttttcttcacacctgcaggggtttccaggtgtaagggcttattggactgtgaaactgtttctgagaaggccactgcataaagtagtatattgcattgtgtacaggacttctgtttcctgctctcgacaagggctggtggcctgggaatcaatttggcttcagcggacacagtcgtcatctttgactctgactggaacccccagaatgacttgcaggcacaagcccgagcgcatagaattggtcaaaagaagcaggtcagtatggagaggcttctggaaattgctttagggttgggggccagggggcttgttcagccctttcaggatgttaataaaatgctttttccctgttttgcttttatttcccctgaagcattgatttctgtttgttaactagcacagagatgttgtctttgggcccaagatgaacctattaaggaacttttctttttctctgtttgaaaagtacaacatcagcgaccttctatgtgtttatcttgagagagatatatgatgaatagacttagaactgaacattttctctattttagtatggaaaagttaaatatcctattgttcaagatggtttgtttttattatacatgacagtgttagctttaaaggtactttggaaaaccacacacttttttgtttatgaatcttaaagtctgttctatattggataacccgtaagtttcattcttggccaaagattctgtttttgtggaactttccatcactgaagcacgatttttattgatggaacaggccataacgacagatctttagaggcaattttatttaagactgtaacctgctgcacatagtaaaagtattgcatctacttaagctgcctgcttggatggcttacagtcttctatggttagagaataaattctgttaaaattttcccctcttgggttttgacagagctaatccttctctctttttttgggggggttggggggtggttcaggcataagcataacagttccttttcctacaggtaaatatttaccgcttagttacaaaggggactgtggaggaggagatcatagaacgggccaaaaagaagatggtattagatcatctggtgattcagcgcatggacaccactggccggacgatcctggaaaacaactcaggaaggtccaagtaagtgccaggaagattgggaggtaggcagaatcaaattgattctacatcactgttggatataataggattttctaccacagacattagtctgttcattacctggaagatgccaggccagaaccacaaataggatagcattttcactttgagtttcttggttcctttttttgcccatcaccccccttcttatgtgttttcctctctttcttgccctctcccttacctttgcttttggctgctcatgtgacatatgacacagcaacagcagtggagttgtgtgttgggtgtcagcctagcataatgtcacctttgacttttctgcagtgagaatccagattggattggcagctgttttttttttttactattggcaaaaatgtttgtgtggagattgttgtgcttccagaagggtgtaaaaagaaagtaatgaagttttaattggctttgggaagaggcacagctacatctcctataaagtttaattagccaggcatggtggcaggcgcctgtagtctcagctacttgggaggctgaggcaggagaatggcgtgaacccgggaagtggagcttacagtgagccgagattgtgccactgcagtccagcctgggcgaccgataataataataataatatcaaaataataatatcaatattatcaagataataatgatatcaaaataataataaaaataagtttacattttgagcagattgttgagtgtcttctgtggtggtgtttcagctatgttttttgtttgtttgtttgtttgtttttgagatggagtctcgctcggtcgcccaggttggagtgcgctggcacgatcttggctcattgcaacctctgtctcctaggttgaagtgattcttgtgcctcagcctcccgagtagctgggactacaggtgtgcaccaccacacctagctaattttttttttcttttttttttttttttttagtagagacagggtttttccatgttggccagactggtctcaaactcctgacctcaagtgataggcccacctcagcccctcaaagtgctgggattataggtgtgagccattgtgcccgctgcagctatgttaaaggtgtattcaaattagcccttcctaaataaaatgttttcagatagttttctgtttaagaggaagctagatgagaaaagcctagctcttttattttggaccggggttgagaaggttgaaaattcttggtgaattataactttctgagtaaaaggccaaaggaaagagctccattctataacattgctagtcacctttctggcttacccatgcaataggtgaaccagtaggactgtaactaattttctattctgctggtttagggttaccatcacagactcatcctgtagatagaaaatgcgatgtttgagaaatcatttttcttgaggcagagtttatattttcagcagttaacttgacctctttctgaaggatagttattctgaagtagaacactttagaggttatttgatgtttctaacaactacattttacttccacagctcaaatccttttaataaagaagagctgacagctattttgaaatttggagcagaggatctcttcaaagaactggaaggggaggaatcagaacctcaggtaattaacaatgaggagagggaaatttttttgagaagtatgatctgtgagagtctaacttttctgtaagaagattctgttagaggcttttgtaaagaaaaagtaattacttgaaggacagtgtgtttttctttcgtaggaatctcatagctcttaccaaattgagtaggaaggaattaataaagcattcgagtatacttttttgggttgtttttttctcccatttctgttcgttttaatttttgaagtttcaccttgtcatttgtataaattatagtttgagacattagatgtaaaagatgtagagttgaaactgaaagtaaatgaaatatcagaaaggagaattggtttatttgcaccaaacatttttagtaaatacgaataatttctgggcaactaggcaactcatctgttgccattttattctattcgtgttggcttttgttcttttaggaaatggatatagatgaaattttgcggttggctgaaacgagagagaatgaagtgtcaacaagtgcaacagatgaacttctatcacagtttaaggtatgaagatctttgtgggagagagttctcagcattgattcattaatgatgactaatgtttatgaacgctttctttgtgctaggcgctctgcttttctctttacctgaattgagtcatatcctcaatattgttctctgaattgtgagtatgttgtgaatgtaggttctacagtccgcacgaaggtaatcactgaagtgggctatcctatgtagagtcagtgtgtggcggaaaagaaatcactgaagagagggctaggtagagagccaggacagagtgtagaaccaggacgtgtggagcactgtgggacacgtcaatagatcagatgccaaagagaggtcaaagataggaaaagagtagatgacaattagaaggttctgatgacttggtgagattttagtttgttttttgtttggtaagtgagagaaagaggtgtcagtggtgtctcatataacagaaaattacatgaaatgaggactaaacacaaaagttgggcaccagacgaataggaggtggcagcacagagtatcaatgttattaaaaagcttagtgaaagagtacagggatgctaaattatatggctagaaggttgaagcaagacaaggtttttgaaagatgttaccatgtttctagtttgaggaaagaacttgagtatagggagatattgaaggttctcaggaaggaaatgatttgatggcacattgccccagaggagactggaagggatacagtcaaaagcacagatggaagacttggccttggaaagaaaaaggacaagtacactttagggaagaggaggaaagagatgctgtgggagtttaatttatgctcttaatgactagtaaagtaagtgaggtgtttgcttgagaagtggaaaagatttgggacagccatggatgaggcagaaagttgttgggaggaacctgatagggagtcagctgaattgagatgatacagctttgccgtggagccagtcagcagggtcatatgactttctccagcaatacttttgaggtcagagaaattggatcagttggctatcccaaggtgggagattggcttgggaggcacaggaaagtcaaaatagcaaaggttttcaagattcatgtgacagcttggaaggaaggattgaccatgggttgattccatggaggtagagaagcaagagagacctgatgattacaatgatggctaagtgtagtatgcccattaggattgaattgaattaggggaaattgtgtgaagtgtttggaaggaagcaatattgtgtgattagctccaaagctggccactggtagaagttgtttcaatggaagaacaaggatggaattgagtgggccagagagccctagattaatgggttaggatgcagaggatggggtagagaagggggaaggtgatttattagtgttcgtcatagtcggtttgggctcctgcagtaaaataccgtagactgggtggtttataaacaatagaaatgtatttctcacagttctgaagatttgaagtttgagatcagggtgccaacatggtcaggttctggtggaggctctcaggttgcagactgctgacttttcttatcttcccatggtagagagagagaagctagagagctctctgggggtcccttttataagggcagtaatcctattatgagggctctaccctcatgacctcctaacaccttacattgggagttaggatttcatcctatgacttttgggaagaacataaacattcagtccattgcactgtttcagctcagttccacctctgtgactgctgctcctttcttcagcaataaaaacctgcacttgtgtaactcttactgtgtttcaagcactatcttaagttaagggccagagtctggcctttaaccacgatgtcccttttggaaaagttaaattccttactgcatgaaccactaacgtatgtgcatatttacatcaatcttaattttagttaattttagccaaaagtcataaagtaagagtcttaacttgacttcactgttggctccaaggaatggagcctccagaagctcatttataccttatgactgtctcaaaggctaggagggagggaataagaagaatgcggagccaggctgggggctgcctgccactgctcagatgctgtccagaggtggtagatgtttctgtgtactcctcctctggttctttgaaatggatacacttagatggctttctttctgggatacctactgttttagtacaaatacatatcggatattaaataatatttgataagaaatgaagagaatattcttctagatttatttaaattttttctgttttatgttttcattttatttcctaagactaaagtgcacttgtgagcatatgaaatcaccacacatctttaactttcatatttttgataaaaatgaataaagcaaccagttggctagatgataatgagtgctttgagttatgcattgtttcaaatgaactctatacaacttatagaaatgtaagttcatcatggagtattaggtattaagcattttaaaatctaaataaatctaaattttatcattagtattatatttattagaacatgtatatgatttataacagctcattcaataaaacttataaaaacaatttgtatctttgtagctgtttctctgcttttcagtaaaatttatgatgtgatgaacttgaggacttgacaagttgatttttgggggtataaaggaaaaattaatagaaaattgattatctgattatgtaatatcacaaaagtcctattattcacagtgtctacttagataaaaacactggataaattgttttagtagatggtgtttagaaatagggaaatgtcagacaatgggttgtctgttttaaggttgccaactttgcaacaatggaagatgaagaagagctagaagagcgtcctcacaaggactgggatgagatcattccagaggaacaaaggaaaaaagtagaggaggaagagcggcagaaggagctagaagaaatttatatgctgcctcgaattcggagttccactaaaaaggtgatcaagtgagatgaaagatatgaaattatttcttatgttgtgaatgctacagaagtgttgattattcaaagaagaggccttgcattgttcccctgacacagaggcttcaggagcagagttgatactgtaggaaacttaacaaaggaaagtggagaaatctgcagagctcctgagcacacctgtgagacatcggatttggtctttgcaaattggctctttgtgaagctgataaacagggtctgaaatttccagaagtttgcattttgcctttgagtagtcctcacagtttggctgttaattgccactgccttcaactttcagaaagtcacacctctgtttgtccataacagttcacagcacttgatataaatacttagtaaaggattatataactataaataagaaacatataccaacttgacagttcacaaagctccatcacagacactatctaatttgatttttgtaacaacattgaaataggtagaacaagtttttttacccattttgttggaggtaatagacacagatttgttcaaggtcacagtaaatcagtatgaggtaacactagctaccatttattgagcccttacaatgtgctaggcatacttctaagtgctttaacttactgaaaaccatctgttataggtactattgtcttcatttttcaaatgagaaaataaaggcacaaagagtaaaattacttgcccaaaggagtaaacatgaacctgttttataatgggatattgtaaaaatattcatatatttttaatccagttcacttatcgttatattacaatgtctctgaaagtatgactgtcctaagtgggtatttctccaagacctgtctccccttatttgtcaaaggaaaattgacttgtctgatatggtgagaagttctgaatactaaagaattaagatggccttctcttagtcctttcaccacttgaacttcgcacttgttacagtgtgactttgcctcgatctttctcaggctcagacaaatgacagtgactctgacactgagtctaagaggcaggcccagagatcctctgcttctgagagtgaaacggaagactctgatgatgacaagaagccaaagcgcagagggcgtccgaggagtgtgcggaaggacctcgtggagggatttactgatgcagagatccgaaggttggtggaggctctgttctcactgagcttgtttgaaagtgcgtactgtaagtcttgggttgactggatcctggacatcgtgacagggtaggcagaggctaatacctacaaaaaaggaaagagaagctgggtcctgtcccagatctgtaggatgatccttccttctccaaggtttctttctgttgagatcacttttatttgttgttcatctctctatttctctcttattctctggttattcagaacattttcacaaagttcagctcggggaaggagataattgacatacatgtatatacagacttatgtatctgtatataaaagaaatatcaaaaataaaaatggtacaaataagtctaccctcactacctctcccctccgccacaatcccacttccacctgtgttagtactgacatcagtttgctagtggtttgctttgatttataagtagtatgtacagcatgttgttcagcaccttgctttccccgatcccatttaaaatccattttagacatctttctatgtgagtgattactatacatttcttggtatctgattcaaatgtctctatcctccataaaaaaatctaaaattgttgcttacaaattattttttttccagtttccatcttttttttttaagcctgaagaaaatagaaagtataaagatggttttaaggcctaatccatattataattatattaaatagtcctttaagtttcatgtatttgaaactgtgaggtgtttcttttcacttaaaggtcacacctattcttctttctttgtttaatttactatggaaaaatagaaatatttcaaaatactgacagaatagcatgtaacacatcccctcttgtgcttatcatcttaacaattttgaatttgtagccaaaattgtatgtatatatacacaccccacctcttcttgctccctattcccagtattattttgagaagaatgtgttttctgctatggggcagtatgttctatagctgtatttggcttagtgtttttcaggtctttaatttcttcattgattttctgtatagttgtggttattttggtagagtcagaatcttgctctcttgcacaggctggagtatgatcctatctcactgtaacctcacactcctgggctcaagtgatcctcctgcctgagtgcctttttcactcagcctcccaggtagccaggtctacaggcatgtgccaccatgtctggctaattaaaaatttttttttttggtagagacaaggtttcattatgttgcccaggctggtctcagactcctggcctcaagtatcctcctgcttcagcctcccaaagtgttgggattataggcctgagccaccgtgcgcagcctagttgttctacccattattgaaaatgggatgttgacatctctgttactcttatatgatccatttgttcttcaattgttagtttttgcttcatgtgtttttggactcttattaattgtatatattttttataatcgataggtcttgattggcctttttattgtaacatgtatttctgtctgtagtaacaatttttgttttaattcctattttcagtttgatattagtatagccactccagctttctttttgggtatttgaaattttaaaaaatggtatttggccaggcatggtggttcacgcctgtaatcccagcactttgggaggccaaggcaggcagatcgctggagcctaggagtttgagaccagcatggtctcaacatggcgaaaccctctctctactaaaaatacaaaaaattagccaggtgtggtggtacacacctgcagtcccaggtacttgggaggctgaggctgaggcacgagaattgcttgaacccaggaggccaaggtttgcagtgagccgagatggcaccactaaactccagcctgggtgacagagcaaaactctctaaaagaagaaggaaaaaaaaaaaaagatggtatcttaaaattttttaaaaatattttttctgccaatctcttttttttgattgcagtatttaatctatttacatttaatgcagttattataaagtaggaattatgtctgcattttgctatttgtcttctatatgtcatgttttttttgtttatttccccattactactttcctttgtgttaaatatataatataccattttaattaccttaaaaaaaaaactttttttttcacttattttcttagtggttgccctagaaattacaagtaacatcttagaacaatttactttgaattaacatcaatttaatttcaatggcattataaaaactttgccccagttatagctcaccatccccatttgtgctgttgtcgcacattacatctttacacattttaaacccatcaatgcagttttataattcatactttatatagttagttgtctcttttttttttttcttttgagacggagttttgctcttctcaccaaggctggggtacagtggtgcaatctcggcccactgcaacctccacttcccaggttcaagtgactgtcctgccttagcctcccaagtagctgagattactggctcctgccaccacgctggctaattatttttgtatttttagtagagatgggatttcaccatgttggccaggctggtcttgaacttctgacctcaggtgatcggtgtgcctcggcctcccaaagggctgggattagaagcgtgagccacccacacccagcctagttagttgtcttttaaaatcagatagaaggaaaagagttacaaaaatgcatgtatactgtttttatatttacttactctattattccatgggtgctcttatttcttcatgtgatttgagttactattttatgtcctttcatgtctgcccaaaggactctcttttagcattttattttgaggcaggtctgctaacaatggattctctattttggcttagctcgcactgttaatttcatcttcatttttgaaggaaagtcttaatttctttttttctgtttctcacgtgggataatctcaattggcctatcttcagatttggcagttctctcttcttcaggctaatatctgctgctgagcctcaccagtgattttttttttcatttccgttattgtagttttcaactctagaatttctatttcactctttaaaaaatgtccgtttttaaacagcatttctgtttctattgatatcattttcgacctttctttttaattctctaggcagactttttttaactcttgtaaatatttataatagctgattagcatccttgtcttataagcctacatgctagacttccttagggatggtttctattacctgctttttttcctatgtatacttcatacttcatactttttttttttttttttttttttgagatggagttttgctcctatcacccaggctggagtgcaatggcgcgattttggctcactgcaacctccgcctcctgggttcaagtgattctcctgcctcagcctcccgagtagctgggattacaggtgcccaccacaatgcccagctaatttttatatttttagtagagacagggtttcaccatgttggccaggctggtctcgaacgcctgacctcaggtgatccacccgcctcggcctcccaaagtgctcggattacaggcgtgagccaccatgcccagcttactttttggttttctatatgtcccgtaatttttcccgtgaaaaactggacattttaaatcatatggcaactctggaaatcagatctcccctcccagccatgtgttgtgtttgccgctgctgttgtatttgcttgtttagtgactttcctgtactagttatctgaagtctgtattctttgtcatgttatgtgatccttgtcatgctatgtgtagtctctactcctttagcttagtggtcagctaatgattgaacagagatttccttaaatgctttgagcctgtaagtctaccagcctttgttgaagggctgggtatgtgttgttggggcacgtttcaatgctctggaaggcaattgacaactctgccttaactttcagttcctgcttgcacagttgctcaaggtctttctcaggctcagacaaatgacagtgactctgacagtgagtccaagaggcaggcccagagatcctctgcttctgagagtgagacagaagagtctgatgatgacaagaagccaaagcgcagagggtgtcccaggagcgtgcggaaggaccctttgagatctttcctctgcatggacacagacctgcacatgtcagagcttttcagagtatctatcctatgaacatctttcctcccagtttttctttttgtctttgttcaaccttttgttatttccagttggtaatgttgcctcaggccgtcatggtgttaaatctttgcatctaattgtttttgaccaatgaattttggacagggctattcacacagtgagttctgggtcagtccaataaagacaagcctgagaatggagcttcttagggtgctgttagccaggtccagtcattctgggggaatagggcttttggagaactctcaacctcttctttaccctccagtggctgctgtgctgctggttacacagctattgtagttgcagaagtgttagttttgaaggctgtcatgcagctggggttaaggggtgggaatagtgcaagttaaaaaatgccttgaagcttgctgagccattttcttgaataaatttcttagatggctgcacgcatttggttaatttccagagttgtgacaatactgattgtgaccgtttatgccagcattcctattgcttttatgggggagcagattttcacagacccttagtctgtcatttcggaagtgttgttatttagacataaaatatttcagtgtctgtcaagaaggagaaatgcagttaaggagtaatcctcaggttttgttcatatataatactttcctaacctttgtatctgcgctgttcctttaatgttgtttttagctattgtcatattcagtcccattttattctgtagccatgtcttctcatttccatttttcccttagcatctgtccttacatggttatataacccaattatcatagtaatttggcatattacatgatgcccttaatgtgtcatgaagtcctggtttttagtggaaagtactggtgaccagcctgtaggaatggggatgatggcatgagttggtatgtagcatagtttagggtagagacttgcaggaagatagattggatttttgggaggagaggtcagtagagtttccaaaattgtttgcctaagaagttttaaatcatattttactgtgccttattccaaaaactatttgagacagtcaaaaaaatcttaacagctgaaaaatcattggttttctaataacgaaaaatatggtattgaaggtaacagtggtgaactgaatacgctgatgaaacgatataagggtttgtcacaatagagtcgtgatgattgaatcctttatgacacagtgaagtctataaacttgtatcttctaaaaaggatattagagctaagtcacagttctctagcatgttatctaagcaggtttatgtacagtcactgagaataaagttgatctttaatttgaatagatttttagcagtcattattttaagttgactagtttcaaagacattcaacatttattcatttttttggtagtgcaaggattgagtccactctatttttgacaatttgcatggctcatatgtcatcacaggatatgctagcatcaacataactaaagtaagtctctgtttttttaatatgttttattgatcctattcttaggttcatcaaggcttataagaagtttggtctccctcttgaacggtaagttcagtgtaatagtcccttatcttcctcttttttgcttttattatatagtacgttcttttttggtaaatttttccatttaatactaatgctgggaacatttttttttctggaaacatttatttacaaacatttatatattgggtgcctgttcattcatgtctctctgcagagggatgacaaagatgataaagacaggccatccataaaaagactttcaccttcgtgagggagataaagcaagtatattcaaaaccatagtgcgtgaaataatttccagagagatgttcatgtaactccagttgaaaagaatgtatgtagttattatttgtatcctagttcttagatttaataatgtcaaaggtaaaaggctctttatgattttataatcttctgctaattagcaggattttatgaggattaaatacaaaggacttaacatagccttgactataaaaacttccaaaagggtagctgttgttactattctataagcatttagaaaataattcagaagttagattttaacagaagactctatttgaaatggttcggtactttacttcctataaaatctaaaaagccctaatttaaaggaaatactgggctcccttctctttcttctgataaacttcttgagtgggtgaaaattacaagcctgtttttgtttggtcctctccatttggcgaggaggtagtgatgtgtagcattaagccacagcaaggccaagaaggtcagttgcatctttccaggactattgctgaccacccaggggtagactgtctgtttttgggccagttaccgtaaaagccaatagaatgtggaaaagggggcttgacaccttttgacagcctgttttttagctgttaatgtagttgtgtgcttcatatgacatggagatcaactaaacatatagtagaagtagctatactctgcttctaggagcattgcagtgaatgaaagtaggctggagaaaggaaagtgaacacaaaagaagcaagctagtacggatggtgttcaggcacttcacctgctgccactaacagcctatttatttaataaactttgctttgcttgtttctttctttcctctctgttttttggaattattttgttttgtggaatattcaagacacaattctttatgatggaaaatgaatgtgttagccttcagtcaatgtccaggggttcttgttggagccttagaatgaccactaaaggaacgcaaagaaaagtgtctttgcaggagaagattatgtgaggcctagtggcatctcatgacacttaagaagagtgggcacagggtcctaaagtgtccccatatttgttcctcctcaggctggagtgcatagcacgtgatgctgagctggtagataagtcggtggcagatctgaagcgcctgggtgaactgatccacaacagctgtgtgtcagcaatgcaggaatacgaagagcagctgaaagaaaatgccagcgagggtaagcgaagttggctttagtgagtcttcgcaacctggcactcttggactggatttctgttgctaaagggcgttttaaggacaggcttgaggaccacacatgcctagtgatttcaggtgtttattctgagctgcgtttctgtgagcttaatattctactctcctacaggtctactcacaaatgaagttgatttgcagaaggtgtagagtgaagaaaaagatgaaatggtttttttttgtgttgctgtagaaagtttaaattcgtcggagtgatgtaaaaacccaggggcagagcttggtggacacctctgtattttggctgcaaataagaggtgttatagatcacaagcattgttaattatcttggatatatattgtgcgttatggcaaacacaaaggatttagagaattaattggaataaataaaatattggatgagtatcgtaaacatttttgggttacgttgagattttcatgccactagaatttgttctcattggattggacatgcagtgtgttttctctttgataccagaaagtgattttgcctgtcctgtgtgatatctttaaaagcaagaggtataggaatgcttgtgaggagagaactctgaagtagttattggtaaggacaccctcatagtgaactttaaagaaacgaagagaggccaggcgcagtggctcacgcctgtaatcccagcagtttgggaggctgaggccagaggatcacttgagcccaggagttcaagtccagtctgggcaatatgtaagtgagaccttgtctctacaaacagtttaaaaattagccgaaagtagtaggatgcacacctgtaatcccagctacatgggaggctgaggtgggaggttcgattgagaccaggaggcagaggctgcagtgagttgagatcatgccgctgcagtgagttgagatcatgccactgcacttcagcctgggtgacagagcgaaaccctgtctcaaaatataaataaattaattaaaaaataaagaaatgaagttattatcattctacttctccagactgtggtttatctgtgccatttctgcattttttggggacagcctttacttaggtaaggctacccttctgcagctttgttgagctgtggttaaatcttcaggctccagagaaagaggcagtcagttatctggaattttggttctaccacttctagttataagactttgggcaagttatatcccttcaactgtctcatttgcaaaatagagtaatagtatctacttcaaaggatttggataattgaataattccatacttgtaaattgtttagcaatggcgtctggcttgcaatgttagctgttattaagaagtgagtatttgtgctttgaaattttctttttttctttttaagattttaataataaaaaattattttattattcaataataaccttaatattattgaatttgatataatttaaaaatatcttcaagagagtcaaaacttattttaagataatgttcttttttgtaaaagacaaataacttgtatggtttgcaaaatgatctgaatatgtgcttttataacattcagaatacacccaaaagtaaactttaggtttaatgtacagtatgttttctatgtaattgttttgaataagtaatacatctacatggcttaaaactgaaaaacgtattcctgttacttcttgatgcttttgagaaatgaataatgttttctcccttttaaatggtagtacagcatgcacacttttctgtgcttgcttttttatctcatagtatcttgtggagctgttttcttaacagtcccttctccccaaagtctcccttttttttgtgcatgtccacattctggatctggctgattgcttcttcctggtattaacttatttcctcacacctgtatttcctgtaaactggtattcagcatattctgaatccaggctgacatttctagatcaaatggaagattattgataccttttttcccttaggttgaaatttttgtttctaaaaatgttaacataattacatatttgctttatcccaaacatatgtttccaaataccaataccaatcttactgttaacaaaagaatgctgaaatgcgaagtgtgatttctttgcatttctttttgatcttagaatatatcacactaacaatataaagtcaaaatatatgtttaaattattcaaagttattcctttctctgtgtggttaatgccaccaccttaatatatagttagactcttttgttttcatttattttcagtacttagggactgcttttctcatttagattcgatttaatttttttaattatgtaaaaacatttacatggttcaaagtcacaactataaaacaaggtacatttggagcatcttgttttcgttttttgttccccagctgccttctcttcctccttaataggtcactgtttctattagttgtaagtttatctttgattgtttcttttaaaatttaagtgtgtgtgcgtgtgtattttccttcttacacagaagagaacatactcttttgcacctgcttattttcatgactgagataaattcatatcattatgtagagatcatcctctttccttttacagttgcagagtattctaccatgtagatagatgtcaattcacacttcccccctagtatttaatatttgggttgttttcggtcttttgttattataaagaaagtcacaatgaataatgatctaatgaatataccatttcatatctctgccagcatatctttgggataaatttctagaagtgggattgctgggtcctgggaaaatgcgtatatactttgcttcgatattcccaaatccttctgcataagtctggtgccacaatgtttgtcacaagcctcacaaacagaatatattgttaaacgtttggagttttgccagtttgataggtgagaaacggtatttcatttttcttttaacgaacaaggttgtacatctctaagggtcacttgcattttgttctataaagtgtctattcatgtgtgctgcccattttctattgaaaggagttttcctctcacaggtagcattatctcatggatttcaagttggactatttggttggggcttcatttttacttctgtgatcattttaatttgaaatttgggttagggtaagtttctttttttttttttttttgagatggagtctcgctccatctccaaggctggagcacagtggtgtgatctcggctcactgcaagctctgcctcctgggttcacaccattctcctgcctcagcctcacgagtggctgggactacaggcgcccaccaccacacctggctaatttttttgtatttttagtagagaaggggtttcactgtgttagccagtatggtctcgatctcctgacctcgtgatctgcctgcctcagcctcccaaagtgctaggattacaggtgtgagccaccgcgcccgcctgggttagtgtaattttcttaagccaccacttgttcatcatttcacatgtgttagatgtgaacttaagctcatgtgttttcagtaatagtgttgtgaagatcaagttcatttttaaaacacttgagagttttttgaccttcgctagtgggatgggtaggaaaacaaaaagagaaaccttcagcactaatattataccctcagaatctacttttgttcatttggaaacaaagtagtataaaacaagcaggaagattaaaatacaactataaacatcagtgaattaaaaaagaattccaaatcttaaaagactgaatgttcagaggttattttacagacattagttgagaaaaaaatttgtcttatagattatatcttcaaaataacaataagccagagatatattcagagagactaagaggtcagggttcgttgatacatgttttctgtggaacttctgcagattttcatttaactaatgtgaaactggtatttttcaggaaaaggaccagggaaaaggagaggtccaacaatcaagatatccggagttcaggttaatgtgaaatccattatccaacatgaagaggagtttgagatgctgcataaatctatccctgtggaccctgaagaaaaaaaaaagtgagtatattttgtgtacatgcttagatggtcgtaccgtaagaaaatagatttgaagttagactttgtgtagttccatagtatttttactgtctcttctttaacataccaaaaaggcccctcttctaatgtcttcctgtttttaaactttctttagatactgcttaacctgtcgtgtcaaagctgcacattttgatgtagagtggggggtggaagatgattctcgcctgttgctggggatttatgaacatggctatggaaactgggagttaattaaaacagacccagagcttaaattaactgacaaagtaagtaaccctaccatgctagagatttctagaagatttgttgtgtaatatttttatatcgattacttatttctaactattttcgagggggcatcaaattagaaattagtatagtcattcttggaaatacttccatctttagcagattgtggcactgtttcacggatgaagataaagggaaaagacagtagccaggtgaaattttggggaaactgtaggagaaatcttaaaattctggtatttaattataggtcagatttcattacaataaatacccaggtgagtttgttaatgataaaagcattccttggccttagttattggccctttgtttaaaagtacatttgaaacaaccatatttcacttcctcacgtaaagattgaatgtcaccttggtattctttgtaatggaattaaacattggctgttcttctcccacaaaatcgagcctcccaccctatctgttgcaagtagcaaggccatggttggagctataagcagggaaggctgactggctcaaattttggtaggatttgctccatgttgtgctcctggcagttcaacagtgctcatcccatctggttttaggagggtgacagcaccctgccttaagcactgagaccagattcagtctggcaagagacccagttgttgtagcaaggaacagatcatgtcctggcgtagctcagtgctctccggcaatgctctaagaagcattttcaatctaaaacgaagctttaacctagctccagggattccctgctcctggaaggaggaaatccacgacggctgggatgctctagcagatgaagccacaagcccctcctacctgagttgttctaccctgttaacagcacaggtaggagccattgggagagctggatttctccatcccattttgtaaaatgagaacggctcgtgagggattttcagtgactgggagccatggacatgagataggatctgaggctttatctatattttgggtggttggggagggaaaggactgtgctcagtttttgttgtctctgtttatcctgatccactaaccaggatgtgggtggtggcgggtgcttctcttcctttcttgttgaagattctgccggtggagacagataaaaagcctcaggggaagcagctacagacccgagcggattacttgttgaagctgctcagaaagggtctggagaagaagggggctgtgacaggtggggaagaggtgagtacgctgccagctggttgtttttcaggggcctgaggctcctaccctgcagaattaggtaggaagagagaggccctctctgagcactgcacagaatgtcaccttctcatgggcatattttgtttttgaggttccagtaatgatgctttgcttggtaataatagaaatgttcatttaggcctggcgcagtggctcatgcctgtaatcccagcactttgggaggctgaggcgggcggatcacaaggtcaggagattgagaccatcctggctaatatggtgaaaccccgtctctactaaaaatacaaaaaaattagccgggcgtggtggcacacgcctgtaatcccagctacttaggaggctgaggcaggagaatggtgtgaacccgggaggcggagcttgcagtgagccgagttcgggccactgcactccggcctgggcaacagagcgagactccgtctcaaaaaaaaaaaaaaaaaaaaaaaaaaaaaaaaaattcatttaagaccacggcatcttggcagctttcttacaaacccatccttctgaaatgttgcttcaaattcatcctctgctccccagtcccactattccacacatactgttactgtttctttatcctactttctcaattttggaacatagttgcagttactgcattgaatacctgtgggtttgcctgttgttctgtctgtctctgtggttcttgtaatagtggatcccagagataaaatggacagttgtaatgcacagttaattcagaaactagaccttacttgctgtgtgaaataccaactaaattctcagtgaactcagctgagctttatctccttttgtttccccaatttataatttcagttcaggcccagaaagatggaatcccagctaagaaatacaagttacaccctgtactagcagcccatgtgtgcatgttctttaagtgctcttgcagctatgtcatttatattgatttccctgtattattataagcaaagcaaatttgaggaaaaaaacccataataccacacctcatttttttcaagtaatagggtcataagtctcattcttcatataatatgttgagtatgcaatatattatgtgttaggctctggaaaggcagaggttagatcatgttacagatcatatctgattaggcagataaacagtattttaaccttttccttattatatgtaacttgctttcaggttttttaatgttactattatgtctttaatatattatctttatttgtacttttgtatacagagtgattttccttttttaaaaaaaattgtgtctttaggatggattccaaagatgtggaatcagtaggtttaaggaatatggatattttggctggcaaggtggctcacacctgtaatcccagcactttgggaggctgaggtgggtggatcacctgaagtcaggagttcgagaccagcctgaccaacatggcgaaaccctgtttctactaaagacacacaaaaaattagccagtggtggtggcatgtgcttgtagtcccacttagctactcgagaggctgaggcaggagaatcgcttgaacccgggaggcagaggttgcagtgaggcaagatggcacctctacactccagcctgggtgacagtgcaagactccatctcggaaaaaaaaacgaaaaaggaatatggacattttaatgtggtataggccatgtataaggcctataggtttttatttgttttggtttggtcttgtgaggtaaaatgagttgcactcttttgatttctttggaattttcttgtttgaattatatggctgctactgctttaaagagtcatcatgttgtttggttatgcttttgagtgtcttgatttgtattttaatcatcattttctctccttttccaggccaaattaaagaagcggaagcctcgggtaaagaaggaaaacaaagtgcccaggctgaaagaggagcatggaattgagctttcatctcctaggcattcagataatccatcagaagagggagaagtgaaagtatgaagtggggtttcggttgagggttatttatttattttagctatacttatcatgccagctggaataaaatcatctgaaatgtgtttggtttacgagtggattaaatggaaatagaatatgtaagtcttcgcttaatctgtcagcgaggatagtttaagtcagcaactgcaaatttgtacataatggaagtaaatgaaggggactatgacatttttgttgttgttgtttgtttgtttgtttttgagatgaagtctcgctcttgtccgcgaggctggagtgcaatggcacaatcctggctcgctgcaatctctgcctcccaggttcaagcaattctcctgcttcaacctcccaagtagctgggattacaggcacctgccaccacgccaggctcatttttgtattgtaagtagagatggggtttcaccatgttggccaggctggtctcaaaactcctgacctcaggtgatcttcctgcctcggcctcccaaagtgctgggattacaggcgtgagtcaccgcgcccgtcctaaagttttaatgataaatggcgattgacacgtagcctcattcttgcaaatgacggggagtggtcaggactgtggttaaccagagagctcatgcctaatgtaaagggggcagctgctatggagttctgttaacaaaactcctgtgggtcaggtttggcttgccagtttgtaacctctggtctaagtaaagtgaatagtaagttggtatcatttagtgtgctatttcagtgacaactttatggaatttctgagagtgtaattgtacttggatattagctccaagaggatcagcagtgtgtacaggaactagcatggatttgagtcatacatacagatatttatttatttattatgagttgctttttgagatggagtcttgctttgtcacccagggtagagtgcagtggcgcgatctgggctcacagcagcttccacctcctgggttcaagtgattctcctgccgcagcctcccaaatagctaggattacaggcacctgccaccacacctggctagtttttgtatttttagaagagacagggtttcaccatgttggccaggctggtgtcaaactcctgacctcaggtgacaggtctgcctcagcctcccaaagtgctggaattatgagcatgagccactgtgcctggccaatacatacgtacatttaaatactagcaacctaatcagttattagctgactttgtataggtatataatctctttggtactcagtttccatccgtgaaatgagaataataaacttacgttgaagggttgctatgagaattaaatgagaggatatcagtaaagagcttctgcctctacagttgtaactggttattactggaaagtttagacttctctgagtcccttgaggctatttgcttgaaaacaagcttctaagtatagacagtgatgaaccactgggggcagtgcttctttttccagaaagtacataagtagatataaaatttgtagcaaaaattcatagccctgttttgtttcctaggatgatggcttggaaaaaagtccaatgaaaaaaaaacagaagaagaaagagaacaaggagaacaaggagaaacaaatgagttctaggaaagacaaagaaggggacaaggaaagaaagaagtcaaaagataagaaagagaaggtaatgatgcccttctgttcatgcagatatccacagcctttgcaattcgccatttggatttagaagtagaatgagatttgagggccctggaataattgtctttttatgggtatgttcaagaaggatgggtggggccgttgatgggatacctgcacctgtccttgcagagagaggggaacctgcaagtttggggtgttctttaaaaaagaaggcctttacttggtcttttatgacatatttcagggggaaatgtttgaatgagataggacaggtgagagaaatcggcatttacatgtaaatacgaaatacgttctcagattcatattagaggagcacaatccacaactgaatttgaatacttgaagagtttgagtcaaaaacaaatattagcaagagttattggaatataaatggatgaaaagccttgctattataacctttacattaggggttttatgaagttcattctaaaccaaagaatttggtacagtgttgcagtgtatacttgctgacctctgaacacagtaaaatcattgccaaaacacaaacaactgctgtaattctaatatccagttgataactctaatagatttcttgataagtgcctttgaaacttttactttgaaattttatattaaatataaaataaacttctatttaagaacaaatataaaaatcagattaggctgtttgggtagtttttcctcctcacttagcagtatatcacaactttccaagtgattaaatgttaaagtcatttttacagccttggcaacgtagggagacctcgtctctacaaaataaaaacaagcaaaaatctagctgggcattgcggcatgtgcctacgggcccagttgcatgggaggcagaggtgagaggattgcttaggcccaggagctcgaggctgcagtgagccatggttgtgtcacacttcactccagcttgggcaacagaggaagaccttgtctcaaaaaaaaaaaaaaaaaaatcatttttaatagttggggaggattctgtttgggtgtaacatgttagaagcaatttgaatttcccattttgaaatactttctaatttttgatgttaatagaccatactgtgataaataacctgtgcatttgtgctcccacagaaagacattatttttcttaaagtaaaatattaaaaaaataaaaaaagagcaattttagcaaacatctgtttatccactctccagataccacaactgttgttaatattttttcatgtttactttaagtggctttttttttttttttggcggggccaggcggggggagacgctgatatcttttgtatttcatgaacatatgactgatactgttgaagctgccccctgttccctttccctgattttattactcttcctctgttttccccataaccactactgtgaagtgggtccgaaaccttcctgttcatgtttttatatttgtagtacatattatagtgtatatccatataactataaacaaagcatactgtatgcttaaaaatgtacatgaagtcaagctaggcgcagtggctcacacttgtaatcccagcactttgggaggccgaggtggacagatcacaaggtcaggagtttgagacctgcctggacaacatggtgaaaccccgtctgtactaaaaatacaaaaaatagctgggtgtggtggcgtgcgcctgtaatctgagctacttgggaggctgaggcagaagaatctcttgaacccaggaggcagaggttgcagtgagccgagatcatgacgctgcactccggccaggatgacagagcgagaatctgtctcaaaaaaaaaaaaaaaaaaagtacctgaagtcattttatatattcttctgcaacctttccttcaatgtaattgagatttgtatagagttcatttacaataatgtagttaatacagattcctaaaccaaagggtatgctgttaataaaggttgctacatgatactctagagagttctgccaatttacaagcttaacctcttgatgacatttctgtgcattttatggataaaggagtaagaagcccaaaaatagcactgatgaaattgaagttataattgggtacatttagagatggaaatgggaataatgtgtgagtaagctgctaatcagacaggtttgtcttcatgatgtttcaggattttattttactttttaaaaaataaactgagaccatcatatttacccattttaataacacaacataggtaagaaacctaaatcgcacggtaggattgcacaaatgacaatgactccttgtaactcttttttaaaagcctaaaagtggtgatgccaaatcttcgagtaaatcaaagcgatctcagggtcctgtccatattacagcaggaagtgaacctgtccccattggagaggatgaggatgatgatctggaccaggagacattcagcatagtaagtcttgaaatcggggggtgccagtgtctgcagccgcggtacttgctgtggctctgccttttataggtccagccagagcttcagttgagctaagcaatagtacattacttgggaaacacattgcttacagtatcggaagaccatgtgctcttcagcaggctggcaggaagagattttcttgtcttttattgaggggaagtttaaggagtggatttcatgtcttgtgctcctagttaagagaggctctcagggcccttagaggcatttgggaaagagaagtgttcactgagcaagtatttattgaatgttttctgtgttccagcccccagagttaccatgttgaatagataaccatttctatcatcgtaaactgtacattggagtaggggagttagataactacacaaatcatgttggtgcccctgtgacagggctctggaggagagagagtgcatactgtggagatcctgtgagaagggaatttgacctagtcaggggttgccaggagggcttgtgtaaggaagtgatgtttgagttgggttctgaaggaagaataaaaggtaacaggagaagaggggagggcaaggcgatggggagcgagtgcatggaccaggtcttgcacgggattggatacaggccagtgtgtcctcaaggtccctttgcccctggctggagctgcaggtatagatttcactgtgccaccatcccttccccacctctctgtggtctcttctccccatacttccacaaatccattaatcaaacggctcattcaggctgaaagaaaaagcggttttctttcaaatttgaaaatacttccatcctgtggcagcaaaggaccctgttgaccctgtcctgtaacctctctctgacttctttctctgagttctctaaaacctatacacgtatgtatatagatattgttttctttgcacttaactctgttttcttaagtctcttttttgcctgtgagctctctgaggacaagtattgttttatataaaggtcatttagatgctagaagtatatcaataaatgagtaaattgaataaatgaataaactaattacatagccagctaaccaatctgtttcctagtctttcttttccgagtgtttataagagaaaatgatatctaatgttctatggtaccatgatatttaaaaaatgctcttacaaatgactcatttaatcttgtttttatattatgaaatctttaaaagatgcagagaaatttcagggatataatagtcattgataaatataccatgaagttttgtcaaatctgaatttttttaagactcaaaatataaagctgaatcccttggtgttcctccctctcaacctatgctttttctgtctctctctctcttttttttttttttttttttgaggcagagtcttgctctgttgcccaggctggattgcagtggctcaatctcggctcagtgcagcctctgcctctccggttcaagcagttctcctgcctcagcctcctgagtagctgggattacagatgcgcaccaccacacccggctaacttttgtatttttagtagatatgaggtttcaccatgttggtcaggctggtctagaactcctgacctcatgatctgcccacctcagcctcctaaaatgctgggattacaggcgtgagccaccgcacccggccttttctctctctcttacctcccagacgtaaccatgattctgaattcgatgtttatacttaacgtgtggttctagagttttactgcttaagtctgtaaagatgataatagctcacattaatagccagttactgtttatgtgctttatatatattttttccacaacactcctgtgaggtacgttagtgtttccattttacatatttaaaaataaggtgaagagagttaagtgatttgccctgtgtcacacagctaagacatagaacacagttttgacccaggcagttcggcatgagaggttgggtccataaccattgtcctacgtagcctcccacatataaacaacatagaggattgatttccatgtcttaaaactgtaattggcacttgtgtatcctgtaacttgcttttcctctcacagcagtcacatttgttgagatttatctatattaataattgtggctgtcatttaagtttcatgttattctacaatttattcttccacagtttaattttttcccgtattggtggacatcaggatttttccaaatgtttgctactacaaataggctacagtgaaattgttgcccatattttcttgcactacacaagtgagaacttctctagggtgtatggcttgagcaaaaatggtgggtcattcattaggtgtacacatctgccactttattagatactcgagttcctcttgaaagcagttgtagagattgcatgaattatagcaatgaattcaagttctgattgctgaccagccttagaaacagttgttaatttctgactcagttaacagttgttaatttttgctaatctgaggactatgaaatactgactgaaggtcgttggacatttattttcatattttagtggtcattcatgttccttgtgaattgcctattcagttattcaaaattgacatatttggaataatttatctttcttaccttttctgtaggaattctttttacattcttaatactaatcttttattttttatagtcattacaggtgtcttttagtttttggtatattttttattttatgtcctttttaaaaattgaagtataacacagaaaaatccacaaataataagtatgtagctgtggaaatgaccacaaagtgatggggaatttgtagagttttcattatttgaaaatttcatgaccatgtgtcttacttagttcattgtgccagatactcagtggctgacaaccatgtccctacaccattctgtgaaattttcttgaattatatggtggtaattttctctaagttcccagttttacctttatggaatttcttgtgtttggatatcgaattctggatattggtccctaattttactttttaagttgttcatttctgctttttactctactttctgggagattgcttcaactttgtttcacattatttctttccaagatctttttcctccaccgctctcgaatatctttatacttctctttgctttccattgttcacgttacacactttgcttcggtggctttgctgaccctcagttgtcagctcatgtttaagagtggaggacgaaacatgtgattggaagtttgagcatgtgggtggtggggcttgatctcctttgaaagttttcattataggatgatgtagcagaaacttctgacagatagtcaggatcatttggtgtttcctctggggcggtcacattttgtgaagaatgccccagtttcctgactctccagagcgtgaaggcctggctccatccactctggaatgtgagaggcagagacctgggtgtgggtcatcctgtgtgactgtgctcatgtgctcaggtaatcctgttttcagtgtggtgggctcagccctcatctgtgcctgtgcagtcccgctcagaggtccttttatccttttctggagaataagtctttatatttgctgctggttggagttagagatctgggtatcttatgaatctggatatgtgttacttcttaagcagtttttaaaccgctccccattttagccctcatccttccttctgaagacacctcgccgttgggggaattttgccgtgtaagtcaggttagttctaggctgtcttccctcctggcttcgaatttcattttctcaggtctgttttgtcatttcccgtgctgccaatattttgttgccattatcctctctcttgttttctcttgtctttgtgggcttgtctcttttaaggacagtccctttaccattgttttagtgggattggggaggcagagaaaagatgcttgtgttctgtttaccatcttatctggaagcctttctcttgctttctttcaagcctgaaggatttgcaaatattatatcccgtatttttagacagtttctggtgggagaatttcagattaggtctgtaatactgctgctcattagatcttcaaaatgggcttgtgaggcatgccatgcctctcttgcagatgaggaagcagtatttagagaggttaagtaaggcgtgaagggttatcacataactctaagcgatggtgctggcactgcacttcagggttttctgacttgaatacttacacttactccactgcactagctttacccactcttcctctagcaattatatggcataggggtgggctgtgttttcatcgagagcacagtaagcaaaggacaagacttactttctgcagattgtttatgtctttactctgttgtcctgttgcagtgtaaggagaggatgaggcccgtgaaaaaggcactgaaacagctcgacaaacctgacaaggggctcaacgtgcaagaacagctggaacacacccggaactgcctgctgaaaatcggagaccggatagccgagtgccttaaagcctactcagatcaggagcacatcaaactctggaggaggtaaccactttggcctcgtctgcccagtttgatttgactgagtgtgggagtggattctgttttcttttaataaaaggtggcatagccacctaagaaatctttctcccagcacaactcatctattggcaatatacctgcaggctttaactccctttccatgaaataggccattccactgagaccagccttttgaaggggtaggacgatgtcattaatttattttatgagagaaagatagtgttactggatttgctggtctattctcagaaataaattttctttaagcctacaaggggcaaaaatcatctggtcttaactactttacccatctcaggttgatatccagatattcagatattactgtatctaatacaactaattggttggttctgtaccaacacatggtgacacaaagattaaaaccgcaagaactatgagttctctattctcatatgcttttttagtaattaaagtagtaatttggattaagttaatctagaacttcagtgtttaaggcatcatggtttataaatgttcctttatatagccactgaaacttttttaaaagatttcaatagttttagggaaacaggtggtgtttggtgacatggataagctctttagtggtgatttccgagattttggtgcacccatcacccgagcagtgcacactgcacccagtgtgtcatcttctatccctcagcccccttccccccagagtccgttatatcatttttatgcctttgcatccaatgtttggttttccattcctgagttatttcacttagaataatggtctccaattccattgaggttgctgcaaatgccattattttattcctttttatggctgagtagtattccatggtatgtatgtaccacattttctttatatacttgttggttgatgggcatttaggctggttccatgtttttgcaattgcagattatgctgctataaacatgtaagtgcaagtgcctttttcatataatgacttcttttcccctgggtggatacccagtagtgggattgctggatatatatccactgtccactttggatattttaagaaaacatgactggaaatttttttttttttttttttttaaatgagacagagtctgactctttcactctatcgcccaggctgaagtgcagtggcacaatcttggcactgcaacctccacctccctggttcaagagattctcctgcttcagcctcctaagtagctgggattacaggtgcctgccatcacgcctggctaatttttgtatttttagtagagatggggtttcatcatgttgaccaggctggtctcgagctcctgaccttaggtgatccgcccgccttgacctcccgaaatgctgggattacaggcatgagccactgcgcccagccatggctggaaattctaaaaggcaattgtaacattaaatctctttccattaatcacagttacttcgtttttattttattttagactcagagggtacatgtgcttgtttgtacataaccacagttactttgaacttgtatatagttcatggataatgtgattatctttgtataatatgtccaatctcagaggactggtttttgagtgaaaagtggatttaagaaaacttctgcatgatggtgtccacagcatgcttcacacctataaagaaaagatttaattttcaaaatggtacttttttttccgcttaacactgttaccaacttctttctttacctagcggcatctggccttttttttttttcttctttttaaatttaacactgattagaagatagcaaaaggtcatcccagtgaacagacccatttttaaatgtgccaggcactgtgatcttggctagcagtagtttataaggtcctcgccctttacaagtcaaaaaagtagtacaaggtaagccctcggagaaactgttcgtcatgaggcagcaaatgcaagcccagatagagtggaagtgttgagaaggaagtgcgtgaagagtagtcaggaaggaaggtcttctgagaggcaggcaggtgcacttgaactgagcatacatgagctgagtcgaattgctgagatgaacagagttctcaggcttcagcaaaggcttgaaagtgggacagggaggggactgggtggtgttcaggatttaaagacagtttgctaaaaagactgaagctctttataggaggctttagacaggaaggtaaatggctcttcacctgatgcagcaggcttactagttagggagcctgtacaggtggtcctgtcagcagcaagccatggtgaaactacctgttaggaagtttgagaagatatgagactcctttatctggctcactctgactacctgtgcttactctttctaaacacctgtctcatcatatcattcccctgttgcgcagtaacaccatgctagggtgaacataatggaattggagggaaaaagccactgagagttttaaggaagaaatgaaaggttgtggtggcgacaactgggaggaaggaggggcagcaacacagagatgaccaactgaatggaggccacaacctgggagatggtggtgctgatggatttgtggtagagtccagaaagtgaaggaaaacttaaaaggactggagtctggggtgtcattgatagaaatttggaggagttctaggtattgatagagccttagtctctaaatccctctgtcagactcttttggcagaaccatgtaaaggtgtacggtaagtcctcacataacgttgtttccttcagctttgtttcattataacattgatgagaaaaaaaattgattttgtttcccttaaagttgcaatttccaagaacctatcgacaacattaagttaggacttactgtattattaatgcaaatacctgaaataatatttctgtagcttaatttctatgcttagggagtataccacagcaaaatttaatagcttgccatccatgaagatcataaaaaattgcttttctaattctataattcaccagaactgttcatttttctttttaggaacctatggatttttgtttccaagtttacagaatttgatgctcgaaaactgcataagttatacaagatggctcataagaaaaggtctcaagaagaagaggtaaagtacaaattcagtcctaattcatacaaacaaataccaattccacagaaaaatctcttaatttttgtttttccatggggagatgatcacagaatcatgggttattgctggtgctaatagtcaaacaataagaccagatgggtgaaatagccaatgtattggagcctaacatggttgaaattctgacaaagagtgtttaccctgtgtttttaggtcctaaaatcatttgttcaccaggttttttcttccatttgcatttttcttctgtacatgtcagtagcttataaatgtggctcctaggaagtaatagggtggtgggcagaaaatactttttctcttcttttctggaccatctatttggtgtccttccagcttttgtatggaaggggtcctgctactcacttgtgagaggtgctcagaagttgcctctcctttggaatagggggatgggtgcagaagtgacatggaggaggctgcagaggcagtgctccttgtgtgggtgtgcccatttgcagatctgctgacttgccacatgggctgtacccaagttggacattgagttcaatctgtgagcattaaataccacctccactaatgcgtcagctccatgaagacagagattttatgtctctcatctactgctgtgttctcagcacatagaatggaatagaatggtgctggggacagggaagcactcaggagtatttgttatgctgtgcccagtgctgtgttggcctgtgaagcagcaccctcaagtagttgatgatttaattttacatggaagaatatgttatagcagtaacatacaggaatcatatactaataagcattataaaaagtctataaatggatagtccggaaaggccccaggagggaatgaaatagttaggaaaggccctttagaagggagtgaaaattaggaagagggtctgaagttggacacataatcatgaaagacttcattcatttagggatcagaatgaataacaaaacagtataagctgaataacaaaaacagtggtatcctactagtgggagtatacattgtcacaacctttctggaggagaattcagcaagatttattaaaagactaaagcatgcagttttgcttccaggaatttagttttgagaaggagatagagatttaaacatgtttataatggaaatggcttggaagcccaacagtaagaaatacattcaatgtggctaggcgcggtggctcgtgcctgtaatcccagcactttgggaggctgaggcgggtggatcacttgaggccgagagttcgagaccagcctggccaacgtgatgaagcctcatctctacataaactacaaatattagctgggtgtggtggcacatgcctgtagccccagcccctcaggaggctgaagtgggaggatcgcatgagaccaggaggtggaggtagcagtgagctgagatggcatcactgaatgcctgcgacagagtgagactctgtctcaaaaaaaaaaaaaaaaaaaaaaaaaaaatacagaaaacaaaaacattcagtagttcatgatatatccatattggggagtattaatcagttattaaacataatattgtagaaataagtatttacatggaaagattttcacaatacatgaagtgaaaaatgaataccaaatatttttgtttaaaatataactacaaaaaaaagcttagaaaaatacgtgccaaattattaacagtaattcccttgctggttaggatttgggtcactttattttttttattgtgtgattttttttatatcaaacatttgacttgtgtgataaggagtaatgttactccaacattcagatatttagcttgatgacttgggcataggagttagttcccactggacagtcgagggttgtttgttgtggttagccttggaaagttggtagtcttggttttacatggtccaggatgatcctctgagagtgccgccagcctgggcgcctacaccataccctgtacagtgacatctagcagtctatgcatgtgttcttgcaggtacttagcagtaatggtcaaactcagcataaattccactgagttcccccagcaaatagcctaacagtggaatttatgagccttttttttgttaggaggtagtaaacgccagttcagaagtttaagaaggacaagaaggagctgtttagaggtgatagcctttattcttctctggggaattaagcctgggatcttgagcttctttggtttccttttactctttaggagcaaaagaagaaagacgacgtgactgggggtaagaaaccatttcgtccagaggcctcaggctccagccgggactctctgatatctcagtcccatacctcacacaaccttcaccctcagaagcctcatttgcctgcctcccatggcccacagatgcatggacacccaagagataactacaatcaccccaacaagagacacttcagtaatgcaggtaggtcattaagtggagtttttaaaagaggtgccaaaagataaaaaattcacacagccgtttcattttccaaagacactggctagacttctgtgctttattatcttctaacactttattgtcctctcttttcttaatgagagaaagcatgaaataaagatcccccaatttttttttttgtttgtttgagactgagtcttgctctgtcacccaggctggagtgcagtggcacaatctcggctcactgcaacctccacctcctgggttcaggcgattctcgtccctcagcctcccgagtagctgggattacagatgtgcaccaccacgctgagctaatttttaaatttttagtagagacagggttttgccatgttggccaggctggtctcaaactcccggcgccatgtgatctgcccacctcagcctcccaaaatgttgggattacaggtgtgaaccactgcgtctggcccccaggactattatttcaacttccgattaagaagaacccagctaacatgaacaaacgaaaaagactgagggagaagtttacattctgtatgacagtgaaatggttaaaactgctaatcttgaaagagctcttgtaaattgagaacaaaacaataactgaatagaaaaatgggcaatcaacagagtgaagagacagtttatgtaaggggagaaaatattaccaaccgtacatctgataaggggataatatccaaactgtgtaaggaactcagctccttatgtagcaggaaggcaaatgctcgattaaaaagtgggtaaaggacctgaatagacatttctcaaaagaagacatacagattgccaacaggtatatgaaaaaatgctcagcatgactgatcatcagggaaatgcaaattaaaagcacgatgagatatcacttcacacttgttaggatggctagtaccaaaaagtcaaaagataagggttgccaaggatgtggaggaaagggaacccagcgcattgttgctgggaatgtaagttagtgcagccattatggaaaacaatgcagagatgcctcaaaaaaatcacaaacagaactaccatatgatgcagcagtccctttaccaggtatatattcaacgaaaatgaaatcagttatgttgaagaaatgcctgcacttacatattcattgcagcattatttacgatagccaagatacgtaatcatcctaagtgcccatcagcaggtgagtggataaagaaaatgtgtatatacacaatcgaatagtattcagctttaaaaagaaggaaatcctgtcgttcgcaacaacatggttgaatctggagggcatttatgttaagtgaaataagtgaggcacagaaagagaaaaactgcatattctcacttacgtatggaatctgaaaaagtcaaactcatagaagcagggagtagaacagtagttaccagggtcggagggcaggggagaattgggaagatattaacaacggagataaaatttcagttagatatgaggaataagttgagaaatctgttgtacagcatggtgactgtagttaataacaatgtattatataagtgaggtagtgcatatgttaattaggctgattgagccattccataatgtatatgtattttaaaacattgcattgtaatcaataaatacatacaatttttaattgtctattaaaaaatttgtacagtctgggcaacatagactcagtctctacaaaagtgtgaaaattagctaggcgtagtggcgtagtagtcccagctacttgggaggctgaggtgggagaatttcttaggcctgggaggtggaggttgcggtgagccaggattgcaccactgcgctccagtctgggcaatagagtgagaccgtctcaaaaaaaaaaaaaaattgcagttttgaaacaaaactcaaaggaatccagattgaattaaaattttggaaatttgattagaaaaaaactctgtggagcttatccattgttttaaaacaaaatgagcaaaagttatgaattagacagttcatgtaaaagagaaaattcaaatggccaatatgacgagatgaccaaccttgctactaggaaaatataaattaaagcaacaataggttaatcaatttttttacccattcagatcatcaaaaattaaaaagggaaatacacaccgattgctaagagtgtgaattgctataatctttgcagaaaataatctgaaaacccactctgcgggttgtctgttcctccagcagtggtccctgcctgggaaagacccagatccttagcctgttgcaggtgctcaggatcactgatctcttcagtggtgacagaagtcatctcttaactctttgaggttttctgctctgtggaatcttagtccttctagtcctcattgctttagctgctctttgatgcctttaaacacttctttctttttttgggagatggagcctcgctctgtcacccaggctggagtgtagcggcggcacgatcttggctcactgcaacctccacctcccgggttcaagcgattctcctgcctcaacctcccaagtagctgggattacaggcacacaccaccatgccgggctaatttttttttttttttttttttttttttgtatttttgtacagacagggtctcaccatgttggccaaggtggtcttgaactcctgacctcaggtgatccattcgcctcagcctcccaaagtgttgggataacaggcgtgagccactgcgcctggcctaaacgcattctttttaatcttccctttctcattgtttttggcaggatgtaattctgctacaagctaccctgcctggaagcattacgttctatgttctgtaatcttaaaaatctgagttcaaaattatttcatcaccattttgttgagggaaagaaagctaatgattttgcagaatgattgggaaatgtttccctgttcttagatgtagttgcatcagttatactggcttttttctagtattaggctgtttttgtgttttgtatacgatgtcacttattttatattctgaatcctttacaataacttcttactaaatacattcttttatttaaaccttggattcctcacccatctttttaatagctcaatactttgtaacctgtgatttacctcacagagggtttaagaagaaagaaaatctctttgatttactccagaaaaaatgaactagcttgagttttaagcacctctacaaaaccacagacattgacaccctgttagaaatctcactttccatttgatatgaagccatcctcaagtgatccttcgcatatttagaaggtgtctctttttgttgttatttgttaattcttagggtgaatagtcaaaagttttttactttgtggtgctctcatctgatctacccaggtcagccatgaatttaagccactggtggactgtacatcatattaatgctatcagtttctgagctcagcacttccttaatggtgttgttcttcagctctgtagaaaaaagctggaaggccagtaaaatgagtagagacacttatttggtggcatgtctttgatcttcacataattatagacagaagatggatttttccatgaggtcataggttccttttggttagtcctctgtattagtttcctagggctgtatataacaaagtatcacagactaggtggcttcaaacatcaaacatttattttctcacatttctggagaccaggaagtctgatatcaaggtgtcagcagggttggttccttctggaggctccgagggaaaagctgttccatgcctctcttctgccttctggtggctgccagcagttcttggcgttcttgactcacgccgatttctgcctccatctttgcatagccttctcctatgcatagcctgtcatagctccctctgcctttattttgaaaggatgcctgtcctggaatttgtagcccaacctaaattcaggatgatgtcatctagagatttttaacttaattacatctgcaaagacctaggtaaaatcacactcacaggctctgggtggacatgacattttggtagccacagtttaactctccatccctggacttctgtgtcttcactacattttctgattcaagtgagtatgattcttttccttaggagaaaaggaaggctacagaagttaaaaggattgtagtttggccttaatccgtaagagacagagcactgatccaagctcaaagttagagaaattacttttttataggaggaggtccatttttgtgtgtgtgtgcagaatagggaagaataatagaatcggtgagtgtagtctggagagattttcagagaccaggcacagcaggtaccagcaggtgaaataaacgttagatgtgtaaccggaggatattactcgcagctgtgaaactcagcggtatcattttctgaattagtttggttttgttgttaagagtctgccacagattggaaggttaaacaggtatggagagtgaaaagcggtagttgttaagatttcagaaggagaggagtagtaaattttgccttaaaattttgttggaaagaatgtttaggagtcattactgatacgttagccagcagcaacaagaccaagaagaaagaaatttaatgtctgtttgtaacatgtgtcaggctttcagtttgaacttcagcaaagtagtgcttacttcagcagcatacctacaagaattggaacaatacagagaagattggtgtggaagaaaacaaaaataaaaaataaggctgggcgtggtggctcacagctgtaatcccagcaccttgggaagctgaggcgggcggatcacctgaggtcaggagtttgagaccagcctagccaacatggtgaaaccctgtctctactaaaaattcaaaaattgggcaggcatggtggcgggtgcctgtagtcccatctacttgggaggctgaggcacgagaatcgcttgacccaagagatggagattgcagtgatctaagatcgtgccactgcactccagcctgggcaaacagagcacgactccatctccaaaaaaaaaaaaattgtagtgaaagtgaaattcatccatttcttgcagtcatcagatcattctttcttttcctgcagatcgaggagactggcagagggaaagaaagttcaactatggtggtggcaacaacaatccaccatggggaagcgacaggcaccatcagtatgagcagcactggtacaaggaccaccattatggggaccggcgacatatggatgcccaccgttccggaagctatcgacccaacaacatgtccagaaagaggccttatgaccagtacagcagtgaccgagaccaccggggacacagagattattatgacaggtatgcaaaaggctgtgagacaccaggtgccaacctttgccaggagctgtttctagggagaaagtgacgtatacatgaatgtatttatctatcaaattactgaagatctcatcatgcatgtgtcagccacagcgaatcccatgtcttggttataggttttatgttttgttttgtgggtcatagggagcacatttcacctgtgcaggaaaagagttttctgccgtcttttgaggaaatctagtgaagaggtcgccataaaatattagagtcaacaaccaaaattattaagctctgtgcgaggctgtcagccacactaggtatcagggatcccgagatgggtaccagcccacagtccttacctgccacgagcccataattgaagagtcaaagtcttctgaagctgcaccctctttacttcagtacaatgccaccagtagtacgatgagccgaagctttacattgtgagagtagcaagtccagggagagctaaagaggttttatctgtatttcctaatttcaaatcttggataatttaacctcatagcagctttggttttccctgggctgatgatgtgcgtcatttgcactgtaccttgaatttacagtgggaaaatttcatataaacgtgtcaaagtcgtgctttgtttttggaagatctggtaacagcagcccgcattagcagagagctgtagctgagtagctgccacctcgttgggagactgcccctcgctcccacccttctctattgtctggacccagtgggcatcttgccctgcgttcttctagtaggtctgtatttctatttgatgtcactttccttttgcctgaaggactttttctgctggtgataaactctttcagtgtttgtatatatgcctgaaaaagtattttgccttcatttttgaaagtagtttttgctgagtgtatacatttttggctttacagtttctttcagtgctttaaagatgtacctctgctatttacttgcattgttttgtgatgaaaaatctgtcatccttatctttgttcctctttacataatgttccttttaaaaaaaatcactgattatgatgtgccttggtgtatttttccttggtttcttgtgcttggaaatttttgaacttcttggatctgtgggtttattgtttccataaaatttggaaatttttacaatcttcttcaaatattttttctgatcccccactctctcttcttctttggagattctcattacacctatattagcttgcttgaagttgtctcacagctcacttgtattctgttgacttttaaaaaattatgctttctgtttcactgtggatagtttctattgctacctcttcaagttcactaatactttccttttcaatgtcaagactgctgtgaggcccatccagtgtactttgcattttatacattgtagttctaaaagttcggaaagttgtttttgggtctttttatatatgttctgtgtctaaccttttaaaacctggaacacagatataacaatggttttgatgtccttgtctgcgaatcttatcacttgggtcagtttcagttgatacctcctcactgtgggtcttgctcccctggtgctttctgtgcctagtaatttttgtcagatgccagatgtaacatttaccttgttgggtgctggatatttctgtattcctgtaagtattctggagctttgttatgagttgcaggttatttggaagcagtttcctttttcaggtcttgctgttaagattcgttaggtagaaccagagcagtgctcagtcaagggctaatgattgcccacccccaaggtaaagagcctcattgcactctacccaattgcgttagtctgttttgcaggaatacctgaggctgggtaatttatagagaaaagagttttatttggcgcacagttccgcaggctgtacaagcatagcaccagcatctggttggcttctggagaggcctcagggagcttttactcatggtggaaggtgaagtggcagtaggcgtcccatggcaagagagggagcaagagagagaggaggaggtgccagcctcttttaaagcaccagctctcacgtgaactcagagaactcactcattatcacaaggacagcaccaagccatttatgagggatctgcccaaacacctcccactacaacattggaggtcacatttcaacatgagatttggaggggacacatacccaaaccgtatcaccatctggaggtctttggtgtggctggtgagaacaggcacgatgccagttctttgtgagcacagggcactgttaccttcagtcttttcgggtggtcctttccctggccttgggtagtttccccacatgcacatcctaagcagtattcagctgtatacctgggaaccctctgtagatcttcaaacttctttctctgcagcactgtcttctctcatgccatgccctgtgaactctggccaccttggttccccatccctcaccttgggaagccaactggtgtctttctgggtttccttcttcctgtgtcacagcctgagggactatctcatgatagtgaacaggagccgttaaaaggctcatttcattagtgtccattcctcagggatcactgttcttcattgcctgatgtctggtgtcttgaaaaccactgttctatgcattttgtcccttttggctgtttcaggcaggatggtaaatctagtccctgttattccattttgactggaacttgagattgctcacttcttcctccctctttctttcattgaggtgaaattcatattacataaaggaactattttaaagcgaacaactgaatgaccttagtgcatttataatattgggcagccaccacttctatctagttccaaaacactttcatcagtcagagaaaaccctataaccattaaataatccttccccattattccctctccccagcctctggcagccaccagtttgcattctgtctctctggatttgcctgttctagacatttcatatagaaagagtcatacaatatgtgaccttttgtgtctggcttctttcacttagcataatgttttcaaggttcattcatcagtactcattccatccttatggctgaataatatttcgttgtgtggatatataccacattttgtttatccattcatctgttgatggacatttgagttgtttccatctttgggctgttgtgaataatgctgcagtgaagattggtgtacaggtacttgactacctgttttcagttttggatatgtgcctgggagtggaattattagtcatattctttacgtttttaggaaacaccaaaatgtttctacgatggctgaaccattttacattcctaccagcaatgtgtaagagttgaaggttttccttatctttgccaacacttatttcctgggttttttttttgtgtttttttttaatgagtatctccatcttcgtgggtgtgaagtagtctcattgtggcttgaacatgcatttccctagtgattaatgacatggagcatcttctcatggttttttttggccatttgtatagcttctttggagaaatgtctgttcaaatcctttgcctgtttttgagttgggttgtttttgttgttgagttttagtaattctttttttaatggtatcatgagcagtttaccatggtccaagctaaaaattttaatactcttcacactgagttggtttttaagataattttattaactagtcactcacttgttgcatatttaggttgatggtgttattaataacttacaaaataatttctgtggctctttttctcatgggctgggtccaggaatatggtaatgtttatggatcttaccagatttttcctaaagggagtgagtttgcaaaagccatcagtaatttttcaagtgtgtacttgtgtcactgcacacttgagccttatttcataggatgtattttgctaataagtgtaaaatgactctgttattaatttttttgattcctaataatgtgagcatttgtccttgaatatgagtatatgaggaagagccaagtgggtagtgaagagaagtggatgggaatctggcttcagtctttcgactaatccttgcatctctatttcaggcaccatcatgactccaagcggaggagatccgatgaatttaggcctcaaaattaccaccagcaggatttccgacgaatgtctgatcaccgccccgctatgggctaccatggccagggaccctcagaccattaccgctctttccacacagataaactgggggaatataaacagcctctacccccattgcaccctgcagtctcagatcctcgctcacccccttctcagaaatctcctcacgattccaagtcacccctggatcataggtctcctttggagagatcactagaacagaaaaacaacccagattataactggaatgttcggaaaacataaaggacagctcgtaaaggagagagtaagagtcaccaaacacgtggatatttttggtctgatcctacagtagccggttatctagaccagtaagtggagttttggacatgctgctgctgtcaactcactggctgaaggagcacttcaaggaatgggaggcctttcactgggtccagctctgattcgggtcaccactcctgcactttggcaccccatcccattccagcctagttctggcctcccactttgacgggcacttggaggaggagctgactgtgtgtgtaccagcttcactgggatgtgtttccccagtcaaggaacaggggatcttcagagtcatgaatgttttcttgccagggtcagtgttcccaggaccttagtgcatggtcggggcaggaactggtgcatggaggctgctgggacctggtgaacagtgtgtgatttggttgatttggttcactctgacatgatggatgctgctgatggggagtggcgagttggggcaagcgggtggggacaagcataggacttgaaggggagcaggtacacccctcaaatgtgttcttgggagaagtgatacactcggcctcattatgtgaaacctgtgggtggggttggggtggagaagtagagagagggcaacagcttccacaactgcttcatctctgccaacactaatttttcccacactgtctttgtacatttcagagctttggtctcctgagtgggcctccttttcccactgtgccagggaaggtaggtttctctggctgactgagtactgtgagtgaggcaacactgatgccagcatgggtcttacttgactggggagtaggctgagtgaggggtagggtggggtaggtggggagtagtgtggccagggaactggaatccctggtggatttctgattcctgtggtgagaaggaaagctacaggacctggagaaggggatgcagaggcaggcctgctgaccaacttgttgcaatcacaaaggtgggggtcctggtgcaggcagtgaacaggcttctaatgtggggttcagtagtgccagcaagtgggggaaactttcagtattgcgctaggtcaacacttcctgctgcatttccttccctttgcacagcttgaagaaatagagtagacagaatcacacatcatgtggtgggcagatggaaataagtacctgtggtgaacaagtttctactgtagttggagatcattagaattgaattcagtttctcttagaatataatcaggtataaacctaagttaaactttttcccaaacaaggagcatccaaagacacagtgacttgagctatagatagtaaaaatcatacgagagttgaactgagtcaggtttaggaagcaagtttggttgcatcaattaagcaggctcttttcaattgactgatgctggggccttcagttttattctcagtatagattgccagtattgttaagagtatccaaaggcctttctagatggagacagaataactgacttgaacatacagtgtgcctgtaagtgtccaggctcagagctggtgaaaacccttctgttgggcgtgtgcagggttaaactcctgaagtaacttgtgaggacttcagtgcttgctggtgtcctgggcagcaccatgaatgcctttaccaagacatgccaagttggatcccccgaatgaagcagatgtggctgtggtgtgacccttgctccctgctacacagagcatcgcagggctggcctgtgtggtttccagatgagggtctgggtcccggaagcttgtgttgagagctcagtggacccaccccgcttgctgaaccctcacagttcttggggttgtccagcctggacttgtagcacacatgtcctgaagcaaagctccggtgactgcatgagccacctggccacagtcctcccatggagggcctgccgtgacgctcagtggagagggcagggcctgtgtctccacttaggccacacagtgatgaggaaaccacagatggagcttcttgccgataatactgactctagcccatgattgccttgcccaagccaaagaggaaggttaggttggcttgtcgagcccttgagcgttgggagatggggtgggaaggaggtgagcccctgcagagagttgggtagtgtccttcaggaatgaaaggaggggcaaaggagtcaccagaggtcctgcatttccatcagggtttccacagtcatcagggcttctctcttgagttgctgataggagatgtgagttatgcccagagatgtcttatcgtgaggaaaaagaaacttccttttgttcacatttaggactctcagtgccatatgaagtagcaaaaggcagtatcggccagatcagtgttacattgattctaaaattacagtgtccccattagacaactattttaggtgctggagtatgtttgaagagtgtgctgggaaaaaggaagcatttcttcattgatttaaatcagtatgaatattatatgcctaaataaaaaatttgcacaggtaaattctctcacttgtgaatgggagaagctgccccaggaatctgtgaggatggtattccctggagtctggctttgaaagatttcattgttggtagaaataacaggttgagaaagagggagttagcatcacctaaaacctgcacgtgaacaagggttgacatgatacactatggccttagaaaagggccaggtgaaaccccaagctaatcactgcggtctttcagagccggacagacaggtgccagcagagcccggggctcactctcctttcagtcattcctcagcccttcgaagggaagcccaaacactttgcacgctgtgctgcagacattctggcctggtgtgtctgaaagttgcatcagtcctcacggtgcaaacacagttgatttaggaagtcacacaatgacactgaaatcctacagaccaaaatccacttgtcagcaggagcagcagcccaggcccagcaccagcggtcttccggctcctctgagggctgccacgttgggcgaggggagccatgccaagggtccaggctgctttaggccatctgtgccccactcatctggggacagatggtttttctttattgtaaaattgtggacttttaaaacctgttgactaaacagtaattaatttatatttgtgaaaaatgccactgtcctagtgatttctgatgtaaataatgttgtttatatagtatgtattaaattttcctacattgtaaaactgctgtacttttgattcttgtatattaaaaagtgttactgagcatttttagaattgggctaa

SEQ ID NO: 5 - DNA, 110839 bp, Homo sapiens
  source 1..110839: mol_type = genomic DNA
gctgtccccaagccgattggtacttcttgtcaggaagaaacgccaagaggtgggagtgcctggggagggaggcaggcggtccctaccgcaggcgcggggagctgcctttccgcccctccgcctgctttccaagcctggactcttaggagtggctgaagctgcggagcgcttttggagcctgtgaatgaaccctcctcctctccctcctccttcttctcgctgagtctcctcctcggctctgacggtacagtgatataatgatgatgggtgtcacaacccgcatttgaacttgcaggcgagctgccccgagcctttctggggaagaactccaggcgtgcggacgcaacagccgagaacattaggtgttgtggacaggagctgggaccaagatcttcggccagccccgcatcctcccgcatcttccagcaccgtcccgcaccctccgcatccttccccgggccaccacgcttcctatgtgacccgcctgggcaacgccgaacccagtcgcgcagcgctgcagtgaattttccccccaaactgcaataagccgccttccaaggtaatcacgtttcttttgttccccccttaaaaaacaaaaacaaaaaacttatagaaaaaaacccgcgagcttagaaaaaagaagcaattggtagaaggctttaattaaggcaaagagctgtaaggcgaagttaagaaaatgtaggcacttaaaaaatgcaggtaactttcataagggcttttggggagaggcatacagagggaccttggtgttgaaaaagattcagacaaaagaaacccagggtggggtggggggtaaaatgactaacggaattgggggaagggagggaataaattgtaaagaaatcatagaaaagtggtgggttcttgagctggagagaagagagggacctttggcactttgatttttttgttgttgttgttcttaacacgctcgaggcaaaagtttgaatggggactaccaagacttgccacagacaagtccccgaagccgccttggtgcaggccacctggtttcccagcccctggtgtgtggtcagtgcctggtgttcctggaaagccactcccgggcagctcctgacagtgcgacccggcgcccaagcagcctgggaccttgcgcggacctgaccccttcagaccgcaggcagtctgggaggaggtccggccgggggaggtgcaggatccccgccgtgtctctttgacgacttggggactgtcacggttctctcccggcgcccctgggttcttttgtcctgcacgcggtgcgaaggggccagcagggaaggagcagaggatggggggtggggttgttggagccccgcggaggtctgggaggcccctgggcgggaaaagcctgttctgaatcggcagggatgtgcaacaatttttctcaccctgaagagtgaaatagggtctgtcgctcccatctcaacaagcaaaccggcacccagagcgcactgcagacaaaggtggctcggggacccgaatcaggggcctctgggtcagtcctctcgcccagactacaggagtcctccgtttccttacatattccccaccctctcctagttctccgctctagttgagcaactttactggcaggtctagcggcagcggcgcgcgcgtgtgccgggagccccgggggacgtcctcggctggagcgccccaccgtcctgcagaggcgtgggcgctgtagggcgacatccctggtgcgtgcagacctagggcatccgggttgttctggcccgcggtctgtgtcactgggcgtggagcggtctgggtgttaggcagaggagagcggggtagaaaaatagtgtcatagcctaaactatttgctctccaatccaactgcgtctcggcaagtcctgcatgtccctgggagatgctgcgggaagggggagaaatctacacggcgcctggagagttgtcctgccgcgcgcacacccgcggcagagtctctctgggtcgcgttcctcatctttgtgtctccctctgtctccatcttctctgcctcccttcccctctcccagcctctgttctctctctctagcttctgcgtcccctcccccacagctgacaaatgaatggctagtgtgaaatccctgcctttcccgtgctccaaggcagcagggagggaggagcgagggaggcggtgcgctccttcggatctgcccccagttcagctcacaagacttgcagaacctagatgtctaggaattgggagttttgcggcgggtgtgggcgccccctgatggagaagtcccgcacaggcggagaaaaacaagccccccagaccaagcgagcatctttcacaaccttgtgttcaaggatggaaggccctagttttcccttaagtcattcattttgcactccacaatctgcggcgtacatctaggagtttggaggaccctgaaaaaaggtcttggtctgtgcaaagtgcagagatgccttctcgcgagtcggctggaacgcacgcggcgccctgggtccagttcgccgcttagtggacgaacgcacatggccagggtggagccaggtttcggaggtctagacgcgccaccctgggcgtctttaagaaagataatacacataccgtgctctcaaaacccatgaccacttgaacccaacgctagggccccgccccaggatattgcaaaagaagggctcctaatccaaaacttaaacttcctcaacttcagggcgggcgtcggacgggaaagtggagagaaggcgggcagtgggaggaaaaaagaaagggaaggaagggaagtggaaggaaagaggaccgtggaggggaggaaaaggagaaaggaacggagatggggcagatggcattcaaacagccaggaacggaccggaagggttcgtttcggggtttgggtctgaatttcgagactcgttttaggatactcttttccctttcccagcggcaacaaatgtgactgcagaggcgtgccgggatggaagggtgggaaagaactagacaagcggaggtggtccagccccgcccaaaggggctgggtctggggcccgcccccactcgctcacctcgcgccaagggaggacccgcaacgggcgctccccgcagcggctgggttagccagccgccacgtgggttggcgcttcggctcccagccgagacgggtgtgacttcctgggctcagagactgcagtacagccgcacaggcggccggcgcagccgaggcccccacccaccgaggccaatgggggcggggcggggaaggcagggcccagcttaaccgagagagccgagtggcctcgcccccaggattcggggccggctgcttctggagctgacccgagttccatccagacagcgctgaacactcttattaaaaggctatttaagttttattttattttattttatttttgcttgcttcttgggagtggtaggaggggcatcgtgcttttgttttgaggcaggggagaggttaaaatttactccaagcaaactttttgtcagaaaaatgagactttataccgtattccatttgttgactttttaaatacattcaggtcactctaaagcccattcttagtcaattaacagattaatttcgttccagactgtcataaagagttcgcctggaatggcaaatactgccattcgacaagactaatagaatttcatgggggcaaacatggaagggctgcgagtgtaactgaggttcctgtgcctcaatgaggaaccttagcggggacctggcggggactggaagctcagcacctatttagggagtgactgagctggaaacctggagaagcttggtgcagacgagacggtgcttcttagagctgcattttaagtcctcccattttgctgcatattggaagaactggattttaaagatcttttccatcacctcagattctgtagctaacagccacgtctttttctttttgtctgctgaaagctgtgacctaattgttttaagcacttcttgacaatttcgccaaacccatcctgaaaatattcacataaagtcctaaaataggatgttgtgagtgtaatataaaaataggaaggtaccaatggaagcaacaattagtgttctgagatagaagcggttcccagtttgtaacttggaaatgttaagagcagtacatcagggagaaggtctccaagagtctgacttcttgttctgagctctgagtaaagaaagaaatatgttagaattgtattgtctgcccgcagtaatattgtaaagggttccaatggattccaatgtgattgagcaattacttcctccagcaccaagtccacagtccttaatcttcttgtgagaagattaggtaggaagcgggatgagattcaagacaatcatttaggatttatgtcagaattcaaagttttgattcttttggtagataaaaacagagttggttttaaattgtatttcctgctttcaaaaaaacgaggtttgaaaggaatccccctagatttacataggtttacagatgtaagtttcttctttttccctgtgtttgcaaactggagggagatgcctttgatattccagaatacctgtatctatacacttgtaaattctgctaggaaaggacctaaacagctaaaccaaaggtgaccatgattaatgttaaagatactacccattgttctctcttttgttgtattattaggcttaaatactttggagttaatgattggtcacttaattgagtaacagagcctttgagagcgcaaagatcaactaactctgtctcccaaagtctggcaactaagccctcctttcctggtgagatttaaacatttttgttgacgtcattcatggacaaacatcggtaaacactgtatttaaaatgggatattgccctgtgatggagcagaacttctcaagacacatggttcttttgaaagaaagaattaatgactgtagtaaggtattttttcaccacccacgtagagaaaccagttaggactgacaaacactcattgttgggagttacttgctctggtctgagaaaatatgctgattgttacataggtctgtattttaccagaaaacacaaagcatgtactctccctgatttggaatcagaaaagggggattagatatggatgtcttggccaagctccatttcaattagtgaatttttgccagtttcctcttgtagcctagacttggtaaattacatatatataaagtctgtgtgtgtgtggggggtgcgtgtgtgtgtgtatgtatacagggtttttaaacactgctaagttcttaccattgaatgtgttagaggtggttgtatttcagaggtcagtacagagaatctttgtttaatgtgtcagttctgtttcctgaaacacacctctgggtagatttaccaactataaaaggatacaaatgtatatactttccacatctgtatacatcctacctcattcttctaaggattttaagaggtgtttatgtctataaaatgagattacatattttacaataaacatatttgataaattataatctttttattattaaattattgatttgatattacttgaggtatagtggaatgagcactagacttggaatcagaaagtttgagttggactcactagctgagaaaaccaagcaaagatattacttttggacctttagtgtcataatctattaaatgaatatgcagttataaagatcaaaagagtaagtactttgaaaaactatacaaaaaagggatgataatatattatgtcttgggattcatattgatctaattctataattttaataataactgcattacccaagccatgtagtttctactgaatctataaaataaatcagagaggggcatattgttttaaaaattgtttagtttcattaatcagaagacaggttacagaaattgactccaatgaagttggacattcagtggaaaggaagaattattcaataaatggtttcaggacaattgatgggtccatgcaaaataagaatcagtctctacctgatttctcatcctaaaagaaatataagatgaatcaaatatgaaatgtagggaataactttttacaaaatgataaaagaaaatcatgggattaaaaaaaataagttaggaatagagaaacctgttctaagcaaaacataaaacccagtgccattctaggaaatactgataggtctgactaagtaaaaattacacaaaagcaaataatatatttggaaaacatctacgacatttgagagacaaaaagctaataactcttgatattccatggacttttatgaataactttgaaaagtccacatctatcaaaatatgagcaaaaattatgtacaggtagtggcagaaagagacatagagttttaaaattatagaaaaaatcgctcagcctcatctgtaattaaataaatagtaattaaaacaccaatgatatgctacaccattttttcaccaatcagaggagtaacaaaaaaaaataatttttttctttttttttttttttgagatggagtctgttactcaggttggagtgcagtggcacgatctcagctcactgcaacctccgccttccaggttcaagcaattctcctgtgtcagcctccctagtagctgggattatgggcacccaccaccatgcttggctaattttcgtgtttttagtagagtggggtttcaccatgttggccatggcagttgatcttgaactcctgacctcaagtgattcacccacctcagcctcccaaagtgctgggattacaggcatgagccactgtgcctggcaaaaataaaattaaaaagtttgatgcaagtttgtgttggccaggttgtggagaaactgggtctctcatatactgttgtatgaaagtaaataggttcctctacttcaaaaaataatttggcaatcacttttttttgattctttatcaaaagtttttaaaagatgtatatactctttgattcagcaattccacttctcgacattattatatggatggatattggtaccaatatcacccaagacaaatggacaaggatgttctttgcagcattgcttctaagagcaaatatctggaaacagtgtaaaggctcatcatagggaaccatttaaataaaagttgctgtatccacctaatggaaaactatgcagctgtcaaaaataacatggaaaaattgtatttgctgatttggaacattctccaaaatatattgtattctaagtgaaaaaattgatagataaaactgagtatatattatacatctaattatgtaaaatgggtgtatattcattcttttaacaaatatttactgagtgttctaggcattgtggatacaggagtgaacaaaacatcaaagactgctctgttggaacttttactatggtaggtagagaaaggcaattcccaatcacatatgcaaaatggtgatatgtgctaggatgaaaatagagcatgggaaagggaatagagtacagtatgtcttaggtagagtaatgagaaaggagttcaccaggcagagaacagaggagtgctaaggggcgacaatgtgaaaaagcttagccaagtccaggttcaggaattcacatgatgctattacttgtatgaagtaaattcatgaaatttcacacctaaatcacgtgatttctctctgctgtacaatgattctttctgtgagaaagaaccagtgagcaatatgatatgtgatgctcattacatccactttgtagctgaagtatcctagaaagttggttgtctagggtacctaattagcagaatggtggacaaaaccaccgtgtctctgtccttaagtcaccccttgtcagctgagcttccccaaaatcaagggagaatactaaatatctatttaatagaatcttggctttctctcggaggctgcccatccctggtgtgtcccttatcctccctgcagacatttctcatggataggagttccattgaccttgtcttttatgtctcccaggcaattaaacagtctcagtaccctgtacctggattgttcaatgactttcttcccttctcattgacttcactggagtagaaggctaaatataggcattcactctcatatctctcaggtctttccatgcagacagagttgttatcactagtagacggtgcttataagagagacatggaaaagtggaagaatggaaatagggatttggagtggtgctaaaaacaaagaaagaggcttctgaaagctttccatttaatatgatcaaacatagaagacaaaagatgtaacttaatgaccaaggatagggacatagccttgagaaaattacagaagtggaatgaacgtcttggactccaaagaagagggaatggaaatgtagttctgaggcagctaaagtcaataaagccctctgatatatttactgtagaaataaatgatcatcttttaattcaaggtttgcaaacttaggtgactacaggggcgaggcatggagtggaaatgggtaagagactaagtgggggcagtaatggccttgagcacacagacttaaggggagagactgctgcttggttaatgctcatgatcagccagctgaaatatagacttagtgttgctagaccttctgattttttgaaagaagttagagatcttatatttagtgtaaacagtctaatttttaaattgagtaacttattcaaacatatttatgcaacttattcaaatgtatttagagcatgtctgatctcctccttgtattcttacctagtcttaggggtaatcttaaggaaagtgatgcgtatacttgttgtacctatgtagatggaggaccattctcctctccccaacaaaagacacttttataaggattgagtgtggcacaaagagttcgatttttagtatttaaattgagtaggaaactcaaatacagaagatcctttcctgggtcacacctttggtttttttaaatgagatttgactctctagatattgacaaacatcatattattgggtcatggtaaatcttcaagtggactgattcaaaagtgttcaaaagtatttcaggtgttaaggaattgttggcacggagtttcaaaggtgtttctgcataagaaatagaggcgttgatcatgtatttgatctacaaacattcctcaaggatataccctgaacctggcaatgaagaaatattgtgggaattattaagttgaataaagtactagctctgccttccagaagcctactgttctacagaggagattagacatgtttacagataatttgaagtacatagcaataaattataggatgatttattccaagcataaagtgtatattgctactatagtggtaacctaggttataattttcaaatgtaagagccccaaatactattctttttactcttagtgatatgaaactatgttagaacatctgcagaaagtctgaattagtaattttaataataaatattgagtactgatatattgtatatcactgagatttattttatatacattattttatcaattcctatgatcacttcggtaagtactaattttcacaactaagtagtgacagaaaatgaggtttagagagatatagtattttacccaaagtcacagaatataagtagagaatgcagaacttgcattctgggctatttgacagtggagcccagacttttaaaattaggcttataaagatttcctggaaaaaaagaaaaataaaaaatagagaacaaattttcctgaagaaaagtaggaaattattatttataagtataattaaagagagatctttaatttcttttttttttttttttttgagacggagtctcgctctgtcgcccaggcgcaatctcagctcactgcaacctccacctcccgggttcatgccataaagaaaggtttcttatttggattcagctaatactcatggaatgcattttctttaacacctttttatcataaaatacaatcttttactttggctgtgcaattgatacctttatttttccttaaaatattgtaatagcatagatatatggtatatacttcctgcttgctgtgctgtcttataagaaatccagaaacatagaaacattatggcatttcccagttagtgtttaacaaagtctattagcagatcctagtgattataggataaataacaaacttaattatcagggttaatttaggattatcaaccatatgtttttcattgtgaattatcagttggtctatagatggaaaatataagatgtataatgtattagcttaaaaaatgctcttcagagagtgtctagaattatagaatttaaaaattttgttttgaaaaggtctaattcttatttcaaaatatataaagaaatcaaatgcaaaaaaattaagagaaaaggtcttaattaattaaatgctgtacaactccaagccctatttatgttcaagatcagttttgtaatttatgactaatttcagcattagcttgttttcaatctaggtttgctaaataatatagaatttcttttccaatgaagtttttcagggtcccagctgaaaaatatataccagttaggatgctttcaactgtaaggaacaaaaagtcacgattttattgggtttaaacaataatgacatttataatctcatataaaatgaagttcaaaggcatggtccactctaggtctaatccttaaggacttacgccttgcctttgctgattctttctcagcttcatttccagaggtatctcacttactcatggatgcaaaatccctacaacagttccagcagaaagattccagcatgataatgtccagggaagaaaactgaccacctcttcctttgttctcttctcaggatgaatctatctttcccagggacccttcactggaggaagagatcccctcacatctcactggccaaaactatattatatactgttccaaatccaatcattggaaaagggaatggtacctctataattgacttaggatatcaagatcatcccttgggctggggtttgacccaggattctccaaagtatgtgactgagggtaggcactagaatggaaccagagttgtgttagaaaggagaaacgcatggctattatagaatagttctaaatgctaccgaggagggcacaactgtaaaaaccaaataatcttttgccattcttttgaagttggcactttgatttctagatggttccccaacacaggttcttctcctcctcatcattatagctgccttgaaatttgagctggaagggaacattctgagacccagattgttaaatgtcttttccaaagtcatgcaataaattaaatggcaaagccagggcagtttcttgactcagtacagggtattttctttcattctttactcttgagacgttagaactgttggtactgctttaaaattcatggcaagaactggtcacttttgtaattaacacctccttataatacatttgttttgtttgcttagccagctagaaactacatggagtctgtgctttaaaaagcctgccgaagtccttattctctgttttggtattatgtgcatgaaccaccaattggttccttctcaccttacacttgatgaagatgtctttctttcaacatctttctctattgctccccatcttctcttgctctatttatgatcagctgtctgtttctaaatagactttgtggtcacccatttctttttgtgccagctcctatccactagttacttgaactgtggtctctgttgttcttcatacagcctactcacttgtggttgtcacacacatccacattgttatatgttcccaaactgtattctggaatgattttggtaatggctgcattggatgagattcaaactaataattaaagcattgagatagcttctgctattacaagtttactcctgtttttatagtccaagaggagctacttcttctactcttattacttaatgcttaatactacccttattacatacaatgcacaaaaagcatgtgatttatgacccactttaaacctgaatgcttgtgatttactttgtgtttttcttcatttctaggccaagatgttcataaatataaagagcatcttatggatgtgttcaaccttaatagtaacccatgcgctacataaaggtgagtgtgctaacaatttctttggtgttaattgaaataaaaatgtaagtgctggaggatgaaatggcaatgtggaatcactggaataaaagattgatttttaaaatctattaagtgctgaaaactatcagttaaaatattattggaccaaaaacattagttttaaataaataagtcaaaacaaaataataagtaggatgctaaagatgcaagtgagcttttagtaacttccctgattactttcaggctttgcaaaaaagctcatatatggtattgggcatattttaaaattctaacactatttctcaaaaactttcctatgcaaaaaaagaaacactattaaacacccagtgggctagaatttgaaaagaattgagaagataaagagaaagctgacagccatgtttttgcccttagttccttttcttttcttttttaaaaaagcagttggatatgcatatgccctagttttttaatttgaaattttatattcttccaatgagggctctataattccaaatttattatttaatatattcaaggaatttgaagaaagatgctatccaagagtttcactcatctgcttctgtctgtctagtgtacctctccagactcagattccatttcttcctcacacttatattatgcatcagactcaccttttatgattttccagatgaattccttttgctaaagtttaagtcatccatctattcattacccctccatccatccatcatctatctattcatccatccatacctccagccatccattcatctgtccaaaatctttccatctgtttgcttatcaacatctatccgtgtattcatccatccatccatccttccatctgtccaaaatctttccatctgtttgcttatcaacatctatccatgtattcatccatccatccatccttccatccatccatccatccatccatccatccatccatccatccattcatccatccatttttcccactcacccattcatctgttcacccattgatgatattttttgaataccttctttgtgccagatattattctgggtgtctgggaatatacccatggatgactcataactggcctatcgttctttaaacttacttctctagttatgggagaccagcaataaacaagtaaacaaacaatccaggtactttcaaattgatgaacataaaacagagtgacatcatagagagtggcttgagttgggggaagttgataagacctccttgagaaagtgaaatttaaagtgagatgagaatgataatgaggaaccagccagccaagacctgtctgtaagttaggaagaaacatcgtgtgtttgaatagcagaaaggtcactatagttggagagcagtgatcaaggggaaagtaggagacatgaacagagagattagcagaaaccagctcatctaaataataataacacccaaaacttgaatagaactccctatgatccaggaactgttttaagtgcttaacactaactcactgaaacatccattacccctgtattctattgaggaaactgtggtaccaagagaggctaagcagcttgctcgaacgcccatacccagtaagaagcaaagcttggagatgaaccaattcataggagtgtgtgctctttaccaccatgttatacttcttatctacatggaacactgtaggctttaaaaagtctagaatttttactcaggaggctgagacaggagaattgtttgaacccgggaggtggaggttgtggtgagccgggattgcatcattgcactctagcctgggcaacaagagctaaactccatgtcaaaaaaaaaaaaaaaaagtctagattttattccaagtgcagtaggaagtattgaagggtttcagcaaagaaagatatgagttgatgaatgttttgaaaattcagtttttgataatctatgcagatttgattgtaggaaagcaagggtagcagcagagatatcatttaggaggttattgtagtagcctgtgcatgaaatggggtggggagtagtttagatcaggtagcagtggagatgaagagaagtgaattggatatgtggagatggaggagtcagtccatccactgatggattggatggggtgtgtagtgaggacatgagaggagtcaagaataaattgactcctgggatggctctctttccccttttcacctccagattcccctttctaaccaatttaaaagctcctccttgggtgggtgcagtggatcatgcctgtaatcccaggactttgggaggccaaggtcggaggagtgattgagcccagtagttcaagaccagtctgggcaacacagtgagaccctatctctacaaacattttaaaaaattagccgggggtggtggcttgggcctgtagtagcttgggcctgtagtagcccagtagctggaactccacctactgggagggctgaggcaggagaattgttgatcacagggggtcgaggctgcagtgagtcatgatcgcaccactgcactccagcctggatgtcaaagtgagatcctatctcaataactggtaaataaataaataaataaattcctcctccatgttccccttgtcccctgtgctgttgcagatataataacatcttccatgctcttgggataagttattgtttttcttcccaagtaggctactataagctgcaaaaaggcctttcatcttctagcaaagtgcctgacacactgacagcacttagtcattttgtgtgttgactaaatgagtgaataaataaataaatgccacagtggaccacctggatagtttttagagtctaggttccaccaattggatcatgaagacatgctaatcagatggtgaagcctaggagctgtcttcctcaaagtttttgggaggtgaaggtgaaggtcacagagaggaaaggacaacagcaaccagtgaagatggagaaagggatatgaaaaggggagtggtatttggatgggctgtattggaagggaatttacagggaaagtagtaggcgaccatccttcagctgaaatttagactttccacttaaagaaagaactcatgcaatgaaaaacaacttgtgttgtacctcctttacagtatttacaacaataattttgatagccaacaacattgagtaatttctgcatgtctttacctattctttgtaaatccatgatcactattattagatgtaattagtttggggctaatttcaggagaatttttttatatcagaggtgaaagttacaaatatacgatccacataaaacagattttctggatttatagtggaaaacacagtagtaacttgttgagtcaagacaagtactttcatcttaaggtttttttctgtttattcccagtcactgatgaggtcaacgactaacataaatgaacaccttgtctattgttatgggctttattttaacccaagaagaactatttcctttaacaatacacattatattatcttacaaactgtcctaatcgttgattatctaccattggcctagttattttgatgttccccttatagtaggaaaaggagtcatgcacagtcgtgaataagtgaatgaactagatagtgatatttgtcacttgaaagagtgataaattcccatattctcaatttgacatttatttggccaaggtctgtgtgtgtgtgtttgctcaaattgtgcagatggaatttacatcatctttactctaaggaatctgctgacagagaatgaggggtaattggttattcattatttagtgatttctccctcactgtactcatttggaccacaaaccatctggtaacagccaatgttttgttaggattcatttttattacttgaattgtcagcatttcagacaaattcctgtaggtagcagatttcttttaaacatgcatactctgtaaacattatactctgaactactgaatttctttcttaaaatatttagatttagtgaatttcgtttttgtgacccagtgcattaagaccgaagatttaatacacaaaagatttgaccacacagctttttgttaatcttgttaagtttgtattcacatcaatatattatttatatccaaccaaagcttttaattttcttatatatataaacatctagaacagtaaacaacccttgggaaattgctttttaaagttatttttttccaacataccttttctttacagcacagctgtttagcaatgctctatgtttcagaaacctccctattggatagattgggttgaatctcatgtctgtccctatatacttcaaattgtgaagagaaatataatttgtaagaaatattgaagaattggaagacatatattttaaactaattttaaaagacatgataaagagtttcaaaattcataccagaattaaagttgatgataaagctgtttatttttgcatttgaaaatagtactttatttgtggcaaagttagtcatctaaataattcttcaggaaggaagatgagattttctggaacatatgatgaatataaatttggagatttttagagcacaaaattctcaccctttctcttctcagaacaatatctttgtgttatcatcatctccctaattaggtccaaattaaaggaatgtgaaataggtagaaggtactttcagagagtcctctgtgaaccttacggatttattaaaaagatcatgaaattactaaaatatttcagttcagatagtaattaaatacttatagaaataggatgcatctagactttgaaaaggaactgaaaagaacacttcttttacttcatttaggggcagaggaagcacaccagagctaaaagattccttgattaggtgtcaggagacatgtgttctgactcaggtctctcaccagccatctgggagcttatccttcctctcagtggaggatcctttgtaaggaattcgaccagttttactttaaggttgagctaagttagagaatttactttgtaagccaaggaggccattaaaagtggaattattcccttgcaattttattccaaaatgataatagtcttagcaatatttcaaaggataatttagtatagctaatagcacacttcactttgtttttatttaatttcattaagtgccttaagtctgctttggataagctacatgtagattaataaaataataaacaaatgcataacagcaatggttattatacatttgaaataaattagtgatttatattgtaagtacattaaatatgatactatattaattattttggatttatttgcatcacatgaaatgttttataggccaatctctttttaggttaaaattttaatctttagcaagacagtatttttttcttaaaggatatatctccatagtatcttcttgcaattttcaaaatgcttttctccaactgtgtttacattgagaatccacagtgtttacattgagagtgatatcatttccaatgcatgcccatgttgagatgtgtgtttccaatatgtttgaccactagcagagtgttagatatacatcattttgttggttaaaaaatcattatttcatttcacctagaggctactattaacttgttgaccatattttcatgaagtaagcattgtttgtgcattatcaacaacttccattattactaacatattgtctagcctaattaatagaggctggaagatagagaggagagtgggagagaaagggatggattcctctaagagtgaaaaaacatttattttgcaggtaatggtgttaaactgtagtcaatatattctttatcattaaaagtttaaaagtttaaacagaaggacattctgcagataaatattttaggacggttaggtgaacagaaaccaacctttccccattatataattgaaggtaatgtctcactgcaaagtgatggtagctggatttgttataattatgaaagcctttggttccaacacaggaccaaagtgcatccttcaaatgttaggctttccctggttccagtcctatgaagcacttttttattttcacttcatctttgaattttgttttcatttcctctaaggtaatgtggcagttattgtaacaaacattttttgtctttcgacctgtagacataattttcatctttcagctgctcttcctaatgttggtccagtcctttaaacctgccctacggattctagtctgcccttctttgcccttaattgcttgacctcttatgcttgccttttttttttttatcacttattttgttcatgttaaacactaagttaaaaaattttaaaatgaatgatgccacatttctatataaagaaatgagcattattaatccctgttgttgtaaaacatcattgaaattgtatgctattctctttatataaagtcattctaattatgtcacatgttgaagatgtaaccaaactattataaaggctgcttatccattcacatattgaatagattaagtttgggttttttaagattgttaatttgttattttctctttcctctagtcaaagtgggaaaaagcccaccggtgaggggctccctctctggaaaagtcagcctaccttgtcatttttcaacgatgcctactttgccacccagttacaacaccagtgaatttctccgcatcaaatggtctaagattgaagtggacaaaaatggaaaagatttgaaagagactactgtccttgtggcccaaaatggaaatatcaagattggtcaggactacaaagggagagtgtctgtgcccacacatcccgaggctgtgggcgatgcctccctcactgtggtcaagctgctggcaagtgatgcgggtctttaccgctgtgacgtcatgtacgggattgaagacacacaagacacggtgtcactgactgtggatggtaaggcttttattatctgcaagaaggtagtataacatgacacctggttcagaagcattgagaaatagcactcagaagtaactgttgtttggggtttggatgagcggaaaaacacctgtcaatccagtagtccacgtctttcaccaaaaatgaactggtactcattcaaaagtcaaggcaggtgcatttttggcagccacttcattgattccatgaaggaaagtattgtatactgaaaataacgaatacctcaaggcatgacacataatttaataatcattacttcagtgttgagtcttatcagtgattctttttcaagactctgaaggcgaatctacattttaaaaattattacatatgtgtgtatgcacatgtacatacatatacacacatatatacacatatacacatgaaaaacctttcccccttttttctctcttaatatgattattaaaatatttgagtttgcttttaggaaattctatcttaacttataccgaagaaataaggtatttaataaaaaccatggtacatatcagagtcttaaaaaggccaagacttaataaatatttgaattcgatcaaacagaaatttagtatattttttaagattaatatcctagttgttatccgttaagtattgcagtgagacattttagtttcaccctcttttcaggggtggtttatatgtcatttgaatttaagttaggagacaaagcaaagaaaaattgctttaattgggtacacacataatgccatagcccttggaagcgtaatattttggcaagttattaagcaaaattctaatacccagacatgatggaacagattttcttccaatcctccatttccctataaaatatttacctttcagaaatatatacaaagggttttattaaaagtctttcttgtgtagccaaaaggaaatactttgaatttcagatgcaacacattaactttctgatacccttttatattcaaattccattgcttccttctataaatctatttttatgttgtctaggcatccactaagtatcctgggttcttctaacctttttatcattatttttgttagcctcactactgtgatttctctctctctctctctcttctgtttacgtatcactttttaaaatccccaaaggagtttaacaacttcttaccatttttcatcattaaagaattagcaatggatttgccccttgcccctctgaaacaatgaaaatcctccacttaatctccttagctccatggggtcttcaaattattccagcaactgcagatacttatacagattgaagttccctgccttggtcgaggaggcctctttgtgcccctttactgccaatcttcagtgcacatggaagatttttaattaccaagaagactatttgaagctttgatcaacattaaactaatctaaatctattcaaattcttgcttaagccttagagatcattttaagctatctcttatattcaccagatagcaccatatatattttctggcaattttagagaggttctataaaggtacaaattggcgtttgatttttttttttggcaaaatctcctatttgagtcataaaatatcagaaatgagaaaatgaatgccagttgtcattgcatctacttagtgcccgtgcaggtctttttgcgttggcactgatctgaggcacttatctatgagatgggtagtcttttcccctgtagtcatattactacagtaatataactctggaagacagagatgatctaaggatgaacacatgggagacagtcttataactagaagtcaggctgcagaagataaactgttgtccatcccaggaaattactagggataagaagagtggcacgtatcttggaaaccacagtttatcccaaataacaacaacaacaaagtgttcttaaatgggatgactcttaataaaatctcattcataagacccagttgcctcaatttctatttttcagtgacttctctggcatattagttcaatccactttgatgtcttgcagaaatgagtcatcatatttaccccagctaaaaatggagagactcttgttgacatggcaagagaggatccagagctccacccccttgcttgctctatccttatccctttgaaaatttcttgagccctggagcacagttcaaaaccactagtttataccacccctaaaatacaacaaagtggaatttgaggcaagtatcaggagcttctactaggaagaatttgagaatttatttcaggctttctttggataaaaattatacatgttatctgtcatagcagagaccctacgttatgctggtcaggtaaagaatatgataaacatttgaatggtacatggtggtctactcaacattttaaaatcctttacctaatttgaccttcacaccaatcaagtaacatacatatttttagttccaccttatgggacaggaaattaaagctcagagaaactgacttgtataaaagtaaggagtaaattagggattggaacaagtcttctcactcataaatagtccagtgtcttttccactctagtacattgtctctgaaggtaaatatctcattgttttacatttggaagaagtggtgttagtgaatatttttatgagacaggtgagtgtttcatgcataaatattgggttgaccccggataaagtcctgaagtagaagttgatcttgtggtccccttaggtctttgtatcttctgcagaatctactccctttaggtatctggtgttcccatgattgcgtgaatactgcctgcaatcaggacaactattgggattcagtgacttaaatctcttccttgatctaggagatcccctaggaaattttctggtggagcagaatgggatgtctagatgaatggcatttttggagcccctcaaatcaacatgattttgcataatgctgcatgaagtaaaagtaaataattattatgatattattactatgtatccaactaagttgatacattgctccaatgagaaattttgcacagtgcagtgggagatttgaacaggctggcaattgtttgctgttgtttttgcaggggttgtgtttcactacagggcggcaaccagcaggtacacactgaattttgaggctgctcagaaggcttgtttggacgttggggcagtcatagcaactccagagcagctctttgctgcctatgaagatggatttgagcagtgtgacgcaggctggctggctgatcagactgtcaggtaagaggtctgggggccacaggcttcattattaacttgagagtgagaagaaagtgccactaactagccatttatttccccagatatcccatccgggctcccagagtaggctgttatggagataagatgggaaaggcaggagtcaggacttatggattccgttctccccaggaaacttacgatgtgtattgttatgtggatcatctggatggtaagatgtttgagtttctatatcttcgtatgaactgagaaaactgagggaagaccagaagttcattggaatagagcaagtcttcgtgcttgtttggattccaaacggtggcattttgtttatacgactgtatgattttgtggtaaaataagccgaaattaaagtggaaaggcaaggaggagtgtgtaaatggttatgcaggttagaaatgtcttcagttaatggcaggttttcttacagtcatgctgctcttggactgtttccaatacacttttagatcattgagaatagaaagctgtaagggtggtacctattctggtgagagcataagataaaaatcatgtgatgacaatccactgtgaatccaagtactgataaacaccccagagctaactaaataactccataaactagcccagcaggaattttcaagtttgacttcctgtttattttgttacactaatattcagagcaatccttccttcattcaaccagtcaatacgttaaaccagttaacacattaaaaatcacctactgtgatttttgtaggtactctgctggttgttagagatatgaaatcagttaagatatagcccttcctttcaagtcgcttacagtctgatttcagcactgtcatttctcctttgcctgagttagagattcttaaagacaaatttgagttcaatagtaccgacattatctaaagagcatggtgcagctttattataaaggcacagggaggtgggcacagtggctcacgcctgtagtcccagcactttgggagagctaggtgggaagatagcttcagttcaggagtttgagaccagcctgggtaacgtggtgaaaccatgtctctacataatgccaaaacttagctaggtgttgtggcatatgcctgtagtcacagttacttaggaagtgagagaagtgtgggggtggggggtcctgaggtgggaggattacatgagccagggtgtggaggctgtagcgagctgaggagattgcgccacagcactccagcctaggtgacagagtgagatcttgtctcaacaaatacataaatataagtaaaataaaggcacatggaatagaagtttctacaacttttgaaatggattttcatttgtattaacagctattattagaatcctaaagtatagataatagtgttaaattaaattatacttttaattttgagtaggtgcatataaaaagaatgatctgaattttcttatgtttaaaatgaggaggctggactagataatttctatggtctctttcaacattaaaattctgtgattccctgattctgtgaattgaataagcaatcttagagcccgaaagctagaatataagcagcttatattttcctaatgccttgactaaatttgcatcggaaggcctgctttcaaaaagggtgcttaggtgtggttctctagtatcttagcattcttattttcactatcactgaagattgccagatgtattttctaaaccaaaagtgcagatgtgagcaaattttatttttgtatataggaaaagggaaaacataacatccaagctatggttgaaatacataaaactagagcttttctcttgcctttattttaattgatttaaaaaatagaagaggagatggttggtaggagaatctgattaaataaactaggaaataaattggattattgctattttggtaaggtgggaatttgtatcactattgttttaatttagtgtaatatctacaagggtgatagttataaacaatatctgaaatgctagtaatactagaaatgatccagaggtagcttttgcaaaagtatatgtaagatctaattaacctaaaagatctttaccaaatattatttaaatggtgggctttcgtgattcaaatatgaataagcatcccaagccagattccttggtggaaagacaggcttatgtacccatgaagccaccagccagagagccctagagaccccccgtgtgtttgtttttgagtttactctgatagagctactatcagctcttagctctctaaggctctagactgcccaaattcaaaattattttttcaagcccagggagggattttatagaagtcccagaaatttcagggcctctgcaagtactgtttgaagaatttttgacaagtcttagtggtgggagtccttccagggatttcctagccacactgtcttcattgaacgatggctccccacagtctgctcatagtatcataaccagtgttcaggaactggactctgtcagaagaggagctctgaggatgtatgcatatctcccatgacgagggatttactagtcttatagacgtcctctcccacttccataaacacaatcacttctaaagaagccagtttgtgtcccaatgtaacccaactgtattttataaagttattttggataaatctacatacttggtgactgaaaacttgtaatgtggaatatagcataactttacttaggctctttataccaaatcaacagaattttcatctttttgttttaatatgtaaaaattggaagagaaatataaaagagtcagttcaaatattaattcaagcactggctgaaatcagtgtcagcaaagtaacaaggcatttatttgtttcatagaagaaacttgacaattctggaggatattcagcatgtttacaataacactgttcctgacatttttttcctccttgtttattggctcttggactaagtatcaaatctttggacactgttcttttctttcttggcttgaaagtgagcaggaatgggggtgaaaggtaacttttatggctgatgaggtaagaggaagatcacaaaatcattcttgtaaggcttctctcatttcttaactgaagtatatgtcttcccttttgaagtacagaccatggctaatgagtgaattaataaaaaattcttgtggaaagttgactacataaaattacgtctggtatttcaattgtcacgttgataaaagattatttgaaggtgagtcaagattccttgtaagaggcattgctaaattcatgagtcaaataattcccacctatattttattatatttgggggagtcaagtgtgtgtgtatgagaaatggtggggacagtaaaagatttggtatattcagaatgcatgtgatggaacacacacataggagttatgaaccaaggtgcaattaatttagatcagaagccatatattccagatggtctgatgaaaaagccaattaagtataaaatgaaaacttgctcaaaaaggcaattaattttccgttttaatttaattatttattgtgaaagatatatagttgacagtatgttgacctgtttttttctcctttcttgttttataatgtcatatcttcctgacatatgtgtttctctataaaatttgaataattgcactaaattaaatcctgctagttttgggagaaaaatctagtagggttctttttctaaggtggtgattataacagttatgcatattcaatgaatattcaattctgcttttcaaaataacctattaagttttaaagagtaattacattagctatattcactagtaaacatttcaatatcagctcgtgttcttagaaatggtctggaaattatgatggcttattagagatgattcaatcagtaatagaatgctattattaagaaattaatggaattaaaattttaaaatgggaatctagaaattaagatccacaaaataatccttattaggaattttaatctttgtttcccagtaagacagatttggaaaacattgggagggttttaaggtagagttgagatgattaaatggctcaagaaattaggtaaaggatcggaattatttaagaacgaaattaatagactgactatttatttggtttcctgatggtagcagatactttaaaaaataagtttcttttttaggcatttaatttatcctgcagataaattggaggattgcagatgaggtcctattaccttctttcattgttgacccacttagtttccttgcaaatgagtcaatacttccagtcttgtccccagacctgacaaatggttggttcaggagcttctctcccctgtgacataggcctatcctcttatggcctgcattttctatgtagccctgccttttggtatttacttcacctgggttaactactaccctactattccaattctctgtttttttacacaagcttccagcactttgacaggcctatactgtgggcactctctttcatctcatattccctcctgaagacctaggtgattcttctcatctttaccatctctgaaccttgaatgtatgactataattaccctcttgcaaatatttgcttatacttctttctctcctactaaactatggattgggggaaagaaggaaacatacaaattcatttttgtatgcccaatatgtccttagcatatagtaggtgctccataggtagagctgaataaatgagtgaattaatgaattaacttctaaaccattaatgcctccctactcaccttgatttacaattgctttctggatagtttcacacttctccaggatccatcagtatactatctgcttcctgatttttttattgctttaattttcttattagtttgtttaatttcatttttgttctcttgtacataacttgtaagccaaaagtcttgtgggacatatggggcatgaaagaataccaaaagaacaaatacgtgaacaatgaagatgttaatttctagttttgcatgtttagctcctgaattcttttctgaatttcatacccatatttctagtttgtgaatcacttttgagtttcatttttggttttggttgtcacaaatagtccccatcactttaagagtccttcaggggatctgttttactaccatcaaaacagttaaacaccattgccatgtaattctcctacttaacgttgtgtgttggttttgttggcttcttccacaagcacatactctgcctggtcttcaaaacctatacctgctctactgcaatctattcacccttcattcccacactcttcaatgtgaccccacacacgtgcatctcgccctgcacagaccctttgcttgctcctgcttgcaagtctgctctgttcctctcagggaacacacacccttcatctcttcaacattgtgattttgcctgtgcttgaagacttactgcttccaggatcccccttttggctattgcagctcacactgaaatttcttgactctgaacttctactttacttagagttagttccatgtgatttattgcttaattgttttctggtttctttgtgttcataaaatataaaatgttatatgtttgttttatttcagcaaaattattgtaagctcctagtagagataagaccataaacttctatatgtttcccaactgcaatcaagagcctgttccaattgcagacacgtaatagttatccaataaatagttggtggtaattatagtatttttccaacctttgtctcttctggaaactgccttccaccaccacctttccatttatctataacacttgaaaaaatgctttgctttatttaccaaattcaaaaagatctactttttaccattatttaatcaccatgatactattttttcctctttgtatttctcctctcactcttttctcctctcactcttttctttgatgtctcttagaaattactccttcccagagatactcctttctggcctctcatggtaaattattttccttgccttccactccttcccagcaaattgtcctctctgggattgcttttcttgtattaatacctattcatcaattataggttattatttttactgtttcttggtgtcagagtccaggatggctttgtcacctctgtgacttatctaatgcctccatatcattcttgtgcctcacctagaaccaaaaacaacttttccatttttgttactttatgagctcctttagatatgaaaatctaaacatttagataaacatcatcaagtaggtcttagagcagggttagttctagctttttaaaggttttggttggaccaaaatcagatatcgcatctggagattgtgtaatttctttcctatagattctcagattgcctattaattttaatgagatttacagtatgtaatctacagaatacttcactgatgaaggttatttaagaattagtgatttgcgtccttactgggcttattcagttaaaaagccacatatcagcttgaagagcctcttgcacactatgattccgccgatggttaaagtagtgattcttgatttcagaatctcttcacatttgttgcagttggccctagaagatgctaaaaactttttaattatccgtagcttcctatatagactttggagattaacacaccttgcttggagttgcttctgtgtacagtgtttgaacagtctacctaagagccaatgaggaaagcaatcaggcacagcatggtgggagcacctctggaagatgatgtccttatacagtgtagtgactccagtaagattgagtgtgaggtagtttcatgagtagaatgaggaaggaaaacatctactgtgtggtgggagtattatttaacttaaatcttatgaaacctttgtcaggcactttttaaaagaaacctcacttttgcctataagaaaactgaggcacagacaggttaagtgattagatatgccttttttcttcttctactgccataaactcacagggccactaaagattccccagtagagcagcaggcagtcttgcaagccaagaagataaaaagtaccctcaaagctccctcaaatctctgatatctcattagaaaaaatcataattcttatttgagcaatgattgcattacagattggattacaatgattgggattgctgggtcaaatggtaactactttgaactttttgaggaaatgctaggctgtttttcaatgtggctgtaccattttacattctcatcagcagtgtattagggtcctgattcctccacagtcttgtcaacacttgctattatctgaccttttgtgtagccatcttaatgagtgtaaagtagtatctctgtggttttgaattgcatttctctgatggctaatgagctccaacatctttttatgtgcttgctagttatttatcaatcttcttggtagaactgtctactctgaaactttgcccacttataattgtgttgtctttactattaaattttgagtgctctttgtatattctagatttgcatgtcttctcatgtaaatgatttacaaatagtttctcccattcagtgagttgtctttttactttcttgataaggccctttgaagcacaaaagtgtttaatttagatgaaaagtccaatttgtctatttttaaaatttttgtgcttttggtgtcatatctaagaaaacattgccaaatccccagtcatgaagatttatctctgtgttttagtctaagagatttataagttttaactcttttgcttttattttgatccatttggagttagcttttgtatatggtgtgaggttggagtccaaattcattcttttggatgtggtcccagcaccatttgttgaaaagataattatttctccatttaatgaccttggcaccctgttgaaaatcaattgaccataggtagatgcatttatttctagactctcaattatattccattgatctgtatgtctatctttatgccagtaccacaatgtctttattacaattgctttgtagtaaattttgaaaatggaaagtgtgaggcttccaactgtgttcttctttttcaaaattgttttagtattctgggtttcttgagttcccacatgaattttaaaattggcttgtcaatttctgcaaagaagccagctaggattctgatatagattgcaatgaatctctagatcaacttggggtatattgccctcttagaaatattatgtcttctgatctgtgaacctgagatgtctttctgctattttttagatattctttcattttattcaacaatattttgttcttttcagagtataagttttgcagttcttttgttaaatttacttgtaaatattttactatttttgatgcaaatgcaaatgtaattttcttaatttttttgattgtttattacaagtgtacagaaatgcaattgatttttatatataggtcttgtatcttgcaaccttgctgaacttgcctcttcgttctaattgttttttagtggattccttaggattttctttatacactctctttcattttataatcttactttacataagtagaactgtcttgacataaactccttgaagcatgtgacagtcatttgctttaaggttttcatgtcagggtctcctggagttctgaatcaaaagagcttctttggaaatacagtcaccatttacctcccagctgtgaaaagccaaaaaaacccaaactaggctgatactcctgtgttgacctgaggtcattctgtgcctgtcaaaccaaataacacattcaatcttttgtatattttgaagactcagaaacccagaaatttttagaacctctttctcactctaattaaaacctactgctctgtcaatgggaaagaatgagtccaaacattctgaaaaccgtacaaatgtgtttacattttagtgggggcttcctgcatctttaacctctttaaattgacataggtaagatcttgtgtaataacacatttgcaaatatgcagatgcattttcaaatgaatataatctgatttagagaatattaactgactatcatagtagactatggataatactctaataattaattacaggttaacatttttaaaactcaaagcatatgctttaagtttatgctttaagccacgttatgttctacttcagcctaatacaagggagaaatttggagggggccctcctagctttctagtctcattattcccaaattagaaacattaccagcctaacactaactctggggtctaaaatgaagttattttggcagccctagagttttcttgtcattgataactgaagattggcctttgtgcaggttaaataatcaaatcttagaggaaattgacatgcttttaaattatctacaaatattagcccttaaaagattatatagcagtatatattatgttaaccaatccatgtgcagctgatggactttgtgattcagtggataataagcattagtttttcctgctttgatcttatgtatatccatacagaaaaacaaaaaaacgatggagagagagatagagagagagagagaaaagaaaaagaaagtgttgaaaaagcttaaaagtccaacatttcaaagctaatcattttgttgaattgttgctatcaccttgatacttgatatattctgttagtgattttatcgtatgggtatttagaagctcatttcatgtaactacttccagcttactcatcccatttacttttgcatacatttattacttatacaccattttgacccagatagcaaggtaatgtgaaaacatttacaaatgttgaacttttgtagtaaaataacaacaacaacaagaacaaaaaaccaaaagagcagggagtgctgctcccaaatggacaaaggaaattatgaattagtttataagaactgattttcagaccaaacagtgcagtatagtagagctataagcactaatgaacagaagaaacataatcatgtatcacatcacccagcaaatatactctgctacaaaactggtaagatctcagctttgactgccacagagagcagcccatctgctgcagtcaggaaagaattgtgtaattatctgtgattaagtcctcctttcaccttggtgattgcaagaattgtcagtgggggagaaatatcctatcctagttttactctagactcaggctctttaatcatattgttgagtgactcctgagtataaactctagcttttgaacactttgggtcatttttaatgttttgatttgttttcatcattgcttgccatttcagtatgtgtcatgtttgagtctgccaagaagcagcttttccacttagcaaacagaattgtgaaaaaaatatacatggtccactttctagggagtcttgtagcagctagtgatcaaattagagtattttttcccttaatttctgatgttaattcccacaataaatttagtttgtggaatgtcattaaagtcttacaacatgtctcccgtttcttctagagcatccctggaaagttgaagtaacaggaatatgtcaaagctataagtatttaatttgaaattttggaaaactatggcttaagatactgcatatgttttccatatgaatatgcaaattatcctattcatgaaaggctctgttgtatatcatattttacatgtacactaatctgaatgtatatgtatataccttgatgaattttttttttttttttttgagacggagtctctctgttgcccaggctggagttcagtggcatgatctcagctcactgcaacctctgcctcctgggttcaagcgatcctcctgcctcagatccccagtagctgggattacaggcatgcaccaccatgcctggctaatttttgtatttttagtaaacatggggtttcaccatgttggccagtctggtctcaaactcctgacctcagatgatccacctgccttgtcctcccaaagttctaggattacaggcatgagccactgcgcccagcctgatgaattcttattataacaatttaacttactgtaaacctgacatcttaagtaatgcatcactttgtttatataaaatatatttggtatatttcctgatgtattagtccattttcatgctgctgataaagacatacccaagactgggaagaaaaagaggtttaattggacttacagttccacgtggctggggaggcctcagaatcgtggcgggaggtgaaggggactacttagatggtggcagcaagaaaaaatgaggaagaagcaaaagcagaaacccctgataaacccattagatctcatgagacttattaactattatgagaatagcatggggaagaccaacccccatgattccattacctccccctgggtccctcccacaacacatgggaattctgcgagatacagttcaagttgagatttgggtggggacacagccaaaccatattgttctgcccctggcccctccaaatctcatgtcctcacatttcaaaaccaatcatgccttcccaacagttccccaaagtcttaactcatttcagcattaacccaaaagtccacagtccaaagtctcatttgagacaaggcaagtcccttccgcctaggagcctgtaaaaatcaaaagcaaactagttacttcctagatacaatggggatacaggtattgggtaaatacacccattccaaatgggagaatttggccaaaaacaaaggggttacagggcccatgcaagtccaaaatccagtggagcagccacattttaaagctccaaaatgatctcctttgactgcaggtctcacacccaggtcacgctgatgcaagaggtaggttcttatggtctcgggcagctcagcccctgtggctttgcagggtacagcctccctcctgcctgctttcatgggctagtattgagtgtctgcagctttcccgggcacacagtgcaagctgtcagtggatctaccattctgggttctggaagatggtggccctcttttcacagctccagtagggagtgcccctgtagggactctgtctgggggctccaaccccacatttcccttctgcactgccctagcagaggttctccatgagggccccacccctacagcaaacttctgcctgggcagctaggcatttccatacatcttatgaaatctaggcagaggttccccaacctcagttcttgacttctgtgcacccacaggctcaacaccacatggaagctgccaaggtttggggcttccaccctctgaagccacagcccaagctgtacactggccccactcagccacggtttgagtggctggggcacagggtaccaattccccaagctgcatacagcacggggaccctgggcctggcccatgaaaccactttttcctcctgggcctccaggcctatgatgggagtggctgctgtgaaggtctctgacatggcctgaagacattttatccacggtcttggggattaacgttaggctccttgctacttatgcaaatttctgcagccggcttgaattcccccgcagaaaatgggttttccttttctactgcatagtcaggctgcaatttttcaaaacttttttgctctgcttcccttataaaactgaatgcctttaacagaacccaagtcacctcttgaatgctttggtgcttagaaatttcttccaccacatactgtaaatcatctttctcaagttcaaagttccacaaatctctagggcaggggcaaaatgccaccagtctctttgctaaaacataacaagagtcacctttcttccagtccccaagtccttcatctccatctgagaccaacccagcctggaccttattgtcaatatcatcagcattttgggcaaagccattcaacaagcctctaggaagttccaaactttcccacattttcctctcttcttctgagccctccaaactcttctaacccctgcctgttacccagttccaacattgcttccacattttcgggtatcttttcagcaacaccccactgtactggtaccaatttactgtattagtttattttcacactgctgataaaggcatacccgagactgagaagaaaaagaggtttaattggacttatatttccacatggttggggaggcctcagaatcttggcgagaggtgaaaggcacttcttacatggcagcggcaagagaaaatgaggaagaagcaaaagcagaaagcccctgataaacccatgagatcttttgagacttattaactatcatgagaatagcacggggaagactggcccccattattcaagtaccttcccgtgggtcccttccacaacacatgggaattttgggagatacaattcaagctgagatttgggtggggacacagccaaatcatatcacttgacattttatttactgttttcaattagagaaaaataaaacattttctcatggataggtaacatttagaaacatgttccaaatctgtgctctaattacaactttgataattgtcctatcaatttagctgctttgatgaggctactcctggaacttattaacaggcttcttgtcaaactacaaaaaagatgcttgttttccaggaaagcaactatccgttaaatctaagaatacattaaattgttcaggtacaagtatccaggagcagagatagaacacaactttgttctatgctactaaaatagtcattttctctcactgaaggctgtgcattccctgtctaactctaaaggttgtactgtgattaaaaactcagaaagaacttttattattcacatcagagataaaaaggtggctttatgataccctctgggtaggagcttacacagttgggccaattaaatcatgttgagagagagcaactaagcaaacgtgcctatttgatttgcttgatttcccatgtttgctgtgatcagtggctttctcttttgtctgttccttggattcctgatttggctttgcctctaggcattagatgttatctttggaggcatccttctatgagcattcatttttggaccaagcctggatttacaattctattactggcccagacttcatttctatccaatttcattccactgtgctatagtttacaacatataatttgacttataaataattcctgactatgggtttaaagactgaaaatggatcaatagaaactttgaaaatgttaacatcttgattgcttttctcagtgtagaaatggacaatgtttagcttaaaaactgcatgtttttaatgagatacggggttgaaagacttattcctggaatttattgttctggagaaagcctgttgctatctgccataccttggtttactttgtgcaaaatgagcttctttttaagtaatgagctctttccatgttcagcttaaattgctgtcttagacacttcatcagggttccctgctctgcctcattcccctttttgctcacttgcagcctttgacataatcctgggaggcaattggcatcatacatattttgctttgtaatctcctgctttgattctgactgggtacccagtctgctcactttgcttctatcttaaacaggttgacacataccagaaacttagtactaagttatgtgtgttgtaagttaattgagagtcctcttcttgattaaaatataggtctttagaacagtgttttccaaaatattccacaaaacaaatttatgtacagatgtccctgccttaataatagagggttgatacatggaaaggacagaagtttggacatttaacttatcacgtttggtatagattgggtgttagttataagagattaaagacatactcaattctatagtgtaaatgcttcactatatcattaggtttttgaggtgagcaaggaaatgttcacactaaacaattatgatttaggaaggcttaaatagttattttttagaacagaatttaagtcacttttttccttttctcattattctgaaataaagtaattattgctgaataaaataactgactgcacgttatcttaacagattaattcttttaatcctcaccttaaagtaaactcaattgattctggttaaatcttcctttttttcatctgaattacaagaaacccaatggtaatgtttcttgcaatatgttttataaaaattttatttggaaagtttgaaaaatttctacacataattgaaaaggataagttgggcacagtggtgcctgcgtgtagtcccagctactcaggaagctgaggcaaggaggattgctggaggcaaggaagttgaggacagagtgtgctatgatcatgcctgtgaatagccactgcactcctgcctggacaatttagcaagactctatcttttttgaaaagaaagaaagaaagaaagagaaagaaagaaaagaaagaaagaaagaaagagaaagaaagaaggaaggaaggaaggaaagaaagaaagaaagaaatggcattagggataacagaatttaatcaaagtagtaaaatgatcattctatgggtatcaaacaaataaatgaatatcgtatacttcaaacaagtgagttaaataattgatagtctgatataaagtcagatttaacaagagtttctacatgaaaagttctataagtaggtctgaactgattaactactactaagagaattctctttgtaacaggccagcacctactgaagcctttctttcttttaatactgcaaacatgtttgctgtttaaaatagggaaaccagctacccatgaaatcatgctgccattttttcctcattagccctttggtctggtcttccttggagaagttgatgttcctcaatagatagactaacagtgcagttggagaagcagagttttactcaattaattatatttctttgcccttccgtggttggctgataacacttgttacttaagaggaatggtagtttcgccttaaggtaggagtatctcaggaaatgcaggaaactaaggcaacacaactaatattccagctgtaataacaagtccaagggttctacctctcagggaaaactgttggcacgctgccttctttacacttgcagccctttcaggcctcaggcaagtgttattctgaggtgaaggaggctgttcaggatgacgtaatttctctgtctgcctttctccatgttgctttgagccaagtctattgtgagataaaatgcctgtttcaggcagcagccatctctccaaagctttgtagcagagttagctttatttaatgtgctgttgggaaggatagggggaaaaaagagacctagcttcttaataagaacttgaagtgccattcatttaacaaatcttattgaatacatactatgtaactggccctgtgacccttatgcttttaaaatttattaggaagggagacgttgtgagagccgggaggggaactttttcttagagtgtattgttgtatttgagattactgtcttttgccagactagataattaagaataaaaagctatgtacacctctaccacttctttcagtcaggtgaaagtaatttctctctcccttcttcaaatagctctcattgaaatttggcctactttcctcaatagcaattttagatatatagtgagaaaagccgatatgtgtgctttggccattttccccatgactaatttttcttgttttatagtgctatcacccactcagagaaagtaatagcactattcattttaaacaattgcttgatacatctggatttagtcaggtgaagatccaaatcatgacagctctttggatcccagttgtctaatatatcatagaatcagagatcagcttcagtgagatggaaacagtactctcagctacaatagtgggctatcaacattttaactttctgtttcagttttcatttctcctcctgactgtgatattggcttaggtattctataattctgcttctgtctttggttacttttgctcacatgtgaaaaacataatttaatttgtgtggaatttatttcagcaaactgttatgttagttagctaagtaaaattccaacttaacaaactctgaagtttccagaatctttcattgtaacatgttaaatgataatgaatataccctctgctaattagacttggtaataaacaaagcaactgtccagccttttcttgttaatcaatcagcaaattaaaaaacctctttaaccaatctcaccactttgggaggccgaggcgggtggatcacgaggtcaggagtttgaggccagcctggccaacatggcaaaaccccgtctccactaaaaatacaaaaattagctgggcgtggtggcaggtgcctgtaatcccagctacttgggaggctgaggcaggagaatcgcttgaacccgggaggtgtaggttgcagtgagcccagatcgtgccactgcactgcagcctgggctactgagcctccatctggggcccgagtgagtggggtgttgggggagtctttctctcttttttttttcgagacggagtctcgctgtgtcgcccaggctggagtgtggtggtgcaatctcagctcactgcaacctctgcctcccgggttcaagcgattctcctaaaaaaaaaagaagtctcttgaacctagttaaagcccctactagcacttggggtgtctttgtaagaattagcaaaaagtgctccctctgcacagagcaagtaaaacaaaggctttatccaaagaggctggagttcctttggctggctgagtgggaggcgacctaggccttccctacacactgggcctggtgctcctgtgcaggccgcgaccttcgtaaccatcatggcagccctgtgcctgatacgggaaggcaggaagtagaattctgtaccacttctgagcccttcccatcttcacatttctggaggttttcttatttttttttttttttatttaatggcgttaatccactttgtcggtagttataaatgagaaggaaggccagagaattactatttgattttaggataaacaaagtggaataaccgtggtggcagttcaatgcaaggtttcccttccaatatgcaatgttaggaagcacatagcagactttttccttaaaaaaacaaaaacctggatagtaatctaaagaatcactcagaaggatttgttcattttaaagaatgtattataaaatgttattaaatgactgattctatggccaatgtacacacacacatacacgtatagaataaaacttctcgggtatgtgttatttatgattatgtattcataattataacgaagctaagtcaccattatcttttctgctttaaagtatcagaagctgctaccttgccatgaaaaagtattacatgctcctccaattccttccccaccatatttatccaacaggaaaggaatgaataataaaactttgggctttttttcccttcttttttttccaggtgatgtgttccacctcactgtccccagtaaattcaccttcgaggaggctgcaaaagagtgtgaaaaccaggatgccaggctggcaacagtgggggaactccaggcggcatggaggaacggctttgaccagtgcgattacgggtggctgtcggatgccagcgtgcgccaccctgtgactgtggccagggcccagtgtggaggtggtctacttggggtgagaaccctgtatcgttttgagaaccagacaggcttccctccccctgatagcagatttgatgcctactgctttaaacgtaagtgtttgatacctttttaaaaattacagttttaaaaaaaatgcttcgaagcatgcattgatgttcaactagccgttggagtggattccatgtcttgcagtgtgtgcacggaatggaaacagttcagtgattttcaaaagcaagcaaactgaacagcagtgatatggttaaaaccacaggaattttggcaaatggatttttagaggggtgaggaaatatcaggttaagctgtaactgtgctctgttgtgtccagagccacagagcatttttctaagtattttatattaattgcagtccttaagttttgcaatttgtttattggtgttacaatgccaaggccaactgaggctgagttaaatccttaagattgttgattttgtcttcggtatcactctgtttctttgagatggcaaagaatttaaatttcagtaattacaggtgagtatttgaagctgacatggatactcaaaatgttcaagtcataactaaaaatgaaccatactatcaataaaaatctccatttatgtcaagtaatggaaatacatgccttctaatcattaattctgtagtatcatattgacgtacaatatgtgttctttgcaacctataacagagtatctttagttaggtttactaattaacatttttttttaaataacatttctcaacattcatgatataattattttaattttccagatgtcctcaagtaattttagcagtagtagtcacatgatatagtatcatagttgtagaatgcaaattaaacaagcaagtaatctagcatctcattggaatatttactgaaccatctatactatgctagctaaacaaagatctcccagaattttggtgaccttgggtaatatccaagacagagttaggttatgttgaaacaaatttgtaaacaactttgactaaatttccaatgtatcttgttatagcaatatgtctctaaaacgagtacaaaatgtactagcttattatataattgatttctagagtgaaatacacaggcatttttaagcaaccaaaaatacacagactgtgatgttctaggtagtcagtagaatggatgttaatgcaaccaaaaggtttgttttcacacttttatctcctagctaagaagcctctgctctgatctcctcccttagactcaactttctgagtgttaaagccatgtgttctgtattagcttgccacaagctggtcgctccataaagactgtagaaaatgctggcttttgttctcaggccctgaaacaacagaattcttccttaatcattttcaggaaaacaacaatagcataaaccttatctctaaaagtagacagatgtacattcctttaagctacattgtcacaacaatgatttttcaagtacttcaggctctaaaatcagttttacattacgtgactgatataattaaggagcaaaatcagattggtatgctgtggggaaggcattggagaggttaaattagggaacgaatagaattatccagcctgacttccttatttgatattttcttgtgctttattaataaaactggcactggaaaacttttaaacaacatttttcgtctctctgtgggtaaaatttaaatcaaagcctgtctgtagccacaaagactattattaaagaattcatcctgatgtgttttaaattatttatttaattgaaaaatacacatgaaataacaaggtacttatgtttaaatagagtaaccaaaatctgcacaaaattcaaaaaatgtttaaaagtttatattcatttttatctctctaattcatttacatgtatgtaacttgtaaatataatggactcattattttgctttccttcccacctaagcatgtggctagattcttatttatttcctacttaagacgttattatattcagaattcatttagtgcgtagaaggttaaaagcatttagccatatagaagcctttcttaaaccacacataatgccaatagttttccaaaatttctaatttatttttcaaaaaattttttagtgtatatgtgtgtgtgtgtgtgtgtgtgtatttttttttttttttgaggtggagtttcgctcttgttgcccaggctggagtgcaatggtgccatctcagctcactgcaagcttcaccttccaggttcaagtgattctcctgccttctcctgcctcagccacccaagtagctgggttataggcatgcgccaccgtgcccggctaattttgtgtttttagtagagatggggtttcatcatgttggtcaggttggtctcgaactcctgacctcaggtgatccacccattttggcttcccaaagtgctgggattacaggagtgagccactgctcctggcctagtatatatttttaaagaatttgaaaaatattttcaaaatgacttaattgatgtccacctttcccacatagtcaagtagtgactaaattctgtagggtaaaattcataagagtcatggcctcagctacagttccaaagtgatttcagagatatacagctggctggttatgtagaggaatttagaaatataaccatatttttcttgtttgcttctaccaaacgtagaaagtgttttttaagtcacttggtgaataaacaatgccaaatcgtaccttgctttaattccctttgcctcacaaagtcactgactaaaacattcacaaagacagataaaagacataaaattaggctttattcttttcaaataaatttgaaaagtaagcaaagtaatgtctttgtaagataaagttttcctgtatatcttctcttaatgattaaacaattttgcatatttagttttttacttcagaatttagcaagttctgtgaaagttggagagttatacaaggctttgaaagatcatttcatacatccccaaacttaagtgaatcaaaaccattcaaaactcatgataatctctcacagaatgtgattaattatctccaggagagggagatggaacatgtttcctagaaaactcattctaatattccatgaccttcactctcagataatttttctaattaagtactttgcatttgaatttgaacccatgttttcatttttgagttggagaccaaaatctgaataacagccatttctattgttgatcacaattgtttatttatccctcagcatcttctccaactgaaacagttttcttgttttacagtttcaatctccaaatttctaattattgatatgttcttgctttgaagtttcatcattgtttagcacattcctctatttatgcttaagtttagaaatcaagatggtggtccagagaaggctaaattaattcccaccactttctatcctatcttatatactcattcactgttaaaatttgcctgcccttctaacctttggttagttcattatcttttttgtgtgtgccctagttcataatctgaccacatgtgccaaaactaacctttccccgattggtatattacaaatgtttcctgtttattgaatttgaatttgttagcattccatcactcatataactttaaaaagatagtttgaattggccgggcgcggtcgctcacgcctgtaatcccagcattttgggaggccaaggtgggcggatcatgaggtcaggagatcgagaccatcctggctaacacggtgaaaccccatctctactaaaaatacaaaaaattagccgggcatggtggcgggcgcctgtagtcccagtccctaacccaaaccctaaccctaaccctaaccctatccctagcctgtagtcccagtcgggaggctgaggcaggagaatggcgtgaacctgggaggtggagcttgcagtgagacaagattgtgccactgcactccagcctggactacagagcaagactctgtctcaaaaaaaaaaattatatatatagagtttgaattgtaatttcactgctccaatctttacagttttataaccatgtttacatttagttatgtataacaaatttaatatagaagaaccaagttaaaattagtcatttctcaataatgtagagagcatgggaataagttaaattgactatcatgctgctaatgggggttttaagttttattaggaaaatctgtctcatgtctcgcaacagaagcagagaagatggcccataggacaaaaatgccataagtacagtgatgtgaaacatctgtgggcagacagctgcaaaggttggaaaggaacttttgtgggaaaagaatcgtgttgatttatgttggcttcctcaataataaagttgaaggaatactggtagttttccagagccaaaacttctccatgtgaatgcacctattggaaggacactgttagaataatctggaattgtttttacctttacaatagtcatcagaatacagtggtatttattcttaaaatatctcttcgtagatattgtgctttataaaattatttccttttgtggaatggttgaaacaaatggcacaaatcctcagatacactgacttgtgatcaaaatcagctgttaagttgatgaaaaagccacccaaactgaaaaggaagtctgaggttttccattccaagtagtagaattaattaacttaattataagcagaccttttcttttttaaaatagggctctaaaattattgaaaacccttgtttttggaaacaaagtcacataaatactggctttctagaacagattctctaggacatattgctaccactttattacacagcaggactagaggaaggaatgcaacagcaaactccatagtaataattgacaatgaaatctagttatttagttttaaaaatatgagtcaacttttaaaacactataaacatattttcatagcattgtagaaagttgctagcagagagcttggattggaacataggaagcctggattcacagcccctttggccctaatgcaattgtacctgtttctaagttaatttcatcagccaaggaaatactcagagggaaaaagtaaatttagcttttttgttgttattaataataatatgattaaattttctctaatatgctgtttgctaagtatttatattatgtttccatgggaactttttctgtatgtatctttttactatttccccaaagaatgcagttataagacaaacatgaaatttggcagttaaatgaagtaatggttatggaatttcagaggatagagaattgaattaaaatagtcatccacattttgggtttttaagttgttcatgtcaatcaaaatagaacaacgcttcttccaggaaatgaatgtagaaaaagcttttctttaaaaaggggaggaaaaggttatttaatgtttttaaactccaactcttttttggttagttttgttttaatattagaaagataaataatgacagactttaaagaatatttaaatgtatcataatgtaaatagccctcaaatgttcatgataaaatcagtgaagctgagctttaaaatggtctggggaatgaccacaactaataacagctcgtgccagacaaaaaataaggaacctgttacagccctagtctgatttacaataaaatcacatcattttatgattaagtttttacagagcaaatggagctaaaaggtagcctgttttgttttttgagggctcctgttctggaattattaaaaataaaaaagaagatactatagatactatggctattacacctcttttcagggcaaacaagcatttactcataaaactagctttaagtcctataggatgtagcaaaacaataactacaggtttcttcaggacagttcttttgagttcagtggcaactattaataggtttttatttttaaaaatactgatttttattttaaaaaaacaatcattatatagtaggctgctgccttttccctgtgttgagaaagaatcttgtttacaaactgttgcttttatacacaatttaaatttctttcaacaggccaggccattctctgtaaatctggagccattataatgcagcattttatgatgacaggttactttatattgcctgagcctgttctttctgatgcttagggttgttcccagtgatttgtaattacagacctaaaatacattatgtgggtactttacttcctgttctacatttgtgtttcaggctaaagtaagcctggaaacaagatccttaggagatacaaacagagtgtgtagaacatagaacaaaatgtagaactacaacaaatgccgactagcctctgccaggcacattttataatttattagaaacaaatctacaccatgaagttgaaagaaggatgaagacaaatgtccaacacctgggatcaagtgaagagtggtattaaaaagttttaatatcctgtttttatgaaagtctccacattatggacaatgtaatggtttatatgtaacttggatacatttcatgtggcttttttgttgttttgcaatctgagacacaccctctcccctgagataatatgcagcaacttgaaaagaagggagcatgtggagaaagctggagacagggtacagaagcctccagaagaatagtactaaattctcctgcgaggcttcaagttgacgctgtagtttctggtaaataaacaatctactgtatctaaaatctgcatttatatttttgggagcttttccttatcttaaaactacataatattaattttcctcaactggtaacagtcatgcatacttttaggtaaaagcagtgataacccttataacgtaaaacaactgatcaatttatgactattaagtgttcaattatctgtccttgggttaattcaagtatagttttaagactcctctccatcacagaacatttctgggccacccaaaaatactccctacaaaatactcaggagcacttaacaaacactgggcatacaagtttttattagtgacttgtctaatcaactctttgaaattatttttctagctaaagaggctacaaccatcgatttgagtatcctcgcagaaactgcatcacccagtttatccaaagaaccacaaatggtttctgatagaactacaccaatcatccctttagttgatgaattacctgtcattccaacagagttccctcccgtgggaaatattgtcagttttgaacagaaagccacagtccaacctcaggctatcacagatagtttagccaccaaattacccacacctactggcagtaccaagaagccctgggatatggatgactactcaccttctgcttcaggacctcttggaaagctagacatatcagaaattaaggaagaagtgctccagagtacaactggcgtctctcattatgctacggattcatgggatggtgtcgtggaagataaacaaacacaagaatcggttacacagattgaacaaatagaagtgggtcctttggtaacatctatggaaatcttaaagcacattccttccaaggaattccctgtaactgaaacaccattggtaactgcaagaatgatcctggaatccaaaactgaaaagaaaatggtaagcactgtttctgaattggtaaccacaggtcactatggattcaccttgggagaagaggatgatgaagacagaacacttacagttggatctgatgagagcaccttgatctttgaccaaattcctgaagtcattacggtgtcaaagacttcagaagacaccatccacactcatttagaagacttggagtcagtctcagcatccacaactgtttcccctttaattatgcctgataataatggatcatccatggatgactgggaagagagacaaactagtggtaggataacggaagagtttcttggcaaatatctgtctactacaccttttccatcacagcatcgtacagaaatagaattgtttccttattctggtgataaaatattagtagagggaatttccacagttatttatccttctctacaaacagaaatgacacatagaagagaaagaacagaaacactaataccagagatgagaacagatacttatacagatgaaatacaagaagagatcactaaaagtccatttatgggaaaaacagaagaagaagtcttctctgggatgaaactctctacatctctctcagagccaattcatgttacagagtcttctgtggaaatgaccaagtcttttgatttcccaacattgataacaaagttaagtgcagagccaacagaagtaagagatatggaggaagactttacagcaactccaggtactacaaaatatgatgaaaatattacaacagtgcttttggcccatggtactttaagtgttgaagcagccactgtatcaaaatggtcatgggatgaagataatacaacatccaagcctttagagtctacagaaccttcagcctcttcaaaattgccccctgccttactcacaactgtggggatgaatggaaaggataaagacatcccaagtttcactgaagatggagcagatgaatttactcttattccagatagtactcaaaagcagttagaggaggttactgatgaagacatagcagcccatggaaaattcacaattagatttcagccaactacatcaactggtattgcagaaaagtcaactttgagagattctacaactgaagaaaaagttccacctatcacaagcactgaaggccaagtttatgcaaccatggaaggaagtgctttgggtgaagtagaagatgtggacctctctaagccagtatctactgttccccaatttgcacacacttcagaggtggaaggattagcatttgttagttatagtagcacccaagagcctactacttatgtagactcttcccataccattcctctttctgtaattcccaagacagactggggagtgttagtaccttctgttccatcagaagatgaagttctaggtgaaccctctcaagacatacttgtcattgatcagactcgccttgaagcgactatttctccagaaactatgagaacaacaaaaatcacagagggaacaactcaggaagaattcccttggaaagaacagactgcagagaaaccagttcctgctctcagttctacagcttggactcccaaggaggcagtaacaccactggatgaacaagagggcgatggatcagcatatacagtctctgaagatgaattgttgacaggttctgagagggtcccagttttagaaacaactccagttggaaaaattgatcacagtgtgtcttatccaccaggtgctgtaactgagcacaaagtgaaaacagatgaagtggtaacactaacaccacgcattgggccaaaagtatctttaagtccagggcctgaacaaaaatatgaaacagaaggtagtagtacaacaggatttacatcatctttgagtccttttagtacccacattacccagcttatggaagaaaccactactgagaaaacatccctagaggatattgatttaggctcaggattatttgaaaagcccaaagccacagaactcatagaattttcaacaatcaaagtcacagttccaagtgatattaccactgccttcagttcagtagacagacttcacacaacttcagcattcaagccatcttccgcgatcactaagaaaccacctctcatcgacagggaacctggtgaagaaacaaccagtgacatggtaatcattggagaatcaacatctcatgttcctcccactacccttgaagatattgtagccaaggaaacagaaaccgatattgatagagagtatttcacgacttcaagtcctcctgctacacagccaacaagaccacccactgtggaagacaaagaggcctttggacctcaggcgctttctacgccacagcccccagcaagcacaaaatttcaccctgacattaatgtttatattattgaggtcagagaaaataagacaggtaagtctttgctttctagactagcattgaaggcaatcctcattttatcttgaaagttacttttggggaaaaaaagtcaacataccaaatgctgctattagaagataactggagtgtgaaaaataaatgttttagcttcatatatttgtacaagaattggaagaatatgttaaacaatgtggaagaatgttagatacaattttatgttaaaagtcataagaagccctgctttgtcatctaatataaccaaatcatcactgttacatcacttcaaaacatgcagaacaaagtgttttaatttcagtgtcttttcatacattactactcaagtgtagcactagactgtgttaacattccattggtctttaactattaaccttcagtacttacaatgtggacggctaaaatcgttttgcatatccctaaggttgacagaaagatatttaaaggtttgctttggtttttctcttccaggattttacaggtttattatatgacttgtgtggtgggtaataggtctctaatgtaagtgttattttaatgtaaatgcaacatattcttatgctattgttttggggtattttactgtggttttatctatttagagcaagtacaacctagcttagttgtagggagtattacagtttattgtattaaatataatttcagaaggtggctatatattcattatccttgcttcctaaaaaccaggctgtagtgttgttcattttatgatttaattgttttaccgctaggaatatttgtgatgccttctattccactcaaatattttagctctctgacagaactcttaaaagctgtttgtttacattgattaatacttggagttgtcatgatcaaatacgatttattgctgtctaaaggtgagcccacaccatcttttacatttgataagctgagttgagaatatatagcaaatgcagttcaataaatcaattcaggtttgtctctttctagtttagaaattacgatcatggattttagttaatttgctatattttcattttcatataagaattaaatgaatgagtattcgttgttttcttgacctggctctgagaagacaggatagaagatttttttttttttttttaagcagggttctctcttactgttggaatattccctttcgagtatcatttttctgaagactgatgctatcctcattagagtgctcaggagtgcacctattggaaacaaacaagtagcgttattgtcaagtatgtttgcatgtagtgctgttggtggacacttcatggcttctataggtttctactctccagaattttctgtgtgaaagcttttgcttgtcagtgaatagtagagaagagaacacacccacagagtattaaaattaacctccacttcccaatgcagtttaaaaaggacaggatttgatcatgattttcttgctaatgatattgtttcttggaaatcataacatatttcctcttttctacatccttttccatctctcggaactggtgtaggaaaaagaaaatgaattgccagtaagtcggaatgaggattgcgttaggctggaaaagagacaggaatataacggtgaaagaaaaacaaaaaagaggtaaaaggaagcaaaaagtaaatgactaccaacacttagtttcataatttaaaaaaatgcttgaatggatatgcagattgtttttcaattgatactactctgttagtgtagctaataagttgagttgaataatataaaacccagtaaaaatgttctgcatttaaaaactcttccaagtgggaaactgccagttaggaagtcaaattacaaaatggaaaaagtgaaacttgatctctctgaaagaattggcagtcatcaaaaaaaaagaactaagttataaatggttgctggaagtggagggtctgagtaagctaaacctgaaacaatttatacaaaggtgtacatttataagtgagttgtggacttgattcagctagacctgggagacgtatataggtgtttcttctccttctgcttctaaaatgtgagactataatccaccttgaaattaattttgttttgcataataatattaggtcagaaaaccgtgcaatacttggttacttccatcaggcagaattctaatgtgagagtgtgtatatgtgtgtacaacaaggggatgtatctgtggaataattatgtatctacctacctacctaccttcctacctacctacctgcgtacctacctacctacctacctacctacctacctacctacctacctacctgtcatcatctgtatttttgtgtgttctgtatatgctgttctccttaactaaaagcattgtttattgtcttcataagacaatgaagtttactcacctctaactgctcacctatactaatattatttattttctatgagaaattttatcctccaacattttgagctttggcaagggaaaatcctaaagcagatgttcaattaatgaatttcaaggcaggtgtataccttaataaggaaaagtgcatatgtgcctggagaaccaacctttttatgtatcaaggcacaattttccagactggaaagtccttggtgcatgtgtgaacttgtataaatctattcacaggaatagaatacacctttatatatactgtatatccaagtaagcaaaaataccacccatgctattctaaaccaaggcattcaataattttttgctgcactcagcgagtcatataaatcttgtttttttttttttttttactactatgaaacaaaacatgctactcaggacacacttatgttatacttgctcaaatggatcttaatagcaacttacggtgctctagctagagggcaactgtagttagcagttaaaaaaatctgaaagaacttttcagctcataaaagttttatgagctgaaaaatgctatggggtgtgtttaacagtggttcaggggatactgaaaactttactcctgtctatttcaggagtaatttgcacacctgcattttgaaaaattattgaaaggctttctttgtgaacatgcatgaaggccagaatttgaagctgtaggaagagtttcttcaactccagattttttttaaaagagcactcctctaaatcacctgaaatgttacaaggtagtggaacagaactgtgaatgtttttaaaaactgacaaacaggtatttttaaatcaaagaataatttagaaatgtatggatattaaataccaacattattatgcaaatgctcttagttataaccttaaaataggcagcttattaccttttttaacaaacaaattcatatatactacttattatgtgtcaggcctgcttgatgctgtcttgttaggtgttctttttcctactggttttgtaatttgtatctacccaaatgtatgtgtgcaggtgaaaagcaatattaaattaaatgatagaaagattaagatgttggtaaaattattaatgtaatgctattaaagattaattacattttgagaaatatacaaaaagctaaaggcttattgtctaaatatggtgttatggagaggataaagaacaaggaacattggctctgagggcaggagccatctgggcagatacccatatttacatcattgattgcagagtcatcacttttttttttttgcgacggagtcttgctctgttgcccaggctggagtacagtggagtgatctcggctcactgcaatctctgcctcctgggttcaagcgattctcctgcctcagcctcccgagtagctgggattacaggcgcctgccaccatgcctggcgaatttttgtatttttagtagagacagggtttcaccatcttggccaggctgggcttgaactcctgacctcatgatccacctgccacggcctcccaaagtgttgggattacaggcatgagccactgcgcccagccaagtcatcactttttaaaaggtaatgtttatttaagataatctcatataattttttaaaatcacacattttctgttcttacagaattttaaagaacattttaattatagaaaaattactttctgatttgttattataagatccaggtcctttcttcaaacaaaatgttattgagagcccctgtatcttgaacagacaaaagagtagctgtgttggttaatgtttgagggggacatcgagaacctcactcccttgggacctcctcatctcctgtggtggtttttaaaataacatgtacctcacaacacagctagaaaaagaatgatatctagaccattcaaaataaagcaaaaacagttactcattcctgagagaattaagttcttaaaagtaaaaatgtttcaaaaattggtctgattatctatatctttatctcattacaatgatacacatttaacatttacctttgaatagcactatgcatggtgctgaataaaacacattaaacaaatattgtttcaatcttattgatgcctatgtgtcatcaagataatatataatggtatgtcagagtctcacatgtatgtgcaaaactaagtcatcatcaaactcacacttcgggcttcatactttcagaccactttttctatatattatcatgtttaaacttcaaagataatttgtgagacaactagggaaagcagatagtcaaacgaaggtacactgagtctgacattcttggcattgggtctagcagccctggccctctttggagcatttttgccatgaagtgattctctctcctgatgagctctgagaaaacaacaaccccctgcccaatggcttaggtactgccctgtctgtcaattcctgaaagagcaaactctgggaagactggtttctcattggcattctagtggtttgttaagagtatataatttagatttggttgctgctaatatggggcagtatgcatgctcttcagatacctgacatagcaaggaaagagtgtgctgaaattggtagtacgttattctgcagttctgggcagcttctttcctgtagagttttggagcacatctctgaaagtggatgggtctggtgcctgcacacctccgtggttccttttcctgagctccagctgtggctgtctgtcagagaagcacatttttctgcagataattagaatggcttcccccatctctcacggactgtcccaagtctagaaaagaattgagttcctcttctattagtcaaataaaagggaagagaatgtttgtcttcctttcctttctgtagtgttaagaaaataaacgaacttaatgattctaaattatcagtgagcttaacactgtactatagaccaaagattaccttttcaaaaagtcctttgaggtgaaatattttgtatacgtaatacatagatgcacatataaacacacacatatagaatctcaatattttaacacttctttgggtagttgtactaactcactaaccctgaggaaaaagttaagaaattgaaagtgttttcttcaaaagttgagatttaacaataaaaggtgttactttgataactaaaaggaactttattatcctcttcctaaaataaaccaatgcctattctgaaaatggcacttgcaattacaatttgccattatcaaagctaccactgaggtagaggcattatctaaaacaaataccacttatcatttattggcagttacctcgagagagacccatacaccatcttctagcagagcacagtcaatcaaattaccttcgggtaaagctatagcatgtctagtcgtttgacagatattaaaggtggtcataaaagaaacataaaccataggctgtgctccaaaggcatattggccagctaacattaacacaatcaaatacagttgtcatactaaacatatagttacacagtaggtgtatggtgtgacagattgtgaatggtaggtgaggtcagaaaaagaaggaatcaagaaaggcaggaagttacagaatatttcatgagaaagaggagacttacgtcagtctctgttggagggatagattacaatccaattatgagaggccagttattagccaattgcttcccaacttaggctcaccagtggggttaaggagccccaagtataaacagctgtttttctaaatagagtttctaaacagcttctgaaggaggccatgtcatcccagtgctgtttgacatggcctgcttcagaagctgaataccttcttaggcctcacgcagaaactagtacagttcatgaaaacccgagatactctgccagcttcttgaggaagcagtgttgtcacacttttctgagcttcagtgattcacacattttgataagacagcatgttctgtgggttaagtacatttaccttttcaaaatatactcccatgaagtatcatggttcagaattacacacttacaaagttaaatggcataaaactactttgtaaaaagtgcctacactctaaaaggtgatttaaaggtttatgacatcttaattcaagtgaatactgaatcagtaggattatagagcaggtgctctaagttagggaatctggagtcagtctctcctttgcttatgtgcaatgtggacccagggatttctcaatttctctgtcagaatttttaacatggtaaaatggctattattatatggaatgatatttcctaagctctgacacatactctttctccaaatcacagggtttatgaaacaaagatacacacacacacacacacacacacacacacacacacatatatgtatacacacatatatacaggtaatatacagatatattttttctaatttattcaacagtcaaataattacaatatactaactacattagaactggatttttttgaagtacattctggttaatattctgaaccaacatggagatgtagttagtttgctttgtaggatacatggaagaggcagttattgtgatagaaagagcctttggaaagagacctgggttcactgtcaacattgttacaggaggcactctgtatccacaattctgcatcctctgatttgaccaaacatggataaagaatatttgaaaaaaaaaaaaaaagcaccacaataaaaaagaacaatacagcaataaaaaataacacaaataaaaacccaacacactataataactatatagcatttacattgtattagttattataagtaatttaaatgattacttataatacctgatttaaagtatatgtatatgaatgtatgcgtaggattcctgcaaatactatgccattctataaaaaaggacttgagtaccatggatttttgtatcctcctagaaccaatcccccatggctactgagggataactatatttacagtctgtttggtcttgtataaattacttaacctccacaggcctcagttgttatataattaaaaatttataataatactacaacctcaccacattggttaaagaaggggatctttgagtgattgccacatgcaagtcactgtgacaggcatttcacatatttaatactccttcagtgactagaaagcaccaagcacaatgcctgatacatagtaatgacttagtacaaattaatctcctgtgggctttaaaaattatttcatttccaacttctaagtacaggaaaatatagactgttttgttctaaataggtaaaagccaaatgatcttaaaattcaagatcatttatgccacaagaagccaagtataattgtactttagtgtctgcttaactgaaataacttcttaaaaatccgaacccgacataggttgtgtttttttgggtggtgccattttgggtgcaaatcagaagcagctgcagcccttacttaaaatttaaatatagtattggctctataggacctaagagtagaatttattagctttttgcttttcctcagttgtgaaagttgggcttatgattttgataactaccaatttaatttttttctcataaacatcattttacaaattcttgatacatttccccaggtattgagcctagcttcttgcatatttatagaatgaatggacattccctgctgtctttttgttgttgtcaaggaaacccccagttctctacacagggattacattcttctttcttaatagctcttagatcgttcatttgtgcaatgaataaaaaatgtactcacaggtccagacagtgttcagaacttttttggtgggtgaggggcgtagctaaggggagagacatgcctagtgagaggagcaataggaataaaagaaaaggagaaagaaatgctggctgaggttccattttaatgaggtaaagctgaaaaatttatgctttaaaaaagacattgcctatttttgtcactttagaaaatgtataacattacttttcattgaggtcagtgtttcatgtacaaaaatgttagtttttaagtggctttgttaagcgaatagctccaagaatggggcccaggttggtgagggtgggatggatgagggagtggtgatgcgttttagtagaaactattttttcatttctatagaagtatttgaactttttttacaacctaattgaggtgatacaaaatataagaatattccttcatcctggggcatcatgtggtcatctgagagctcatttgattacattaaaaatcgtgttccttagagagagagtgccagtatttagactttttgagtgtgaatcaggagggaaacacacatccattgacaagaagatggatataattatttttaaaaagagtgatttgatcctttggaggaaaataaattctggtggaccttctaagtaactgctagaatgattgggtaatgtatacagcttttgcttctccataaataatgtaagtattaaaaaggagattttaaactagaaggaaggaatctctggagtgagaggaaaagtttaattgtatttcagtatctatgtctatgaaaagttgatatacggtgtcactgtggtatacccaaacttgtttatacacatgtataaccagtacacagtaagtaccatgagtggcttttagtgattttatctttttaccttgtagtacagtctccctggtgtctcacaaggctagtttacttactttggccatatgcttcacatagtaggtttctggaggttttgttttttctaagatgagagagtgaaaaggtaatgtatatttctggagagtatattggaatatagtataatcatcattttcactatgctgcacttcgggacggctgtctattgtattttttaaataggaaaacaaaatctttttgttacacattaaaataaaatccattttaaaaaagaaatgtgatcctaatatatctctgctgagtagattggtgtacatttacgtttaattaaaagctcttaaacttaaattgtaaaattccccaaagagaacgtgaactttaaccagctgcctatgcatcttagcaactatgttttgtgtctggtaacagtatgactggaagacttgtgctctgtctacaaaactttgttatgaagtacttaaaaatacttgtgaataatttgaggtcagctagcaataaagctttgtgtgaaatgtcattaaaaaaagcctattaaccatggtactgttatattcaagtcaagctgttaaaatacattcatataaacatagaaaagattatgcatacaccctgtagagttctgtggtttgattcttgaaatccaaacaaaagttatattgccttttgagtaaaattctagaatagagcagtcttttataagactaagagcttcatctaagagcttgaaatgtcaattacaccattgggttgctctgttcctatgaaatagagcacatctccatttcggaatgagatacctcctctcacagtagcacaggtgtaccccccaacccccttactatacaccgcaaagaaacttttctggtttgcaataatctctgttgagattctctaataacgtgtgtggtgggtggaggtggtgacaggaaatggggatgaagaggtaatttcagaggaagaataaactaagagggggcaagtaggatttggtgagatgcaaggagttagtgacaaatatttgggtgatagggcagggaaaaatttatctgcatatattaatagtagataggttttataccccacctctccctgctatgagatgttaaaagtatgggaagaaattatactgacagaataaaatttagattgtatgtataggaaatgtcagcagaaaattttaacttgaaagccctgggtaattaacatttctctctccttcaaactgatattaagaaatccagccaggtgcagcggtacacactgtaatcccagcactttgggaggctgaggcaggaggattgctcaaactcaagagtttgaggctgcctgtaatggtacccctgcactctagcctgggtaacagatcaacaacctgtctaaaaaaaaattcaataaaaccatttgcaagttgtcgcgaacttatttaaagaataataatagttgcttaattgtgagactattactttcagaaaaaggaaacaaaataatttcaactcccattttgcatattttttgaaattaaagaattcccatttagtagacaattttttttctggggatctaatatacaaaattaagactgtagttaataaaattgcattgtattagagattttgttaaaaaagtaaatttcagttgctcttctcacaaaaagatggtatatatgttaatctgcttccttttaccatctatatgcatcccataacatcatattgtaaacctcaaatacacaatagagtttattttagaaaaagaaaatttctatcatacttattaaatgagcatattattttatttatatgtagattttcttctcaattacttaatttattttgatgtgctgccagcttcatgatgagaaacataagatgaaactgcataatacatttctgttttctatcattttgaaggcaagtcagatcaaatagttgcgaggtgggtggagaaaggaatcctaatctaaatttaatgattagtacatttgcaataagtacattccaaaagtttcccattaaaataggagaaaagagtttagtaaggccagttctctaacttactggcaggaacatttgtttcagagagagagagaggaagggggcaaggagagacttggaaagtatagttaggtctctctgaagttgacaagagagtgtttgccctagggtctgatacataacaggtactcagtaaattttgagaaatcaatgagcatctgaagagatattacattctgggcagcatgcatggttgtggtggtagtgaatttaattttgtgtgcaaaaaccgatatgaagcaatgctgtgtttgtgaaatgtatgcaaagattctgtctctgaaatgcttatactgctgtgattgaaacattatcatatttatttaggttagaaaatggaatttactacatctgagttggtttttggtgagaaattctgatatgatagtctaaaatggcaaggaagtccttatagatctatgagcaattggaagtgttagagttcttgatctgagagaaatatgacctaaaagaatattatactttgttaattggagctaaaatcagaaactataaagtgaatgccatggtctttagtagaattaagtattcttaatatgagttgatagttagctaaattattatacagtactgatttacaattagagttcttctttattttctttcccagaggaaaacaaaaaatttcagtgagcattatgaccatccatcagtttcttaccatattgacatgtgacatgttggcatacctttgtgtcttctttctctgcttttctccaccccactttttttagagccaccaacatacttgacagaacttccatctgtaattactcaataagaagatcatgagatatgtttgtatcagtcttatttttttgaagtaaagaatttacttagaaattcaagtaaatctataatagcaatgagtgttcttaccctattcttggcctaggagtttgtaaatatacaatattaatcagatatttccttatttatccttgtgttttgctggagaaacccagctgaatggctcgttttaacttcattatttacaaaagggtacaaaatatggtagaggttctttatatgcttgacactgacccatgtttcttatttaaaatcttttctctgtacttaaatgaaagttttggtgtcaccaaacagggtaagtaagaatttagtgtacctttgtctaatatttcttaatcatgaattctagttttatttaagttaatgaagcaaaataaaagagttgcttgcatgtaaaatggtagtgtgagcagtttaagatatgcacatttttaaactccagttaaatcccatgaagttgtactgaatagtttaactgagtctggcttaattcaactatattcaaatagttttagcaatgagagactcctggcttggataaaattattgatgtgaatatttcaagagattcttttgtacagaaggcattttaaatgcttctgctcatatagtttaaacattttcttcacattctgttttcatagcacaaagtttaccttcaatgcaaactgaattaagaggatgttatcatctgaatattttatggtgtcctattttaaaacatatacaccatgggtactatatataagatccgagtaacaactttagtgacctaatattgaagaaacctagtctttttagttacctatatttttaaatgacaaggcatttaatcattttcctgcactgagcaattagtaacaattgcaacatctgtgtcagaaataatctgtattcattttatgtttttataacacactagagttatgtatttatctcgcttctctttgtggtagaaatattttctcatttatttgaatacccatatgctgtagtttaagtagttgaaaagctgaatatacagaatggaatggaatggagagagaagaaatgaactgtagtgtgtaaaatttcaataggaagggtgtttagttaggataagaataacccagtcctacacagaagtattttagtgaaataatttagtgaagatgtggtgggatacaaaagagagttttctttcttgtttctattagaataaaagggataaatgtatatgtctttgcattacataaaagtcttattgtctgggttttttaatttaaaaaaaattcaaggagcttctgtggaatttgtcttggtagttcctacacttctatatttgtcttgattcataaaatagattagaatataagcaacactgattcctcttcaatagggttttttcttctctgatgaaacagcaaaagctagatattgtttcttctatacatagaaggaaatagcttcttgcaacaggaacaattcaggagaaaacagttgttttctcccctttagatgataggttgggaagcagggttggctccgtcataatgatttctcctaaacacttctcaggtttggcctatgcatgtgtgttatagattggggatagtttgaaaactcattctgtagtattattcctatgggcagggtggtgagtagtgtgtaaattctttgtcttctttatgggtcagtatatccacaggcacattttcatactgctttgtcactgaaagtaaggcagctgcagtggcaggaccctgttctaggacagttgaatgcctctatgatgagacctcagaatttcctctttcctagtgcccaagacaaggagctttgctgatgtatttctgatagcagaaaaggccattgagcttagtggttggtaccatatggcaatttacaatctgggaaatattctgatgatacatacttttcgaggaatgctagttagaatatttagataggactcctgaactttctttgagaagatgttgatgacaagaactaaaatcagcctaatctgggtcacatcccaggaaggataaaggtctataggtgtggaaggctctttctggtcctttcagtgagctatttccaatagagcccgcctatccagagcttcccactcttgtgcataggatgtggttaagctcatgtctcagtgccacagtaggtagaggatgccattgcaatgtaaaagggctataaataaagctctcttgtttttccataaaacagtctgctctagaacagattataaaggggccagaaggaatctcttctcattttcttattgaatagagagtgtataaattattcccttacataaaggacaattactttttctatatagatcatatatagaaatagagctatagaaaaagtaattaattctatatgatatggcctcaatttttaatttttaaattgtttttatatgaaatagtcttaattttactctttttgcagttcacacaaagatgaattcctgcacttcaagattacattgtatatgtgattccttgcttcattttaaggactatgttgttttcttaaatgtgttgatgagtctttataacctgttttaataatgttaaattgaattcatttttcttattgttaatacaaaaacagtaaatttgaagactgagaaccatataagagggtgattgcacttattatgaaaagatttgaatccttctttgtgtgtgtgggtgtgaccagccttgctatcaatttcttctgtcatacactgccaaattttctatttaagtattgtgaaaactctgtttttttcaggtcgaatgagtgatttgagtgtaattggtcatccaatagattcagaatctaaagaagatgaaccttgtagtgaagaaacagatccagtgcatgatctaatggctgaaattttacctgaattccctgacataattgaaatagacctataccacagtgaagaaaatgaagaagaagaagaagagtgtgcaaatgctactgatgtgacaaccaccccatctgtgcagtacataaatgggaagcatctcgttaccactgtgcccaaggacccagaagctgcagaagctaggcgtggccagtttgaaagtgttgcaccttctcagaatttctcggacagctctgaaagtgatactcatccatttgtaatagccaaaacggaattgtctactgctgtgcaacctaatgaatctacagaaacaactgagtctcttgaagttacatggaagcctgagacttaccctgaaacatcagaacatttttcaggtggtgagcctgatgttttccccacagtcccattccatgaggaatttgaaagtggaacagccaaaaaaggggcagaatcagtcacagagagagatactgaagttggtcatcaggcacatgaacatactgaacctgtatctctgtttcctgaagagtcttcaggagagattgccattgaccaagaatctcagaaaatagcctttgcaagggctacagaagtaacatttggtgaagaggtagaaaaaagtacttctgtcacatacactcccactatagttccaagttctgcatcagcatatgtttcagaggaagaagcagttaccctaataggaaatccttggccagatgacctgttgtctaccaaagaaagctgggtagaagcaactcctagacaagttgtagagctctcagggagttcttcgattccaattacagaaggctctggagaagcagaagaagatgaagatacaatgttcaccatggtaactgatttatcacagagaaatactactgatacactcattactttagacactagcaggataatcacagaaagcttttttgaggttcctgcaaccaccatttatccagtttctgaacaaccttctgcaaaagtggtgcctaccaagtttgtaagtgaaacagacacttctgagtggatttccagtaccactgttgaggaaaagaaaaggaaggaggaggagggaactacaggtacggcttctacatttgaggtatattcatctacacagagatcggatcaattaattttaccctttgaattagaaagtccaaatgtagctacatctagtgattcaggtaccaggaaaagttttatgtccttgacaacaccaacacagtctgaaagggaaatgacagattctactcctgtctttacagaaacaaatacattagaaaatttgggggcacagaccactgagcacagcagtatccatcaacctggggttcaggaagggctgaccactctcccacgtagtcctgcctctgtctttatggagcagggctctggagaagctgctgccgacccagaaaccaccactgtttcttcattttcattaaacgtagagtatgcaattcaagccgaaaaggaagtagctggcactttgtctccgcatgtggaaactacattctccactgagccaacaggactggttttgagtacagtaatggacagagtagttgctgaaaatataacccaaacatccagggaaatagtgatttcagagcgattaggagaaccaaattatggggcagaaataaggggcttttccacaggttttcctttggaggaagatttcagtggtgactttagagaatactcaacagtgtctcatcccatagcaaaagaagaaacggtaatgatggaaggctctggagatgcagcatttagggacacccagacttcaccatctacagtacctacttcagttcacatcagtcacatatctgactcagaaggacccagtagcaccatggtcagcacttcagccttcccctgggaagagtttacatcctcagctgagggctcaggtgagcaactggtcacagtcagcagctctgttgttccagtgcttcccagtgctgtgcaaaagttttctggtacagcttcctccattatcgacgaaggattgggagaagtgggtactgtcaatgaaattgatagaagatccaccattttaccaacagcagaagtggaaggtacgaaagctccagtagagaaggaggaagtaaaggtcagtggcacagtttcaacaaactttccccaaactatagagccagccaaattatggtctaggcaagaagtcaaccctgtaagacaagaaattgaaagtgaaacaacatcagaggaacaaattcaagaagaaaagtcatttgaatcccctcaaaactctcctgcaacagaacaaacaatctttgattcacagacatttactgaaactgaactcaaaaccacagattattctgtactaacaacaaagaaaacttacagtgatgataaagaaatgaaggaggaagacacttctttagttaacatgtctactccagatccagatgcaaatggcttggaatcttacacaactctccctgaagctactgaaaagtcacattttttcttagctactgcattagtaactgaatctataccagctgaacatgtagtcacagattcaccaatcaaaaaggaagaaagtacaaaacattttccgaaaggcatgagaccaacaattcaagagtcagatactgagctcttattctctggactgggatcaggagaagaagttttacctactctaccaacagagtcagtgaattttactgaagtggaacaaatcaataacacattatatccccacacttctcaagtggaaagtacctcaagtgacaaaattgaagactttaacagaatggaaaatgtggcaaaagaagttggaccactcgtatctcaaacagacatctttgaaggtagtgggtcagtaaccagcacaacattaatagaaattttaagtgacactggagcagaaggacccacggtggcacctctccctttctccacggacatcggacatcctcaaaatcagactgtcaggtgggcagaagaaatccagactagtagaccacaaaccataactgaacaagactctaacaagaattcttcaacagcagaaattaacgaaacaacaacctcatctactgattttctggctagagcttatggttttgaaatggccaaagaatttgttacatcagcaccaaaaccatctgacttgtattatgaaccttctggagaaggatctggagaagtggatattgttgattcatttcacacttctgcaactactcaggcaaccagacaagaaagcagcaccacatttgtttctgatgggtccctggaaaaacatcctgaggtgccaagcgctaaagctgttactgctgatggattcccaacagtttcagtgatgctgcctcttcattcagagcagaacaaaagctcccctgatccaactagcacactgtcaaatacagtgtcatatgagaggtccacagacggtagtttccaagaccgtttcagggaattcgaggattccaccttaaaacctaacagaaaaaaacccactgaaaatattatcatagacctggacaaagaggacaaggatttaatattgacaattacagagagtaccatccttgaaattctacctgagctgacatcggataaaaatactatcatagatattgatcatactaaacctgtgtatgaagacattcttggaatgcaaacagatatagatacagaggtaccatcagaaccacatgacagtaatgatgaaagtaatgatgacagcactcaagttcaagagatctatgaggcagctgtcaacctttctttaactgaggaaacatttgagggctctgctgatgttctggctagctacactcaggcaacacatgatgaatcaatgacttatgaagatagaagccaactagatcacatgggctttcacttcacaactgggatccctgctcctagcacagaaacagaattagacgttttacttcccacggcaacatccctgccaattcctcgtaagtctgccacagttattccagagattgaaggaataaaagctgaagcaaaagccctggatgacatgtttgaatcaagcactttgtctgatggtcaagctattgcagaccaaagtgaaataataccaacattgggccaatttgaaaggactcaggaggagtatgaagacaaaaaacatgctggtccttcttttcagccagaattctcttcaggagctgaggaggcattagtagaccatactccctatctaagtattgctactacccaccttatggatcagagtgtaacagaggtgcctgatgtgatggaaggatccaatcccccatattacactgatacaacattagcagtttcaacatttgcgaagttgtcttctcagacaccatcatctcccctcactatctactcaggcagtgaagcctctggacacacagagatcccccagcccagtgctctgccaggaatagacgtcggctcatctgtaatgtccccacaggattcttttaaggaaattcatgtaaatattgaagcgactttcaaaccatcaagtgaggaataccttcacataactgagcctccctctttatctcctgacacaaaattagaaccttcagaagatgatggtaaacctgagttattagaagaaatggaagcttctcccacagaacttattgctgtggaaggaactgagattctccaagatttccaaaacaaaaccgatggtcaagtttctggagaagcaatcaagatgtttcccaccattaaaacacctgaggctggaactgttattacaactgccgatgaaattgaattagaaggtgctacacagtggccacactctacttctgcttctgccacctatggggtcgaggcaggtgtggtgccttggctaagtccacagacttctgagaggcccacgctttcttcttctccagaaataaaccctgaaactcaagcagctttaatcagagggcaggattccacgatagcagcatcagaacagcaagtggcagcgagaattcttgattccaatgatcaggcaacagtaaaccctgtggaatttaatactgaggttgcaacaccaccattttcccttctggagacttctaatgaaacagatttcctgattggcattaatgaagagtcagtggaaggcacggcaatctatttaccaggtaagatcacaacattgataaatctgtttccaaacctggaaacagtcccttggtgctaacgtttatatgtatgtaatttttattgtgatgttaaatcaatggagagtttcatattattcacataacagcaggccaggccacagtattgagttcataatgagatgaaatgacagtaagtatagattagttttggactttagaagtagactttgtatttttctgggttttagaaataatatacaattacaacatggaaaagatgaaattattaatgttataaaaattcaatttgtttttactcacaactagagtattgctttgtcatatgtctcatagttatacatgttaggtttaaaagtagaaaaaaagtcctatttttaaaaaccctcccattgatggatgctattgctgtagtatcaaaatctgtcaggcctttaacatttgggagtagtacgtagctctaataattatttcagagtttgtgcagtatcaatatcagctcatacttatatgcaatgtccttgtttaagacagtctacataatgcatcaaacacagtgcctaccagtagtgagtagtcatttattatataaacatactgcctgttgagagaagttttctgtgtatttactgaatgtatggaaagcatgaatttgatactgattcatataagccatctcttctgattgccacgaaaaggctataaaagccctgtgtgaaagggtaagaggtgaaggttcagagaggttcagcaacttgcccaaggtggcacagccacattgtggtaaaagtaggatttgaacccagcttagctccactctaaagtccatagtcttttcactgctctttgctggtttcagtatagtataaaaataaacaattgatattgaataatatatgaaccaggaatcttggaatatttactttgtagaatttattttcctcttaatctagcctgagaatgttaagaaatcagctctaatggtgttttcccataatgttattatttaaattaacaatgtcagtggaatccacaaatagacatcaccacctagctgctacctgcaaaaagaggaagaaaaatcagtactttaatgtctgtcttggttgagaatatatgttttattttaatatgttttatgccatgactatcgttaaaattattcttctgatcatatcaatattaccttttgtgccaccaatgctttattttgatgtgcttcagaaagagtaaaatagaaagtacaatttttaataaatggcttgaaatattttgaggaaaattgatcaaaggtagttgacattgggttttttgttatcactgtgtgttaaatctgtaaatgataatctagtaatttggctaatatttattgttttttaatttagtttaatatacttcagtttgttaaaaatatgatgtaaaaataactggtaataactaggtacatatagagttaagtttgatgaatgagaaatatgtaccaattttccagtttacaatatttaccaagatttatagtttgcgtcttcattgcaaaacaaatggtcactttagcttaattcagtaaacagcagctcatatgggattacctggtctatctgttgcagattcaactttcagaggttaatacgaactgtttaggggagaataacattcataaaaactgaagtttcctgttaattggaacgacttccagttcacaggaagactcactcactcagtccttgtttcatggtctcagcatggtgtctagtgtcagtggtaggaatagtaatagtacttcttcacatttgtgtggcacatcacagtctgataaagcactttcacctagtgtcatttggattcagcacagagggcagcatgtggctatggcgtgtgttaactgcagccttgtcatcctggcagcgagcgtacttgtactttaaaattcagaaagctaaaattgttagggagatttcaaatagttttggaactataggaaaaagtgtcttagaaaactcgggggagtttttggagaagttgatgtactcatctgaattaacctaattttaacgtgaatcccaaacatgggaatgtgtacctatccaggtttatagtcattcagaatttacttaacactcagaaagtttgagtttgactttctggtgtggggaagtctcagttatcttttatagcagtaccttgtttatcctgatattctttaagctaatgtttcataagaagttagacatctttcttctttcatgtgtaattatttcagggtttcaggacttaagattcttgaaagtatgggtgtattccatagataatctattttatttcaattattttgtaaaactttcaactctcatttggatctttgaagatttagaaatgtaagcaagtctgaaacaatatacaaagaataagtataaactcaatgaaaatacacttatccaagcaatattgcaatataaaatatatgcttcaagtggtgtaaaagtgtttgcacttagaaaatatatttaaactgtttgtcctcataaatttatgtcttcggccttcatatttatctcccaggagtgtcggttttatttgtattttaataagaaaattataataaaaacttggggtttcattttaggtgaggtttttgtatttgggtttgtttttctacagtagagtttaatccatgtgttgcttttcttcaagtatagtttaaaggagtacatttggaacgtgtttttggaaaaagcatgttaatgtagcagaagagacttcagtgcacactttcgaagaaaaacagtttctgagcattaagtggtaaaaggcaataataattcaaatgatgataacaagccaacctgctaaaaagaatgcatgttctgtgtatccagccatttcacatgaactaaccccatttaaaagaatacattttccattcactgtgcacatatgtgtaatcatttttgactaaaatcaattgccattatcatgccaactaaatctgcagtagaatatattagttgccagatacagtacaaaaaatatcatttaagagtaatcgtgattgaatcccagaaatgaatagatgcaatttgtaacaattagttataatgccaagaaacactccagagagtaaagttaatgttaatttttatatgtagtaactctaaattgctatggtaaagcctataatatggtagcaatatggggcgttttatgctaaaatacacgcaaacattagagacgagcctaactgcttttcttactttcctgaatatggtaggacctgatcgctgcaaaatgaacccgtgccttaacggaggcacctgttatcctactgaaacttcctacgtatgcacctgtgtgccaggatacagcggagaccagtgtgaacttggtaagatggtacttggctgaaaaggtgcagttctttcacagaagatatattgggggagaatttatgttgtcgaatcaatcagagatttcaaagaaacccatatgaagattaattatatgttaaatgaagttaaaatctgagggtaattaactaggggctggaaaatgggtacagatattcagtgaattctgttaacgtaaccaagactcagtgaggcctgctgagtcttcttgtgttttttacaggtagaatttacaaatgtaaaaatgcataaatattaacaaaaatgtacatttatcccccaaatctgcatataaataaaaatcaatttcagtataaaaatctttttagaaagctagacttaaaaattaggaaaataataaaagttagagagctttgtccttagttttgggataatttttcttctcatttggaatgggaaagacccttccctgactcccagcaaccagcccaacgtgcctcggcctcagggagctgtgcaattgctgttccctgcctctcttttggttccaaggaatataattgaccctcacactcccatattcttatttaggcatccttctctttaaagaaaaaaaaaaaggcaccagtgttgatttggctacatatagacctcacttctgagaaaagaatgatgaaatatgttgtccagatgtcccttttagagatatcatgaaggtttgcttaatttgcttacaatgattgagtaaagaaagctcaccaatagcactttaaattatacatcaatattgcgatacaatcccaacattcatattaaaagagtacttaaaaaaagtcaacgaggccagcgcggtggttcaagcctataaccccagcactttgggagggcgaggtgggcgaatcgcttgatcccagaagttcgagaccagcctgggcaacatggcagaacctcacctctgcaaaaaaaaaaaaaaattaaccgtgcctgtagtcccagctacttgggaggctgaggtggaaagattgcttaagcccagaaggtcgaggctgcagtgagctgtgttcacgctactgcactccaggctgggtgacaaagtgtctggcactcagcaagcaccataaacatgtttggtattattactatataatatcatgtttactaagaccatttctttaggtaagaatacattatatgactaagaaatttaacttgctttgtatattcatttaaaaatattcttaaacattaaatttttagtgtaattgcaaaatgctatggaaataaagtcactaatttcatcaggggagatcatatgtagaaagattagaatctgtgtagaaagattttatttgacatagattttaaagttgggaagatttgacaggtggtggagggagatatggacacaacaaacaaaagcacagaggccaaaaactacagaaggcatttgaatgacagcctcgatccaggtatgcctacttaggggtttgggagagggagacgtattgggagacagtaccagaaggcaggttgggtctagaaagccctgacagtctaagaaggtcctgagttcaggatactgaatagtgttacttcacactctagtcaagtgattctgagaccttagcatgcatcagagggctggtaaaacagattgttgtctccacctcaaagtatgtgattcagtagatttggggtggaattggaattgtggatttttaacattcttaggtgatgctgatgttgtttgtggtccagggagctcacgttgaagactgctgccctgggcaattgggatccatggaatgtttggaagtaaaagaataaaattatcatgactgtgtctaaaaaagatgacatttagcagagtgatggatatattggagaggaaagggcctagggatggtgaggccagttagatactttgagtagtccatgtgtgaggtaatcagagaatgagccatgattggaggtgggaaggctggggctgttgattcttcattcgttttagggcttatctgattcatttatcagcaatggagacaatggccctactctgaatacctttgacattttcttagggttgccaaatttaggaaataacaattcaggatggccacttatatttgagtttcaagtaaaaacgaaataactttgtagtataggtttgccctaaatatggcacggacatacttatgctaacaaattatactttttttaaaatctgaaattcaaatttaactggctgtcttgtatgttatcttgcaacctcacactaaatggaattctttgatactttttgaaagtattttgtgagcttttactattttgtttcagattttgatgaatgtcactctaatccctgtcgtaatggagccacttgtgttgatggttttaacacattcaggtgcctctgccttccaagttatgttggtgcactttgtgagcaaggtaagagctattgcaacatttgtatgatgaacattattgatttttttttagcaattttggcctcaatgcataatctttcctgcagtggaaattcacatttccttaggtttccttattcagggatagctcaaaacatctgaatcatagtgttgacttgattatggttgtttagctgatagattggaattgcaggcaggcaaactgagctgaatttaaagacatccagccaataaaaggaatattatcgtatgtatttttcttggggacaaactaagcactgaccttactgtggctcatgtacgaaggagtactgaattcaatattagctgtttttattttctcctcctaagcacttgagactcaatggacttatttttcatagtcaatcatatctggagaatgagttgatatagttgttagaatacatttgctttggcacatgctaagtagaagatattgtgaatctgctcaccaggaaattttcctactaaagaaggattgactttttctgaatgaaagaaagccctatgttcatgatggcttgaatctcatgatccctgtaatttgcattttacggccaacctgagggtgtattttaggtggttaatgggagcatttcttggtccatcaataagaaacagattgcatgctaagcacactcagctttggaatgtcgatttcctctacttaaactcgtacagtggtttggctttgataaaagtgttcagtgccaaacttccattccaccagacaaactgaaaatgcattagacactcaggcacattggtctggtcccacattctgcttcatggtgttaatctggatgtcactgcgatgaatgcaaatccaaaaggagcatgtattgaattgctgttccaagtggatggatgatggctacatttttaggtgttggtttttttctttttttattgcatagggtaaatctgtttgttttagattttgaatataaagatagaccaagcaagatcctcttcttaaagtaaaaacattagaaagatggcatttgttgaagaaaacaaaagcctgagacagttgagacattccaatatgttaaacatgattctggcttctgttagttccaagtacaagaagcaattcaaaaaatcgttttttcaatgtgcatttactgtcttccaggcactgttctgggcattggagatagaaatatgaacaaaacaaagtctctgatcctggtgacttagcataactcttggcagagaataaaatttagttctttacagactatcaaatgcatcctggcacattgtttcatttggttggcatagcatttctatgcattcagtgggctagaaattaaggctcagagaaaaaaagtgatgtgtttaatgtcacacagctagtaaatcgtacaatgggaaaagtgaacctaaatggcttaactctacagcccaagtttctctgaatatcttcacacttctaaagtaactctcaaagataaacactttatttatatgtttatctgatgcattgagtggcaacagatttttggaagggactttggtgccattgaccttttctctttcttttcaaaagaatattgaaagtaaaaagtgttaattaattttatttctggtgccacctgactttcaggtactttttattgtattttcaagcaagtttgattttcatgcacatttttttgctgagaaacatcgatctcagtctgtttacgcagtgcagctgtgctcctgtgatttattgccaggatactgaaagatttttttcctcttttcaggttgcctaagaacaaatgttttcttcattaacagcagctttgttgtctaaacaattttctatccaaagtttggtgatgaccgtgtcagtgttccttcagctgacgttttctgttctctgactagtaacttcccaagtcacagttactccgaaataggggacacattttggtgcaataattacagatacaaaatctagaaagggctattggaacagtagagaggcagttctggctgcacaaactgcccttgccaaagtcagtgatacagcttgcctagtgagaagtgtggaggatgggcactttcttaggacttgacagctatatgtcagagaggttgaaaacattacctgtacagcatcaaaagaataaatttttggtgaatttgtttgtgatagtttcaccttctatgttcatgaacaggagctgtgcacactacaaatctgggtttgtattgtaacccattgaaacaacctatttttttgtaacctctttaaaacctataggagttttaaagcataagatgtctttccatgcattgaatgatttttaagaaaatgtcatccacaaaggttgccttttaataaataaaaagagtttcacataatttttaggtaaggttgaaaaaacaaatagactatttctatgaatagtatctcctatcagaatagcatcctgggagatgcagcttgacaaatgatccttcattacatatttgttgaattcatgaataataaaatttaagtggccaggcatggtggcttacgcctgtaatcccagcactttgggaggtcaaggcgggcggatcacctgaggtcagaagttcgagaccagcctggccaacatggcgaaaccccatctctactaaaagtacaaaaattagccgggtgtggtggcgggtgcctgtaatctcagctaatcaggaggcagaggcaggagaatagcttgaacctgggaggcagaggttgcagtgagcagagatcatgccaccgcactccagcctgggtgacaagagtgagactccatctcaaaaaaaaaaaaaaaaaaaaagtgaatcaatgtggatagttggctttgttttttttttttttacacaaaaaccactctaagtggtttttgcagatatatttatagtcattgggaagctatgatttagatagtacaaataaatgcattttcccagtttggttttaacagaaaccccgcctctattttttggacctgtgttctgattggaatgtatgcatctgctaactgagacaggcactgttagtagtgaagtggtcacatatctaaattttgtgatcatctgggttttcttgtttaggaggaaaaatacttaatgataaactatttagaagacaaaaaggggctgggtgcgatagctcacgcctataatcccagcactctgggaggccaaggcaggtggatcacctgaggtcaggtgttcaagaccagcctgggcaacatggtgaaagcctgtctccaccaaaaaatacaaaaattagccaggcatggtggtgcacgcctgtagtcccagctactagggaggctgaggcaggagactcacttgaacccgagaagcagaggttgcagtgagccaagatcatgccactgcactccagcctgggtgacaaagcgagactccaccacaaaaaaaataaaaaataaaaaagacaaaaaaggggaaaccaaactaaaaccaattgggttaatagcagataaaaaagggtatgtagaaaagttttttctgatgtattattcaaggggttaagatcctccataattttacatcatgtatcttaaattaatgtccatggttaaggaaagttatgccattataaatcacattatttactttggcagtaagaatgttctaaaagtttttttgattctcctcctctgtaaactaaccccctcatataggaagagctgtgttcttcctagccctctcaccttacctctaaattcttacaaatgaacttccccaaagcagaaatactacatccaagtagccaaaatttgcttcattttgaggcactgagtgctacttttataccaaaccatctagctgtgtcttgagtcctttcctatgagacttggtgatctccaaacaacactttaataaacgcaaagcttccagtgcacattactcaaaagaattagtcagctggctgcaactaaacaacaggcctgatagactaaactgaaataaatactgctctcagataagctgcatctgttgtgtgagtatggttttaatcactgaagccaggaaagaaatgaaatctttcagaattcatactttcccacagttatagaaagaggagtaacaggaataagagtcaagagacaatctgagtttcaatttggccaccaaaactaacgtataaagcaaacatttatttaatttagtagggttgtgttttcttctattaatcagcaaatttgggtggggggagatacttactaggtcatctggaaggttttgttggtgcctgaaattctataaactgcagttttgttagtttttacatgtaactacttcaatataattgtggggtgtattttgtgaaagtcaaccccacctgtggatgagcaattctgtgggaagattgccaatgaagaatacagtgctatgaacaatgccactttcttgtggaattatgtaaaaattggcaacctagaaagtgtagctgatactgccagtgtaaaatttagatatatttgaaaaatattattgtcccactggaatatcagttatagtgtgcttattgtgaaacacacacacagacacacacacacacatatgtatatgacctggtggaatgggggggtgagttaaataatttaatttatttcatttttaataaacttaaaatcttgatgcattttcattgggcattacctatcttacccttctttttaggaagaaggcatacagttctagctgtatcccaaaacgtacctattcataaaggatttttttctctttgtcagttttacatgacaagagcctgtgacttctcagatatctctttgggaaatgggagaggactacttccagaacctttgaagttgttatgcaaatagggcattcataattctattagccggaactcttatctatcacttgaatgagtctcttagaaaagttgtgttggtaaggaattagccccagttgcttcacaagtaagtcagccagtgctatagcagcccaagagattttggctggcccctcttccagttttctctggctttaatcaaggaagttgctgttagatgctgcctttgcaatccaaagatatatagccatccacttggcacgaatcagttgggctcacttcataataatttctttgtcatcgtgaccaaattttatgaatcagttacttcagggacattgcacagatactggcttgggtatcctactaacacttggttgggggtgccaagtttgaatgacgtatgtgcgtttaataagctcctgcctgtttcttctcagataccgagacatgtgactatggctggcacaaattccaagggcagtgctacaaatactttgcccatcgacgcacatgggatgcagctgaacgggaatgccgtctgcagggtgcccatctcacaagcatcctgtctcacgaagaacaaatgtttgttaatcgtatgtaccaaatagatacgagtttccaggaacttcacttctcatcactctcttagttttgtctgtgtgcaagtgaaaagaagtagctttttcaatcataatacaacttatcaaatccctcatctgtgaattacttaaaatcatctcacctatgttaagtcccccatttggggaaacattcaactataatataggtaggcattggtttgtctgccagcagtaatagttgaaacacttgctgtaggttgaatcataagcagttgctatttgatcatttttaaatatacaaaaacagctatttcttatggctcaatagaattcttactatggttatactttcatagtctctattttgaatatttatatgcctgtctaaaattacagttgttttcagttatttttgtcctgctaattaaaattgaattgttaataatagcaccctaatcttaccttttgggcatattgattctcattcaagtttctaaatattttaaattgtggaaagtgagctacatcctaagaacttgaataggtggagattgaaagctaatgaaacttaatatcagagctgtttaataactccttcaactgcagcaaaaaggagggcaactagttttcatgtagcaatatgtagaaatttgttgctcataaagcattttcttaagaggtagtgtcttgccatgctgtccaggcttgacttgaactactggcctcaagtaatcctcccacctctgcttcccaaagtgctgggatcataggcgtgagccaccattcccagcctcatgaagcgttgtttgatgttctattaaatattttctcgtgatgcctactatcgtttagaagtttgttaatttgtaatctggatagaggttcatttaactttactgcgtgatatccttgccagtgactcacctcatggtaaaagtaaatatttttgaggataaatctgtagaactgtctaatctaggtgttcactaattaaaatgttttgaaaaaaaggaacaagtggcttccaaaatgagggtagcgtggataagatctggcacattttattgggtcactgaatttttgccaatggcatcgcttaaaaacaacaacaacaaaaaaatagaaaatttctatcataaaaaaaagaaaatttctatcatgagtgagggtgggaaaaaatttaattatagtaaattgctaggggaattattgtctatgtcttgatattttaatgcttcacagggtttgcacattaaccttttcatttaaagcacattgggcagaagaacaaaaggtagactaggagagatttttatgagcaactaaataaaaatccagccagtaaagaggatgcatgattcatgctgaaaataattttctttgatatattttcatccatatatggaaaagtagtacaaatatctgtgtggtttcctatcccttaggtgtgggccatgattatcagtggataggcctcaatgacaagatgtttgagcatgacttccgttggactgatggcagcacactggtaagatgcccttgaaaatgatgtcaagttctaccttctggaaatttggtactgtgcactgattgtgcattacagagggtgcattagactggaggcaagttaaatgacttgctcaaggtcactcagtgaaacagagaagggttagaagagttccaagctacctgatccaacatccagtcctctcttcaatagttgtggttctcttcaaaagaggagtgtaccagatttctatcaaaccagaaaaccagacaattagtagaattgccttgggtctgtctttcagatggttatctttgctttttctagcttcagagcaaaaagagaagaataaaatgtagcagaaaaagtcattttaaaaaaatacctttccgtcttaaataattcactggaaatccgctataaggcatgactcatttccaagcaaaaatatccatttatttttatcttaaagaagactgttgatatgatcttgtgaatttctgccaactaattacatatttcaacttgttttctattttttgaagaaagaagtgacttggaaatgctggccacaactttgagtagactgtaataggttcttagaacaggtgaagctgttttgagtcactcttactaaactcaaataaatctaatttttataaagagttcaaatatgattgtctatactagtggtactcagtgctggctgttcattagaatcacctggaatatgtaattaaaaactggtgcttaggccttatcccaggtccattacagcaaaacctctagccgctgtattttctcagtgttccacaggtaattcttaaacgcaaagttgggatccactgggctagatagtaagtgtaaattaaattctaaattagaaacaaagtgtaaaatattgaagataattttaaaggcctttttgtgtttttattacttaggtattcagtttcattcattatctgccacttgtttggattcaatgagtttggcaaaatataaaattcattcaaaaacagatgtcaaagtaatctctgcttttggaagttctgctctgtcttaagagaagctgctccatcatggacacactactcactttatctatgtgccagccactgtattaagcacttgcttatgtttattccccacaataacttttaagagaggcaatgggttttccttcacctgttttacaggtaaagaaagggaaggtcagttaggttgagctatttgcctggaatcacaaagctgttaactgatgaagccagaatttgaacttaggcttgtctccaaagccacagtttcttctgaccggtacctcctcggctttaaaaagagtgtatcccttgttacattttcgctttgagcaacccaaaataagacctgagtttctctctctgtcaccactgtttatgtttaatcagcactgtttcactgtttgtcattcaagttcttaagtaggttatttggcaagatgtgagaaaaatagggaaaaataggttgttcttaaaatatgttcccagtaagcaataggaaacacaaccttagaatcaataggctcatcttcttctattaataattgtcctggctggatgtattggatctgtatctgcaattgttgcctctttatgttttcattttgctgtacttagggggataatactggcctattagattaatagcgattggtatagcatgaatctttatattacattaattttaattgaagataattttgatcctattaatttaatttctaagtgaacatatgattcagagattgtttctatatattataagctgtttttataattttattaatgtatatcatacagtgaatgcatttaatgagttttccttgttaaatgtgtacttcattctcatggaatacattgggttttagggtgcccactattaagtctacctcccacgaatttcccttatttatagcccagtgaaaagtgcagggttttgtgagcccccatcatgtatacagaagctggcatgcccaggactcagctggccatttctatctagttactgcttatttgtgcctggcagatgcagcccatgacttatcccaaagtgtacctgttgtctgggttcctgtagattccagccctgagcctagaatagctgcatttggccaggtggagtgtacgaaaaatctttttttcctacacacttacctgactgaaccaagtcccatctatttctaatctgtcattggttacatagatttgatgtgtgtgtttttattcttagcatgtatgtgtgttactagatgtttattctggtctctcccttagcagttcacctcttcaaagaagtaattctttcccctgctttttatttctcgtggtgtctgaaataaagtgttatcctttattcctgtgtgcttggttaaagagacttcatattggcctatatctggcagctatgtggattctgtagagtatcttaggaaaattatcttccctgccaagtgccatacaggtgagcttgattcatcatatgtcattattcccctatgccaaagcaaggcaactcaactagtttttgtctgtgtccattaatttttaatgtaggtacacaaatactctgaaaaacataacagtgactatttccatagtctagaaaggtcctaaacgtggtaaattagtgagcatcgcaccttgtcaaaaaagaaatattgatttccctctgaaattttgctctgaaacttccagaggaagataacataagctaacatagataactgtacaacataaacaagaaccctactcttaattagttggcactttcacttgaaacgtaaggattatggagaatgcactgagggcctcagtttgaagaagacacatgatgaaatgtattaacaagcaaagtttatcaaagaaatgacacaagtaaatccagaaaaaactctgacagaccctcggtttcttcttaattcactctctgtgtaaaataaaagtgtgctaaggaatgtcccttaactttgaaaatactggaacagaacagaccatctgtcttagagccggtctccctcgcattcaactgatctcctgcccactttcttgcttttgtaaccaccctttcctctatccttttcctctctgaaacagcctaggtgtcccttaaactcgtttgtagttttttctacagtcaccatccccttaacgggttccatatgtgtgcaggcctttgaataaaatccttctgctttgtttcgctgtttactccaaggtttttgcttttgaaaatatccctaacagtaaagtcttggtcagggggatcagtatctgcttatacttggaatggtgttaacttgactgtgtgcagttttaaggactttgtttatgttttggagtgatttctctcctcttccacaccctctctatctccatttttttctttgaaagatttattagagcttctccgtcttgggtggtagaacagtattaaaacaaaaagaacctttcatatttaccttaaagtgtcttttgatatttagccttacaatccagtaagaagaaacaagtttatattaggtctcaatttcaatgatccattttactcaaataattaaactttgctttcaataaacttacagtataaatgtatcatatttaatgttatgctatacagctagactaattcaactagtatactaaattaatgatgttatttggctaagttatctaaattgcccttattcttgagattctgatggattcattccacattactggcctctataataggatgttgttatcattgatgaaatgccaaattctcatttctgttatatttttaaaatctattactttttttatttggggtgtttgcccaataaatttcacaaaagtgaattcatgaataaaattgtgcctagccttacccttgtgatttatattaagattatttcttttaatacatttcagtttttactttgtcacttggctttctcctaacctagttattctttaacttgactattgttaacttgacgattgttctctatagcaaaatgtgcctactgctttattggaaaccctaacaaataacttcactaatgaattgctttgcttgtcacccaagtaatatcttcaaagacactcagttaaaccatccaagttaaatatacattaaagctggcaaacttaaacaaacttttcttatctagcttatatactgttagctgactttaaagttctttcttaaaccaactgttaaatgaatgactagtcagagtgttttctttcagatctgttttccagtgctaatgacctttcccttccctggctatgaactcttgtcgctcccttaaaattcttcagtgtctgctcattgccttcagtataaaatgttaattattagtatggcagacaaaaccaatccactccgtctgccacttcctgagctatagcatctcaaaatactctcagctcctggaataagccatgggttctcactcctgggcggctttgcctgtactggccctagtgtttagcatattctcacgtcttatcctcatttcatctcacaaacagtcaaataccctgcatagccaagggtctccttccaggaagccttccttgctgggaatgactaagagctcctcttctgtgctcccacatcttttttgtcctccacccatcctaactcaggctcctgtgaaatcaacttcctgacactgagtcttctgagataggaattaactttcgtctctgttttttcagcaactagcagagtagttgacatagaacaggtatttaataaatatttgaatgaacaaatgatcatcagtatacacacattgctcagccaactctatcttttgaatcctgaaatgaacacattatgtctttcagctgaatctctttgtgacattttttgcctaaattaaagattttatttaaagttgtaccagtatgaaaaacatcaaaacataatagatgggttttacggtgaaaagaccaaaaaaaaaaaaagatattccttaaaaatagaagtatatagttgaacatactgcatcttataaatgtatcaacccaaaggaaaacaagtgtttttactagaaatgatgacaattttgtccatggttgtcctagaaacacctttgcaataaactttgggaattaaaaatggaaagtaaactttcaacctctgccacccctgcaggtttgagttatatcagggcaggttttccatgaaactttaagaaaccaacaattactcaaaactttggaggaggatttttttttccagataggcacatattccgtaggtatactttctgaagaaaaatgagttttagaaaccttattatttatatccaaaatggagtgaaacaaacaaaaggaaatatcactcccaaatattatcagctcattttactttttatagatgctttggctaagggtgatttggttgcataaggtgggatagggcttcatttgtaaatccactatctgaggctgtttattcaagtgcagaggaagccagacaggcagggaacgttatggaatcatttatatttatctgtcagtatacctcctggcaaaatgattttcacaacactgttttcaactaaagactatagtgtctatgggacagcccaattaaggagctatcagaaactcttacatgctttcatcatactgttctgtctgacaaacctctccaacaagtggtttaaaatcaaattgtggagctcagagatttaaagctgtcatattgcttccttctctcttggaccctctggagtaagattctcacgaggcgattctctgggctccacattgttcctttcttcaatgattccccccagcaccatcaaagctgacccttccccactggacactggtgtcttcagtggatcagacgcatttacttcaaagggaaccatcactttagatggccatgtatagaggccgaggactgaataaaactgacattgccattccatttttaaaatattggggagtttttggaatatttagtttgttctgcagaaaaagccctgactttattcctaaacattttaaaaaacattttctgcatctccttcactttttttacttctgtcatctctacattgtcaggactcaaatgtcacaccccgtgaggctgctggcttccctgcttcctgggaaattatcacagcttccttcttctcactttccattctacagttgggagaaaacagagagactttctctcttctacatttgtccaaatctggtcaggaagttctagaacaagttactaaatcacagattcataaatatcttattttctagctctaaccaactcatcttgctatgatagttgtgatataaactaaaaaaaaaactaattgataggacaattagtacaattaattgtacaattaaccttcattacttaaattcttcttaaaaatatttctggaagataactcaattttgcattttgtttttcattttggtaagcatagttcagctttggcaacttaatacctacaatttccaacacccacttgtcccccttcaccagttgattcgagttgatgcacaagaatgtccagatgtgtggatttgactttaaatccagaggctccttcttcttctttcataaataaacacatcagtctgtcaagcaaagtattgtgagaaaagccagctttgaaaaaggtagaaacaataaagaaatagcccttacccaggaagagacacttaaaaggggcagaaaaaatggagtaacaaatcacggaccataaaccattattgtttttctgcagcaatgtatcattattaccctttcataaacacaaaggttcttattccccttcctctcccagatgtcttggacattgaaaagagaatacggagtattcattaattccagtgctttctaagcttgttgtagatttctgctcatttgaaaggatttcacatgatttgacagaaaaacaatgcaaaacacaatccccacaacaaaaatttaagttttccttttcctacctgaagatcttagaagactttctatacaacatttgcagatggatgtatgtcagctgtgatgtggcattagctctaagtcaaataccatttctctgtgaacaagtcacactgcatatcaacattaatttaattatgttaaacttcacaggctttattgtattaatccaaaagccaaggaaaacatgctcttttctcattctttaacacattactcatgagtggaagaattctcagattcccttctgtgaaagactactgagttcttaatgaaaattttgacttgtgttgtagtttaatttgatttggaatcaagaactgattcttctgattctaaatgtgagatattatgagtcatagagtagttctagaacgcaactctgctctctgccttgtctttcagttcagatagctagtggtgggttgaacagctggaagaaccatatttactcactactggaaaatcattttataattgacaagattattataaagaataagaaaaggagatttagtgcagtagcatctcacagatgcttttccaacagtcttctgtgcaactttaaaatctcatgcagatatttaaatctaattgctaattagtttaaggcaatgcataaccatggaaaaggccaaaaaaaaaaaatatattgaatgagctttggcagtctctccttacatttggatcgtcagcccttcatgactggagacctgtgcaaataagcttggggtaaaggagcctactggcaccattcattctatggattaaatgcaagttgctctctgggcctctgcctgaggccccctctctcacagtggtctcacagtgcgagtaactcacatccttctgaaaatgctgttgataattgctgctttgtagggcagtgagctcacactattacacaagattagtgctgttctcaagagctggccagattgtctttcccgcacagaggtttgccagctaggaaaataatgggcatattgccactttaacaactatcaggagaccccaagttagtttttcttcccttcagcatattcatgtttgtaggatccaactccaggctgccagcatagggtagtgacaccaaaacaaacgtctctttctcctttaaaacaaagctgctcttttcttttcagttgtcggtcaacgaattaccctgttcaactaaaagacagcagcaaaaccataacctcccttaaaacataaataaagaaggacccagactagactaaccttaagcaagtacaaggatcagaagaaggtttatctttaccttgcagggaagtcatttgcccctaacaaacaagacaaagttaaatgcaccactccccctccagactgcaaacaaatgcctattgtgtacaccagccatctagggataaaaaagtcattttaaaggtaccaaatgttttgatttctgtaataagtagtcctcatagcctcttttcagataaccatttgacctgtgttctgaaaggctgaggctaaccccaagtggttattctgtttgttatttagtgaaaagatggtttcttatcggcatatgtttcaaacaggtacctgtcctcttgggaaagtgttttctgtttggaatttgctttcctacttcggtggttatctgcttgcccttggtatccagtgcgtttggattgaattttgtagctctgggagtacagcagtggcaatatgggccccaggtgatgaaaagagtttgcgcacaaagaagtcagctcttactgcaggtgtcatgttttcatagctaatctagataaatttttacggaaaaacaaactaactgtgactcacgctgcagacattgcatttgtgtgcttaggtgtttatctatgatctgacctctcctaaggattttaggtggatgttgcacatttggctttggttctgatgcaatttcaccattgatgtaaatcatcggataattttaaaagacagagtggaaaagaagaaactaccgtaggtgaacattttagacagaaagaaaattcagattatggatagaatggcttgcaacagaatagaatgcagtcaggttggtaaatactggttcaccgaggtctgtcttcttgcaaagtgttctctttgtgttttcactcacaaaactgagagaacatatcccagacaatcttttattttttatttttatttttttatttttgccacatggagtacataattacgattttgggggacatattccaagttctcttttgttaagtggtgtagccgttaattcataatgtaagaatggatatatatcaccacctagtggtcgtattgtattttgtgtttcaaaaccacattcacagaactacacccagatacacacaagaataatactatctgtaaatcaagttcctgtagttttgaatagtttcttaattctagtataaattgcatgatactgtgatcctgaaagttaaatgtgaaatgagaggatttttcaaatgcagcatgaagctaacacatgtagtcaaatacttagtaaaatcctagcaactaaggcaaatattaggacctatctgtcctgtgttttcactttatacacaatagtagaacgctggagaaagttttctttggctagtttccttgggaggtgaacagagagggcttttgcagggttttttagatgtttttttttttttcactgtgaactaaattagcaatgtttggaggaaaacagagtaagtgaagagcagtgactgaaccgttcaagagaaaaactcccaaattatagtttgaagttcagtaagttctcccaacaattaaaataatgtattgtgaatggcttgactacacacatgtcaagaatggtttttctcaaagggatgtgcttggcaaaattcataaaatctataaaacatcatctttaattggccatttaaggtaatctaaactatggcgaattttaaaaaacaaaaggtgactgcacctaagctgaaaaattatagataatatatggatagatagagagagagagttggaaagtaggcccttggcagttacagattcaagatttgccgccccagttatacatgagatcctgaaggtctgcagtatgaaaacatttgtactttttgctcaggcacaaatttgaactgtacccaatgactggctagtgtgtaaaaactctcagtgagctctcaagtctgtgtattggacagctcagttttcccatcacaagaagtaggttgctgtctactctgctgaccattttgtttgttctctactgtatttatggcaggaaattatctgctacacagatgtgtatgaatggaagcattaccaagtcttaggtcttaggcacttctttaatgccaagaagtattgtatgtgtaagggtgtgtgtgtgtgtgtgtgtgtgtgtgtgtgtgtgtatgtgtgagagagagacagagtctcaaatttatgactcacaaaaatatgaacttgaattttgtctagtgtctatgaaaattctgtctctttttatttatattgtatgatttagaagccagtagagaggaaaagaaatagaaagattctaaacagtgtctgactcttctagagaaccagtgctcattgattattctttgtagttatttgaccaagttagagaatctcagtgaaaatgacttgaaatgggttgagtattataaagaaaccctagttattgattaggttttgataagaacgattgctcttaaaacttcttagtcttttgctcatagatgaatttgcttctgtatgtgatgtgcagggatcagctgggacttgactgtgacagcagtaactgatactggatggtctggtttcctttcttcaactgaaagtagtactaaagatgaacccaagaaaactcattttttaacacaaggaaaaaaaaacctcctggtttatttctaagtcttatctatttctgaaaaactgcttttttttttcttttttttttgagacggtgtctcactcttgttgcccaggctggagtgcaatggcgtgatctttgctcactgcaacctccgcctcccgggttaagtgattctcctgcctcagccttccgaggaattacaggtgcctgccaccatgcctggccaattttttttatttttagtagagacaggatttcatcaccatgttggccaggctggtcttgaactcccgacctcaggtgatccaactgcctcagcctcccaaaatgctgggattgtagtcgtgagccaccacacctggccctgaaaaactgcttttttaacctttgcaaaaaggcagttatccatcactgcataaggaaaagggctattagtgtacattacatttttatcatcagtttgttttgttcatgcttgtgatgctagttatctgctgagattttaggtcattgatcatggccacctggtgtgtgttttaaatgataaaagatatctctgaatgacagttgggatttcctagacactatgtaatcagaaattcaccttgaacagtgtaaaccccatctgaatttggtagattgttggtaactttcaaaagcagagacctctccccacccaccatcatctttttttttcctggtatgttgactgaattaagttggagactttgcaaagaactgggaaggagagaaatagctctccaaccattctgagtgagaaaaatagtcaaatcactctgagatacatggaattgaggtcactctctgagggttaaggatgctggcatgcacagaagtcatgtgcactgcagaagacctgcaggatgagtcttctcttttgtgttattgtgagacagaaataaatttttgacaagtacagattatttggaacaaaataatcgaaacatttagagttcgatagacttcaatgaatagcttcagtctgctctgagttttcaccctgttaggaatggttcacaatgagttctctagtttgtgaagagaaacatacttattagctgttagattttgtccagggttttttgaatcattttattattttggcagctgatttgcttgaattcaattaggggaaaaagaaagaaaaacaataactgaaaagtgactgattccagcttaatcgaaatggtagccctttttggcatgttattacagacctggagaactagttatttaattggactctaaaaataaagcaattttatcatatattatccagcattaagcagttatatactagatataaaataattatctcttaataaaatgcaagaaaaatttacatctgagttggctttcctctacatcaactatttgcgtttttgtttgtttgtttgttttgagacggagtctcacctgaccccctaggctggagtgcaatggtgcgatcttggctcactgcaacctccacctcccaggttcaagtgattttcctgcctcagcctcccgagtagctgggattacaggtggctgccactacgtccggctaattttttgtatttttagtagagacggggtttcactatgttggccaggctggtctcgaactcctgacctcgtgatccacccgcctcagcctcccaaagtgctgggataacaggcatgagacactgcacccggcaactctttgatttttatgtcacaatttcctctgccatcagaagagagtgaaaatgcaaagtaattttagggttctctttcaggtgtagtagtgatctaattcttgtccctggggaggcaacaagcgtttgaggtgtgttgcatgaacttgagtccctgaggcacagacaaacatgcaggggaatgaccagcatttatttttccctaaggggttaaaatgaatttccccaacccatgctggcttctgggaataattcttagtttgcacattcagctctagaagagggttgatccaagatagatcgctcaggatgtttgctcataattcaaagtgaaaaataaagaaatccaaatgggaggtactgagtttttccctgctaattccaagaatctgtattcctgtatatatgagacaccatattgtgcaagaagatctattaccttcttataacttagaattgattccctgagaagggatttcttcttaacatttaactttagtgaaaagaaaagtacgttattgaagctaaagttaattttttttttatattttctccctacaagtaatgttaaataaggctgtaaagaattcagaaagacacaaaggaagttgttaagaaaactggagttttctttgctaagtcagtttggcaataacatgaagcaaaatcaaagcatcctagccaagataaatctgcacaatggaatgatcagatatgaggtaatagtgtgacatgcctgtgggtatcagacattcttgtaaaaaccacagagctaaaatttggtactgcaccattaaactacagctctgccaagcaacaacaggaacactcattttaagtcattgctgcaagccaaatgtaattctcacccaaaacaattaaatcttttaacagaggcctgaatctgggcagtttgagccccgagaatcactttagtggcatggagtccgaatctcatttcagtgtgaaaatgagatggttattgttcagatcaggaggaagtgtcagctgcaaaatatagggcagtcaagtgactttagtaacttgcggtgatatttgttaagattagatttaaaaagggttagttaagaaatttgtattttttgtgagaaatgcacatatcattttataaagttcatttttagcaattagaaaaataatgctcactctagagaacttggaaaatatcataagtaagaatatatagaataaaatattatctcagtctcatatcactcagacataaactctggaagattttattgcatttgcttttggtcttttatatacacagacacacacgcaaacacaaacacacacacatacatccatacacccagctgtatctgagagtatgagtaaaatttggatcattataatgtaataatttaacacttgttttactaccccccatttctttatttattcttcaaagaaaattttaaatggtgatataatattctatttgtctggctatatcataatttattgaacatatgtttactctataaattgttttccctttactgctaataaacgtagtatttcatataaaatgtcattcacatctgtgattattttttagtatagaattttagaagtggaattttggggtccaaaagcaagaactttttgaggctcctgatatgcattgccacctgttttccagaaaggttatttacttccactggctatgtctgtaattgtctgtctcacctatttgctagcagcaagcaggatctttgattaggtattggtgtgggttgggaagaatgaaacaccctctgtggttcattgtctctaaatatcaaaaactatttattaaacaacataagtatgtgccaaacatagtttctggcactgaggatacagtaatgagcaaaagaaaccaaagccctgtcctcaatgaatttacattctactaggagaaaaaaatgcaattaatgagtaaattatgtaggatggtagaatatgataaatgttatgaagaaaaagaaattaagaaagggagatgggacagtgtaggtagggacaaaaaatgagagagtaatgcacagtgtacacatagtattaggatgttggaaaattttccacctttgaggacattactggtttcctgtaagagactagttggaaagtaagctagaaaatattgagctcctaaatccaaatttaatatttggcgaactctggaatctttgaccatagagagtaccaaatatagatttttgttagttttaatggattcttattctttggtttttaatttttatcctactttaactcattcattacaaacaacttagttctgtatcagcaacaggcagaacatgacatatctctgaaatgttgattatctattaaaggagagtatcaaaaatgtaaaaaggaggcttggcgagtggagggtgagggatgataagggaaatgagcaaagaaaaaaaaagggaaataattagaaacccagtgcagagccaatgtgagttcctggttgcagggagacctaccagtcaaggagtacttcagtgagtgtggtcccttgagcatcttttccaggccatttggagagtaacacagtggggccatttaggctacgagttggatttaaatttgcctcacttctggattaggtttttcccccgagaaataaaaccacccttcatgctgtattttgacaaaaaaacaacttccttaagggtctcttggttttttgcaagtttatcactcttcaaacagtcttttttacatagcagtgatctcttgtctcatatcttaattttggcaggattgaggaggactttaaagtaaagctaaaagactgaaacaaaagtaggttttcaaactttagatcttttcacaaattattttatgaaagatctaaattttttttaccatatttaaaagttttgaaaaccactttttctgagaagaaaaattacagacatcctctagtatattaattatactctttttgtttgtaaactagagcttattggtatacaaatccaatttcataggtaggagaataccttttaagttttttattgtgccaagtattagagatataaaacacagaagaaacatttggtattgaaaacactgcagatagctaagtatagtactttggtaaatacagtaaaatggatcagacatatattttaaaagacttaaaaatagtgatagtactgttgggagtaagtaggtagtagagtaattggaccttccctttttttttttttttaatttttgcattcactgatgctctgaattgaaaacaattgccttaaatcttatatacactttattctctttctctttgccaaataaattcacttaactcattgtctcaaaccataaacttattttaaacttaattcaaggaaagactaacagatctgtaggcccagaaaagacagtcatattagccattgtcacataaatctaaatctgtatttctagcatattttggaagtttgtcaccactaatgttgtcatactagacatgataaagcatgagagtagccaaagcatggtgggaaagtgatgctcaaattgacccagaaaggcgctgaacaaacaaacttgtctcataccacattctagttaagaggactcaagactaggaaactggtctcttatttataggccaatattattttcatcttatcaaagtttgttattcttgaataggcacagcgactatgttttttacataattattgttgccaggaaggcaatattttaagtaacaaagaaatgaacctaaaccggagagttctgggtgcataacatctctaaggtccaaataattccctattatgctgcattgttgtaagagacaatgcatatcaagtacctagaaaagggcttcatctattatagatgctaaataaatgacacatatgatggaaggcaaaagatattttcaattgtatattattgctcagagtaggatatatatatatacgtgtatatataaaggtaaccagcagagaaatgtcaaacccataaagtccttttcaatgatctcaacatacattacacacaaaaaaaatctgtaataagatatacttttgaaggtgtattttttatatcaatatgcataaatgtcataaatgtttctactaaaaagaaaacatttcatattaaatcataaagcacaactcaactgtatggtgcaaataagaatcacatctaaaacaaactagctttgaaaggttgtatataaaatgattagcataggtatgtcagataaatacaaaagataaatattgcaactatctcaacttttttaaccaaatagatgaatttgggtgaaaagcaattacaataaatgagacaaagttactttatagtagtacagataagacaagacaggctgaaaattcgattgaggtatcatcacaattatataaatttatatgtgcacataagaggtagaagaaaacaatgattagagtgatgagattattttttctctagttctacttccattaattttattgaattaataatatgatgaaattcctaaattgaaggttgatgatatatttagaaatctagaataactaggccaaaatttgtccatgatatctcattgccaaatagtagacattcgttcaataaagactttgagacacatatattttctactcacagtttaacagtctttttctgtaccaccaaaataatttcagctatatgaaacaacagaaattgttgagtctattccaattagattgtgatataataccgtcgttgctcttacgttactttttgactagcaagtagttaccttctccctccatttttacagcaatacgagaattggagacccaaccagccagacagcttcttttctgctggagaagactgtgttgtaatcatttggcatgagaatggccagtggaatgatgttccctgcaattaccatctcacctatacgtgcaagaaaggaacaggtaatgatcaccctgttaataatgtgtacttaatcttcatttcaattataaagataattcaggaatttgtgtctcaaattcattgtttgagacacaaactggatatgtccatgtatgtcatctctcgttgctctggaatatttcactcttccaaaacaattgaaaagtttgttttcaacaatgttctcaccttagatttcaggtccttaagataacaatgtgacattaacgtaggaatgctgcctggtaatatctttaagaagaacaactgccagtccaaaggccaatagacctttttatttttatttatttatttatttatttatttatttatttatttattattattattgttttttgagatggagtctcgctctgtcaccaggctggactacagtggtgtgatcttggctcacggcaacctccgcctctgggttcaagcaattctcctgcctcagcctcccaagtagctgggactacaggcgtgcaccatcacacccagctaatttttgtatttttagtagagatggggtttcaccgtgttagccaggatggtctcaatctcttgaccttgtaatctgccagcctcagcctcccaaagtgctgggattacaggcttgagccaccgctcctgaccgacttctttttttattttgatgagaacattacaaaataaaatagttgtcaacagttaaaaattaggctatattttttaaatctggattttcagcttttttaagaaataagaagacctggtaccatgtggcccatattcagatttgtcggtggtttgaagtactagagctgagaaccactgccctcccttggttggggctgcaatctccatttattgcagtcctcattgagtccttcctttgttttatgtgagtccgtgtcccaatcctgaaagacacaatcccaaatgccataatcctaaatgttgaaatctcaaaggattaaaatcccaaaaatagaattctggaaaaaaacaaattttaaagacatttatttacattttaaaatgatgatttattagagaaacatataaaaacatgacagcgtgcttcataagccactttagacaataaaataaatagacaataaaaacatacatatattttcaagcataagcactcaggtatactaatggcagttggggaaaaaccaaaatgtatgaatgcacatcactctggttgtaattgtgtgcaccagctttataacggtggtcatctgaaataccatgatgaacaacataaatcttttcacaagattgatgaagaactgagatgggttaccaccgcatattcagtcactcaaagagctgagatcttgagaaattttatctttcataaatggagatgtataaaagaacatctcttcatttattgaggaagtttcaatatttttatattgagaaccaaggaagctgaagccagtactgtaactctcagtctgagaccgaaagcctcaagacctggggggcctctggtgtgtaagtcctggaatccaaaggctagtgagcctggagttctgatgtccatggtggcagaagtctgtcccagctctcagagaaagaccagcttgccttctgtatctgttctctctgggcccctggctgattggatggtgcccatcaacaatgagggcagatcttccccacctcatccactcacgctgacacattaatcttctctagaaacactctgagacgtgccccaaataatgctctattaggtttctaggtattccttaatccagtcatgttgacacctaaaattaagtctacaggtctaccccttgcaacttggcacccatatgcatgtttttaaaccgtatttaaatttccaaataaagacaataacaaggtaatataataatttctcctgacatgatataactatcctgcatacaaccaaaaatgcactaatcccttccctagaatttggctttcaggatttcaacatttgggattttaatatttcagaattatgattttggggactttagatgttagggattttaacctctagggattttggtctttaggaatttcaaaatttgggattatgacttttgagattatgtcttttgggattataattgtcaccggtttttgccaactgcctggtctctgtaggcatttgagctttttaaccattcccttagaagtttattttatgcttataaactatggatcacaaatgccatccttatatctgtagttgaatatttacaagatataataaaataagaacatgtgtaatataaattttatgagaattgtttagttaacattaaacaagaaatattttaaaagcgaattttttaaaaggtgtgtttatcattggccaatttctaaagcacgctgtacagactttttccctaaacaaatagaaattctgtaaaatattttaacctatttgcaattaataatggtgttatcacatgaatatttaatccctagacccagacttttacccatctcaaataagagtacgaagtacacatgtaaaatataaacctatttgattaatttgtctttgaatacaaaaataataaaactaaaaaccatactctataaatattttaggaaagatttaaaccccaataatgagaaattctattagaagaaagagaacactaacatacatcaagcccgagtctcatatgaaagtcagctgttagcaataagtacgttagtctgctgttttctcacccaaggtagaatgtattctcaataccttttctacatgagaagctttcctgaccatgtcccttacttcagcacctctgcgatgagatttgtaaaactagcaaatcaagtattttctatttttctttttccggtgtaggaatctttactaaattattcgtctctatccaaatgtcatgtttgccctcttatgtctccaatggtccctggagtcatacttttcattttatgatttaaacattcttacatttcctattttattttctcctatagcagggtttctcaacagcagagctattgacatttttggtcagataattctttattttgagaggctatcctgtgcattaaagcatgtttagcataatccctgccctttgtatactacatgtcagtagcacctttacatcctttctgcattgtaaaaagcaaacatgtctctagacattgccatatgtctccagaagaggcaaactgtcccacgttgagaaccactgccctataccaaaaaagattcacaaaaacaccatgattgtttacatttcccaatggataacaagttttataaaatactggttctacctcattaaagaagaagaaggaaaaaaaccctatttttgcattttatctcccctactcgctgatttttatatttgtgcagtcaattctttactaatcagaactctggggaagtttttaaatgtttataggcttttaaaaaagatacccttttctctttttagatattttaaacctacagacctaagtagttttccttttaattaactattacatacttgtaacgatttataatatatacaaaaggcatattttttaaaagaacacctcaatgcatactgcccatgtatctgtggagtatcctgtgggttcctctcaatcctatctatttacttctcaactcccaccagagataatgacttaattcccttgcttttcccttttctattatgatatacacttgtttcactaaacaataaattatttagtgttgtacatttttgaactttaaataagtgggatcatactgtatatattctgtgctttgctcttttttttgttcagcattatgtttgtgagatttattcatgttgatgcatgtaatggcatgttctttgtttttgtttctgtattgtatttcttgtataactatacaacattttacttatcaattctcctgtcagtggacgcttgagtcatattcggtgtttttgcttttataaacaatgtttctatgagcattcttgaacttgttcttggtcaacttttgtgagtttctgtaggatatatttccaggagtgaagttgctgagtcataggatatatgtaccataaaatctactttaaaaagccaaatttttttccaaagtggtggtaccaattttcactcccaccaacaatctgtgatagatcctgttgctctacatcttctccaacatttggcactattggactttgaaatttttgccaatctggtgggtataaaatgtaatctcttgtgacttaattcacattttttgatacgtctctctgaatatcttttcatatatttatcaatcacttgaagctctgcttttgtaaagtttctgttcatatcttttggttatttttgaaaattgtttacttataatcttatacatactaatttgtaggagttctttttatattctggttactaatcccttgacaattttatatgttgcaaatatcttctcccagtttgttgcttgacttcacccttaccttatgatattttctgatgaacagaatccttaattttatttattttttttcctttatgatctaatcttttttgtgttttaagaaatctttacctactgataacctacaggtcacattggcaggcttccaaattaatccgcctgggggaggtcttatgattcatggcttacatcctgtccctgagtaaacaattttatcgtgagttcctcaaatcttatcatgaattccttaaactgttgacatactgattaatatgtagcctactgacagtggaaaaacactgatttgtttctgaatcctgaagttttactgattgttttgcacatagagcattttagcttgtattttgtaaatcgtagccaatgattataacctctgtattgtaccctccaatgaaaatcacaactcgggtctgaggagttgccctcccttctgaacttccccataaaaaccttccaacttgtagcagattctggaatatgcccaaatttgtggtgtgtcttcccaggtagatcctggcatttggcttccaataagcctttatcaaattatttctgcctcaacagccttaattttggttgacactatcctgaagtcataaagatattctatagtttctaaatgttttatagttttgcctcttatatttatatatttcaaccatctagaattgatttttaatgtcttttctgaagtatggaaccaagtttattatttctgtatgaatacacaagtgttcaaatgaaaagactacactttccctctgctctgccatgttgcctctttcaaatatcaagcatatgtgtgtaaatctctttctggtctattttcctgtccttgccaataccacactcactgaattattatagctttttaataagtcttcatatttagttttagaagaaatctatacaattatttcctcaaaattataaaaatgagttcaaatttgttagcatagcaccaaatcaagtacattgaattattgaattgatcatttttaaccttccctatcactttggtcttattccatctgatacttgctattgtctggaccctagtataggctttccatattgcaataaaagaagtgtgcaccatggaatacgatgcagccataaaaaggaatgagatcatgtcccttgcaggaacatggatggagctggaggtcatcatccttagcaaactaacacaggaacagaaaaccaaatactgcgtattttcacttataagtgagagctaaacactgagaacataaggacacaaagaggggaaaaacagacactggggcctacttgagggtggaggatgggaggagggagaagattagaaaaataactgttgggtattaggcttagtacctgggtgacaaaataatctgtaaaacaaacccctgtgacatgagtttagctatataacaagcctacacatttacccctgaacttaaaagttaaaaaaaaaagtgtgcaggtatccagattgaggtcaagcagaagtaaattagaagaaccaaacatttaaattaaaccaaaatttgtcattgcagaaggatatggttgtaaacagtcctctgaatatgtaataaatttaataattgtaaacttttaatattaggatgttgacattcaaatatttggtaccaaggtttctggtaatcattttcccactgaatatttgcaatatttcatgagagaatgtggcatgtttttgtgggcctgtggtgtaagaattcttaagcaatagaaatttccacttagggaaaattatatttaagttacatttgtattaaagatatataggtaaatataataatttaatcaaagttcatttttttaaagcatatcatttaaaataagtgtgctaatgttgaataaaactatgttaacacaaattcaattaaatcaattttccaagcttttggatttttttaaaattcaaaattacaaaatttttcattgtaaatttaaaatgatggttaagaattccaagctttaccctcatttgcctgtctcaggagttttaatttatattcattaaggtatttatgaaactcaggcatgaatattatggtctctttttcttgtctcaatacagaagacaaaaaagagcaaataaatataaatggaaccaaaagatatttgtatttaggagactttgtccatatttcaaaactatgatgttattgtagattgtaaggttttttgtttgtttgtttgtttgtttgttttgttttgttttgttttgtttttgagacacagtcttgctctgtcacgaggctggagtgcagtggtgcaatctcggctcactgcaacctccgcctcccaggttcaagtgattctcctgcctaagcctcccgagtagctgggactacaggtgcccaccaccatgcctggctaattttttgtatttttagtagaaacagggtttcaccatgttggccaggatggtcttaatctcttgatctcgtgatccaccccgcttggcctcccaaagtgctgggattacaggcataagccactgtgcctggcctgtagattgtacgtttttataaggaggtaatagtaatagttaaattcattattgtcccaagtgaaggtaattaagaaataaaaacttagggacggtgatgaagacagtatgctttttaatttggaaattttgtcagaatagtggcccttccagaggggtagatgaatgtatgaccatttagtcctatggttgttttaataaaacaaatttcaagatggcataatctgagattcaaagtaggcccagagcctcaacattacattttctttttgaaaaatttcatattcttaattctaaaagattgcctttgatgaagttgcttactttggtaccataaagaaagagagaaaaataagagactcatattagttgaaatacttagattatttggaaataacccaatttgctttcctttagtcgcttgcggccagccccctgttgtagaaaatgccaagacctttggaaagatgaaacctcgttatgaaatcaactccctgattagataccactgcaaagatggtttcattcaacgtcaccttccaactatccggtgcttaggaaatggaagatgggctatacctaaaattacctgcatgaaccgtaagtggtcctttagaaagaatggactaccgtgctataacaactactagacaccttcattttacggctgtggtatcggcagtttagggtatggagcaagtaatattgtgtgttttctttttttctttctttccttccatgtagcatctgcataccaaaggacttattctatgaaatactttaaaaattcctcatcagcaaaggacaattcaataaatacatccaaacatgatcatcgttggagccggaggtggcaggagtcgaggcgctgatccctaaaatggcgaacatgtgttttcatcatttcagccaaagtcctaacttcctgtgcctttcctatcacctcgagaagtaattatcagttggtttggatttttggaccaccgttcagtcattttgggttgccgtgctcccaaaacattttaaatgaaagtattggcattcaaaaagacagcagacaaaatgaaagaaaatgagagcagaaagtaagcatttccagcctatctaatttctttagttttctatttgcctccagtgcagtccatttcctaatgtataccagcctactgtactatttaaaatgctcaatttcagcaccgatggccatgtaaataagatgatttaatgttgattttaatcctgtatataaaataaaaagtcacaatgagtttgggcatatttaatgatgattatggagccttagaggtctttaatcattggttcggctgcttttatgtagtttaggctggaaatggtttcacttgctctttgactgtcagcaagactgaagatggcttttcctggacagctagaaaacacaaaatcttgtaggtcattgcacctatctcagccataggtgcagtttgcttctacatgatgctaaaggctgcgaatgggatcctgatggaactaaggactccaatgtcgaactcttctttgctgcattcctttttcttcacttacaagaaaggcctgaatggaggacttttctgtaaccaggaacattttttaggggtcaaagtgctaataattaactcaaccaggtctactttttaatggctttcataacactaactcataaggttaccgatcaatgcatttcatacggatatagacctagggctctggagggtgggggattgttaaaacacatgcaaaaaaaaaaaaaaaaaaaaaaaaagaaattttgtatatataaccattttaatcttttataaagttttgaatgttcatgtatgaatgctgcagctgtgaagcatacataaataaatgaagtaagccatactgatttaatttattggatgttattttccctaagacctgaaaatgaacatagtatgctagttatttttcagtgttagccttttactttcctcacacaatttggaatcatataatataggtactttgtccctgattaaataatgtgacggatagaatgcatcaagtgtttattatgaaaagagtggaaaagtatatagcttttagcaaaaggtgtttgcccattctaagaaatgagcgaatatatagaaatagtgtgggcatttcttcctgttaggtggagtgtatgtgttgacatttctccccatctcttcccactctgttttctccccattatttgaataaagtgactgctgaagatgactttgaatccttatccacttaatttaatgtttaaagaaaaacctgtaatggaaagtaagactccttccctaatttcagtttagagcaacttgaagaagagtagacaaaaaataaaatgcacatagaaaaagagaaaaagggcacaaagggattggcccaatattgattctttttttataaaacctcctttggcttagaaggaatgactctagctacaataatacacagtatgtttaagcaggttcccttggttgttgcattaaatgtaatccacctttaggtattttagagcacagaacaacactgtgttgatctagtaggtttctatttttcctttctctttacaatgcacataatactttcctgtatttatatcataacgtgtatagtgtaaaatgtgaatgactttttttgtgaatgaaaatctaaaatctttgtaactttttatatctgcttttgtttcaccaaagaaacctaaaatccttcttttactacac

SEQ ID NO: 6 - DNA, 115531 bp, Homo sapiens
  source 1..115531: mol_type = genomic DNA
cgcctctgcgaagcccctgcctcgggccctgtgcaacgctttttccggtgagcggcggcggcggctcggtcctcttgctctgtgggtcgctttgctttgtctcagtgccttccgcactttggcctttgtggattctggttctcactgttgacaggtgggcgccttctgtctgccttagcacggggacccccgggaacgcgggaaggcccggggtttggcctcctgttcggctcccgggcgccctcttctggcgccgcctcgccgctcgcgcgtcaggaagcccccggcggccgccgcgggtcctcgggagttctcctggggctcgcatctgcccccatgcgatcctgagcgggcctgggccatgtcctgaaagggtggatcctggtcgggaccgctggggccctttgtagtcccctccctgctttgtcacatcctagcgctttctgatggcacaggttctggtttcctccagtatatcaaggaggggggctcattcattcttcctgtgtttggacttcttttaggagaagtgggggaattcgggttttcgctgccttcctactcctgcctgaacccagaaatcttattagccttttttcttaaaaacttttttttaatagtggtaaaatacccataacatacaacttaccatcttaaccgtttttaagtacacacagttcggtggcattagtgcattcacattctcttcagtatcatttttgtgttaaaatcattaattcagtgtgtggtccagccaagtgtttatttttttaattttaactcttacagacagtggaaatcagacaaaagcttaatttatacgatacatatgcaattaaaataccaagatttgcacatacaatgacatgattccctttaactgtctttcattgctagggaagaaatttctaacagaatcttagtgcactattagacagcactatttcctgtcattcagggacccaggtgtttttcttgcacgcatttcctgtgtatttcctttatctgttattgtgtgtattccattgatctgtctcacattttgtacacaatgcaacaagagatattatttgcttccattgttctaaaaagctttctactgcctttgaacagaaaacttgtccccactctgacggcagcccctgtacatctgggtaaggctgtgaccctccaggtcatcagtgtaagctctagcacattctctcccctctcaagttccatccttgttctgcaaggctgggtgtcttagagtcttggatctgatgatttgagctttgcatttacaagtgacatttctggtgacattgtacttacaaactcggtgtttccaattatagcatgggaggcaagaggaccaacttggattcactgatgcaaataaccgctttgttctgaagccaagcagcccgtgggcagtggcatggcacagactttagatgttggtcacattccctgcccagtcataaactcacttgaggttagtcattgatgtaatcatttgaacgaataaaagtcaagatgaatatgatctcaacccatactcctctatcaaagatagctgtggttttctaaagcgtaacctatttgctatacaagcattttcttttgtttttcttttcttttcttttttttttgagatggagcttcactctgtcccccaggctggagtgcagtggtgtgatctcagctcactgcaacctccacctcctgggttcaagccattctcctgcctcagtctcccgagtagctggactacaggcaagcaccaccatgcccagctaatttttgtatttttagtagagacggggttttgtcatgttggccaggctggtctcgaactcctgacctcaagtgatctgctcgcctcagcctcccaaagtgctgggattacaggcgtgagccacctcgcccagcctatacaagcattttttacattgtgatactatctcttgccttggaggcatctaggatctaatgtggtcctagatgtcccagctgcactatccagcctgcacagacctaacctgttaaatggagaaatagagaaagggcaagaggacaagacgtcattgtatgactattagaaatagtacactaaggatgatgccaaaaaatattcctggacagatagagaacaagaactgtctcttcctcatccatttcccttgttccctgcaaatcctttgtaattattacttattctgctgggggaataagtaggggccagcagtcttcctccatgagtcgagtctgccaggcttttcaggttgcgacctgctccccagagcttaccatactctctccatttggtctggatctcaagtgtagagctgcctaacaagcccccccaaaatttagtggcataaaataacaattgatgagttcttatgagtttatgtatcgactgatctgtaaggcacagttcttctgctccacctcgtgttggttggggtcactcatgccatgtctggcagttggtgctggctgttagctggcttgtattactctcctccacatggcatctcatcctgcagggcctctctctccatgcggcctctcaagcaggatagcccagacttcttcctatggtgctggcttccaagagggcaacgacagaaactgcaatgcctgttatggcctaggcctggaagtcacctaatgttccatctgccacatcctagtagtcaaaacaagtcacaaggccagctctgattccagagaaggggaaaaagcctccgcctcttgttgggcggagtgccaagtaatgctatagaaggacatgcagaatgggagccatgggagcagccatctttggaaacaatctacctcatccagtgagaggtgttccatccattcccatgtttaagagaaaaccctaggctgggcactgtggctcacgcctgtaatcccagcactttgggaggccgaggtgggtggatcacctgaggtcaagtgttcgagaccagcctggccaacatggtgaaaccccgtctctactaaaaatacaaaaattagccgggtgtggtggtgggtgcctgtaatcctagctactctggaggatgaggcaggagaatcacttcaacctgggaggcagaggttgcactgagctgagttcgtgccattgcactccagcctgggtgacaaaagcgagaccctgtctccccaaaaaaaagaaagaaaaaaagagaaaacccaaggaacagaaagaagttggtacagccttggcactgggatctctgatgggaaagtgggggtctatgacagtggcgctgccactttccaagtattggtgtccacattgtcaccacttgataaaccttggtgttgatgcgttctagcccctgcattcacaccaaggtacagcttggctgtacaccatgaccctgtcctgctaggccacttgtttctagctatcttgggtctggaaatctccattttgtgagtcactaaaactattaatggacaaagagattttaaagctcacaatacaatctttcagaaggtaaaaagtcatcgtgctgagagcacttgtgttagctcttgcataaaaaaataaacatttaaaattcatcccaagaagttatgcattaccaaaatattttgtgtttttgttgttgtttgagacagagtctcactctgtcacccacgctggagtgcagtggcacgatctccaatcactgcagcctctgcctcctggtctcaagcgatccacctcagcctcccaagtagctgggactacaggtgtatgccaccatacatggctaattttttgtgtattttttgtagagatgggggtttcaccatgttggccaggctggtctcgaactcctgggctcaaatgatactcctgccttggcctcccaaagtgctgggattatagttgtgagccaccacgcctggccaatatggtggtttttaattaaagtgaaaatcacataacataaaattagtcatctgaaagtgtacagtgtagtgacatttagtgcatttactaatgcacgttgtgccaccatcaccactatgtactttcagaatatttcatcatgccgtacagaaaccccgtgtccattacgtggccactccccatcccctaatccctcagcccctggcacccgctaatctgctgtctgtgtctatgaattcctctattctggatatttcacataaagtggctcatctgatatgtgacttttcatgtgtggcttctttcactgagcaaaatgcttttgaggatctatctgaatttcagcatgtatcggtacttcattcctttttaccgaaacacattgaaattagtgacatttttatacatttacaggatagtttttgtttgtttgtttgtttgtttgtttgttttgagacaggatcttgctctgtgacccaggctgcagtagtggcacgatcacaactcactgcagtctcgacctcctgggctccagcgatcctcctgcctcagcctctcgaggtacctgggactacagccacacaccaccatgcccagctaatttttgtattttttctgtagagacagggtctcgctatatagcccaggctggtctccaactcctagcttcaagcgactctcctgccttggcctcccaaagcactgggattacaggtgtgaaccactgctcccaggctgcagggtagattttttaattccattgagtcacttttcgtaactacaagcctcattcttctcggcatcagcctttattcgtgtgcaccatacagtgggttacccaagccaggcaaaggggcaaacctggatggtcccaagcagccaggtaccaaacacggtggtccgaagacccttgtcagtgttgttattaatttgaggactgatcttggagaagtccagtaccaaagagagttgccaggagacacgggtcagttgcttaagagaggagcacagctgccctagaacaagaaaggcccatggccttgacagtgtaaccagagtcccaatatttgataacaacacacaggagaaggtaacatggtaagcagtgggaattttagctcctccacaaaggaagagcctttgctctttgttctgttcgattgcttgttctcttataattggctgcagttatgaaataaccatgccaaggggcagcataaaagcacctctgttaacagatttgcagtgctgtgagctcctagtagggtgagaaaaaaaacctctggctctagataggatacttgaggttgaaaatatattgattacttaaagaccctttactcccttgcgcccaggcctctgcactccatcatacagaaactttaaaaaacattcattgatgtaatacacctctatgtatgtttatgtaaacatacacttatatgcagtcacagtaaaagatgttcacggccaggcatggtggctcatgcctataatcccagcactttgggaggctgaggcagacagatcacctgaggtcagaagtttgaggccagcctggtcaacatggtgaaaccccatctctactaaaaatacagaaattagccaggcatggtggtgtgtgcctgtaatcccagctacttgggagcctgaggcaggagaactgcttgaacctgagagacagaggttgcagggagccgagatcacgccgctgcactccagcctgggcaacagagtgagactccatctcacacacacacacacacacacacacacacacacagatgttcaggtagtggtattatttactgctttaaaagtttaggttttatagtaaaaatttaaaaatcaggcataggttgggcgtgggggctcatgcctgtaatcccagcactttgggaggccaagatgggaggattgcttggaggccaggtgttcgagagtaggctgggcaacacagcaaggccccatctctacaaaaagtaaaaatgcaaaaattagcagggtgtagtggcacccgcatgtgatcccagctacttgggaggctgaggtgggaggatcacttgagctcaggagtttgaggccacagtgagctaggattgcaccagtgcactccagcctgggtgacagagtgagactcggtctctaaaaaaaaaataagtaaaaattcaggcatagcacaaaacaatgtttagactacagtgattttctgatttatgagtgttgtgtggcaccattgtgtttatgcatagactagaatacatatatgtcagaaataactgtgtgtgtttgcattttgtctttatgaattttcattcctttggagattatccaggtaaatatacttgctaattacctcaatttattgtctaccccaggtatcaaagtcagtagatgagggaatcttagaaattatactaggctgcctgggcgtgttggctcacacctgtaatcccagcactttgggaggccaggtgagcggatcacgaggtcaggagttcaagaccagcctggccaacatggtgaaaccctgtctctactaaaaatacaaaaattagctgggtgtggtggcgcacgcctgtaatctcacctactcgacaggctgaggcaggagaatcgcttgaacccaggaggcggaggttacagttggccaagatcatgccactgcactccagcctggcaacagagcaagactccatctcaaaaaaaaaaaaaaagaaaaaaaaagaaaaaaagaaatgatagtagcacaatatgatcacacttcatgaataaaatttgacaaatatgacactacaatttattccgtttacaaggtggagtaactttgtagggctacacaattactgctattgttggaagtttaaaaggttgattttaaaaatacagatattcattattataactcagtttagctcaactcgtgtttacatttacaaaaccttagatatttagtgtaagaaatgctgacgtacgtgatctgcaaggtaagtattatgggtttagaaaggtcaacataataaaatttctcatgagaaaatcataatggatacatctcaaatcttgcaaaaaccaaagcacagtgttcccattgtcacttttacatacttcgtactgtgataaaactggagagaagacaaagacatacagctatttcttaaatgaagaataaaacaatttaatctattcaaggatttttcttataaagaaatattgaggaaacctggagttttagattattttcttggctttatttgttttttcttgatacattgtaatcatgcatatttatggtgccaattcatatcacgttgcacaatgacccaatcacggtagttagtgtacctatcacctcatgcaagtatcatttcttgacaatgcgaacatgcaaatacctctcttctagctattttattttattttttattttttattttttgagatggagtcttgctctcttgcccccaggctggagtgtagtggtgcgatctcagctcactgcaacctccgtctcctgggttcaagcgattctcctgccttggcctccagagtagctgggactacaggtgcccgccaccacacccggctaattttgtatttttagtagagatggggtttcattatgtttgccaggctggtcttgaactcctgacttcaggtgatccgcccacctcggcctcccaaagtgctgggatgacaggcctcttctagctattttaacagtaatatgcaatatcttactgttaaccatcatcatcccactgtgcacagaacaccagaacttattcctcccatctaattgttattttgtactgtcgacgaacctctccctgtgctcccttctccagtctctgtgcttctaagatatcagccttttttgttttgtatacagacagggtctcactctgtcactcaggctggagggcagtggcatgatcctagctcactgcagccttgaagtcctgagctcaaatgatcctcccacctcagcctcctgagtagctgggactacaggctcacaccaccatgcccagctaattaaaaaaatatatgtatatatatatatatatatatatatatatatgtgtgtgtgtgtgtgtgtgtgtgtgtgtgtgtatatatatattgtagagacagggtctctctaggttacccaggctggtttcaaactccaggcctcaagggatcttcctgccttggcctcctaaatcactgggattacacttgtgagccactgcacctaccctcaactctttaaaaaaaattccacatataagatcacacagtatttgtctttctgtgtctggctaatttcacttaacatgatgtattccaggtttattcatgttgttgcaaatgacaggatttcattctttttatggttgaatgggattccgttgtgtatagataccacattttctttatccattcatccatcgatggacacttgggttaattccatatctggctactgtgaataatgctgcaataaacatgagggtgcagatctccttgacacaccatttcatgtcctatggatatatacccagcagtgggattgctagatcagatggtagttagctctatttttaatttcttttttctttttctttcttttttttttttttgagacagggtctcactgtgtcacccaggctggagtgcagtggcactatcacggctcatgcagcctcaaccttctgggctcaagcaatcctcccacctcagcctcctgagtagttgggactaaatgtgtgcaccaccacgcctggctaaattttttaatttttttttttttttttttgagatggagtttcactcttgttgcccagggtggagtgaaatggcgtgatcttggctcaccacaacctccgcccctgggttcaagcaattctcctgcctcagcctccctagtaattgggattacaggcatgtgccaccacgcccggctaattttgtatttttagtagagacgggatttctccatgttgatcaggctggtcttgaactaccaacttaaggtgatccgcccacctcggcctcccaaagtgctgggattacaggtgtgagccaccgcgcccggccttaatttttttttttttaattttttgtagagatcgggtcttgttatgttgtccaggctgctctcaaactcctgggctcaagtgatcctccctcctggcctcccaaagtgctgggatcacaggtgtgagccaccgtgcctggccgattttaaatttcttgtgcctcatattgttttccaccaacaccaagtgttcccttttctccacatcctcatcaacacttgttttcttttgtcttttaaaaaatagctgttctaattagagtaaaatggtatctcatggtggttttaatgtgcgtcttcctgatgattagtgatgttgagcattttttcatgtatctgttgcccatttctgtgccttcttttaagaaatgtctattaaggtcttttgctttttttctgagacagagtctcgctcttgtcacccaggctggagtgcagtgacgcgatcttggctcactacaacctcggcctcccgggttcaagcaattctcctgcctcagcctctgggaggcaggattacaggcgcctgggattacaggcacctgccaccacgccaggctaatatttgtatttttggtagagatggggtttcaccatgttggtcaagctgctctcgaaatcctgacctcagatgatcctcctgactcggcctcccaaagtcctgggattacaggcgtgaaccactgcgccaggccccattttgttttgttttgtttttgagacagaatcccattccatcacccaggctggagcacagtggtacacacatggcttactgcagcctcaaactcttgggcttgactgatcctcccacttcagcctcccaagtagctgggacttaacatgccatagttacagtgttatagcgttttgtgttttttatgtacttactattaccactgaattttataccttcaagtgatttcttattgctcattaacatccttttcttttagattgaactgctcccattagcatttcttgtaggacaggtttgggaccgatgaaatccatcagcttttgtttgtctggcaaagtctttatttctcttttgtgtttgaagaatatttttgccagttatactattctagggtaagctttttttccttcagcactttaaatatgtcatgccactctctcctggcctgtcaggtttccactgagaagtcagcggcctccattgcatgttatttgtttcttttctcttgctgcttttgggatcctttctttatccttaacctttgggatctaagtgtttggtcactgcagctgtatctgctttagggggcaccccaagccgagtaaccctgtggttcttgcaggtggcaaaggcagccaggccagtgtcgtcccctccagggtggcgagttccccccagtcctgggcggatacagagatgccatttgggagccagtgcctgtagttgggagtcttaggaatctagttggtgctgtattctactgtggctaagctggcacccaagctgcgagacacaggccttcccactcttgcctcccttttccacaggcagagaaccctcaccccacagccaccactgccccaggcccacggggagtactgccagactatcgctcgtgttcactcgaggaccaacggccctcagtcagcttgtggtgaatatgctgccatgcctgagcctctctcttcagggcagtgggatcccctctagccctagggcaggtcaggagcccaggcctggaactggaactggggaccccaggagcccacttggtgcactactccgctgtggtcgagctggtacccaagctgcgagacaaagtcccctttactcttccctcccttttcctcaaaccgaaggggtctctgcctgtggccaccgcagctgggagtgtgctgggcccgcacggctctgagtgtcagccgaggcctgcagcaagtacggcctgggtatggctgctggttcctcagtgcccaagagcccttcagtcagcaggtgatgagtcccgctaggactgggtccttctcttcccttccggccgagggtgtctagaaatgtcgtctgggagctagggcctggaatgggggcctcacgactctgaccagtgccccatcttactgtggttgagctggtatccaagacacaagacaatgtcctccccacttttccgtgtcctctcctcaagcaagaggaaggaggggctcctggagctgtgagcggcactgcctggccttgggggaggggaggtgtaagcatggcccgagctaccccggctgctatctcactaagtcgcttgtaccccaagtccgctggctccgagcccagtccagcagcaggacttgcccgggacttgccgtccttgttgcctagactgcctttcaagtatatttcaggcccctgaatactttaggccgcagtggtgaggctttgctggagctcaggctccatccgctgaagatgggcgattcctctccggctagggctgatgtaaatcctcccttcgtgggcgcccgctaacttctgccccgtgttgctttctgctgggacacggcagcagcgctgagttccgacgcaaagccccacagtcaccgtgccctccctcccccaagtgtacagcttctctctctgcaccacgaggctgctgcggagcgggggctgggggtggggggtgccggggctgaggctggggcgcggggcggggagtgattcaagactgtccttcctacccttgtcacggcctctttcagtgatgtgaagttcaaccaggtcctgtgatcgctcacctgatttttggatattaggaaagtgcttttttgtgtggctagttgttcaatttggtgttcccgcagtggggatgatcactggaggcttctatttggccatgctgttctgcctctctctctatcttctgtgttgataaagccctttcaatattagtaagtgtatttaacacagtagagattcctgaagcttcttcatgactgttcaatttgggcctgatagcaatatgcgtttccttgtttcttatcctgtgactgagcaagcaggacattgtaacagtggaggaaaaatccccagttttccatgttctctcatccaaaaactttttgagagaaagagtacatttaggaagcaggacgaccatttagatttttactaatagcctggttttatatggttggttttatatggctatttataaatgttttgatttaacttgttaaagtgtaatatcccaaaattctatgatttatttttctcttttcccattgcaatatttatttatttatttatttattttgagacagagtctttctctgttgcccaggcttgggtgcactggtgcaatctcggctcactgcaacctccgcctcccgggttcaagcgattctcttgcctcagcctcctgagtagctgggactacaggtgcaccccaccatgcccggataatttttgtatctttggtagagacccagttttgccatgttggccaggctagtctcaaactcccaacctcagatgatccacctgcctcagcttcccaaagtgctggggttacaggcatgaggcaccacaccccgccccattccagtatttaaaaacgacttttgtgcacagaaaagagataacatgatgatttgttccccacaacttcaacttatttaatttaattaaaatttctaaacaggttaccatgtatataggaaggaaaacccacattgtatagagaccaaaatttatataatttagggttcctctttaagaatactaaatcacttgcaaatgtgtccattcatttagaaaaagataagaaatcacaacaaattacaaattttaaaaagctgacaaatacaacaaaaggcagcaaagtacaatgtttttgttcctattatattttgtactgaagctacctgtgttatcttttttccccacattttggctgcatagtgttagatcgcatcttcatctgacaatgatattgtgacataattctcactagagggaacagaaagataaagcagtcttccttccactctgcttgactgaaatgttttctgattgctatcacacagtctttgtttgtttccttatcagtaaagctgcaccagaaacttcctctgtcatttcctgctcagaggcgctccctgccccaggactagctctctgggtgtggcctgtggtccgtggtgtggcctgtggtgtggcccatcagtccgcccaggggtcactcgccctctgtgtggccagttgctgggttgctgttcctgcagcagctgccctaccctggccaggcccttactgtccctggttctctccatcccaggaccatcctaataaccgtttctccttttttctttttctttttttttttttggagacggagtctctctctgttgcccaggttggagtgcagtggcatgatctcagctcactgcaagctccgcctcccaggttcaagcgattgtcttgcctcagcctcctcagcctcccgagtagctgggattacaggtgctcaccaccacgcccggctaatgtttgtatttttagtagagaagcagtttcaccatgttggccgggctggtctcgaactcccgacctcaagtgatccgcgcaccttggcctcccaaagtgctgggataacaggcgtgagccaccgcgcccggcccatcctaataaccttgaagcctgattgtagcctcccctctcccacctgtcctcaaccatgcagggagtggagcagtgcctcacagggttcctcctcctggaagtcaaagaaaagtcaagcttttgatgaggtctggcagcccccgtgctaccactgaccagggtgtgagggtggcccaggcctctagtgcccagctggggtagctgcccagtccccaactgtgtggagagattctcaccgtggggaaactctaactttgagagtttgtcttaaaaggccagcacttttatagtatcagaggtttggccctacattttaaaatgtttttctctggtgagtctttgaagccaatcaatcagaatagtggttccatcagctgggagagcctcagcatcttcattcattcatttcctttgcaaatgggcaaaagtatcctttgggggaaactcctcccctttactctagttctagctgtacagaaaaaaagccaccatcacccagcaggatcgtctttttttttttaatttaaaaaaaaatttagggacaaggtcttgctccgtcacgcaggctggagtgtagtggcatgattatagctgactccagcctcaaactcctgggtttaagtgatcctcccacttcagcctcccaaagggttggggtttacaggcatgagccaccacgcccagccacccagcagaagaatctcatcaaaccctccagcatgctggagagtgtcaaggaggcctcccctgaggacatgagtccctcccctgtgactgtgcccggactgagggtctttgatggctacagagtttcacggtgtccctacagagttggtcagctcaggaacccccaggtaaggactggcaggcagaggggctgctccctactgtgcacagcactacagaaagtgtggatggaggatgagctgctattcagtgctgaagcttgaagctcacactggctcccacagcttcttctgccatcccatcaccttattccatgcaatccaatgtatgtattttcctgggatttctctagttattcagagcagaaggaccagcctcaaggagttcaagtagaggtcagtctcatgggggccagacaggccgagctggccaccactcactcgcttccctcccagtacaagactcagacccgcatgaccatgattgagatgtctcgggtgccctcgagccaccccccccaggagccaaattcttcccaagagtccattatcccggggacagctgtcttgtgatcctgttccctggagaacacaggcacggaacaagccctgatccccttcggtgacgactcagtagtgtgcacagccaggaaaccacagaagacaggcagaaccagttctccagctgtagctacaagttaactataaaaagacccctgggtccacagggcagggctactcggctggctctggcccaggctcttgggcacaattctggccacagacgggaagcacagagaagataaccaatggtgtcacaaacaggttttccaagatttcaatctgggagacaggacacttcatccaggcttccggtttcaaaattggaagacaaatgtcctaaggggtcttgtcagttttgtatactggcacacagccatgatttacagaaacaggacttttggtctctcaccctggaagacaagaggaactaatcaaaatgggccaaaggaccagaaacttccagtggacatcacacttggacagatgagagcttagaaagcagctcaattgctgtgaccaaagttcggctcccccctcagtgacagtcctcctgggaaggaaggtaagagactcaaggagcctctggggtcctgctgggacttcccaggccagggctgtgctccagtggcagctatcctgaggccagggacattgaggggaacctctaaacaatggaaacagccaaagagatgatgagcgtaggtccaagtgcagccaggcagcctgaaaagagaaagggaaggtggagttctcagggacaggcttcagaggaagaggagggtttaaatgagtctcttcagtagggccaaagcaagttcatttcccaagggctaaaagtctgccatgtttttatgagttgtttgggttaaacctgggtcatgttgacctagatacatctccaagaaacaccagatatgggaatcttaataagaaagaatgagcaacatggttgtgatcttccaacagaaatacagtgcaagaggccgggtgcggtggctcacgcttgtaatcccagcactttgggaggccgaggcgggtggatcatgaggtcaggagttcaagaccagcttggccaacatggtgaaaccctgtctctactaaaaatacaaaaattagccgggcgtgatggtgggcgcctgtaatcctagctacttgggaggctgaggcagagaactgcttgaacccaggaggcggaggttgcagtgagccaagatcgcaccactgctctccagcctgggcgacagagcgagactccatctccccttcccccctccccctaaaaaagaaatacagtgcaagaaagtccagtttttttctcataacaatgttctgcttaagtttggagaaaatatgcattttcttaagcttgaaataaagtttggctacttttggatggggtctttgtgtcattcctacgtcagacaccaatctatactgttgccaggaggatggcgacatgattgatgggaaaaggaaaaacttcacacaggtgactccttagagcagggagcaaagcagtgacgcctgtcagaggcagaagcttccctggcaggactaatgacatttacagtcctcattgagagaaacaagagaaaaggcacatggaaactatactatgaatggaaaatggctataaccacagatgcagacaggattttaaagtaatggctattgtgaataactttgtgccaatacatttgaaaatacagttgaaatgaacaaagtcctagaaaaagaaattaccagtattgactcaagaaaaagcaaagaccctaaatagtcatataattataaattttttgttagtaataaaatatcttccgttcaaaccaaactctaggcctagatgacttcatcagcaagatctatcaaatattcaagaagcaatagttctaattttacacaaactctttcagagaattaagaaaaagaggctccactcttgttagaaggcaaacataaccttgaaaccaaaacctgtcaaggacattatgagaaagaaaattataagccaacttcacttgtaggcagagattcagaaatcccaaacagaatactagcaatatgtaaaaaagataatacatggtgactggactgggcacggtggctcacgcctgtaatcccagcactttgggaggctgaggcgggtggatcacctgaggtcaggagttcaagaccagcctggccaacatggcgaaatccagtctctactaaaaatacaaaaaattagctgggcctggtggcgtgcacctataatcccagctactcgggagggtcaggcaggagaatcgtttgaacccaggaggtggaggttgcagtgagccgagattgtgccactgcactccagcctgggagacagagcgagatgctgtctcaaaaaaaaccaaacaaaaggaaaaaaaaagataatacatggtgaccaagatgtgtttatctcaggagtgcaaagttagtttaataatataaaatcatttattgtaattaaccaaattaatgttaaagaagaaaaattacatgatcagcagggcatggtggctcatgtcagtaagcctagcactttgggaggctaaggcaggcagattgcttgaactcaggagtttgagaccagcctggttaacatggtgaaacctcatctctacaaataatagacacacacacacacacacacacacacacacacacacacacacacaaattgccggtggtggcacatgcctgtcatcccagctacttggggagctgaggcaagaggatcgcttgagcccaggaggttgaggctgcagtgagctgagatcatgccactgcactccagcctgggtgataaagcgagaccctgtctcaaaaaaaattaaaaaaaataccaattacatgatcaccacaataagcacagaaaaagcactggataaaattcaatatccattcatgattacaaagaaaagtcaggagcctaggaattaaaatgaacttccttagcaaaggatttattaaaatagttatagcatcatcatatttaatgacaaaaagttgaaagcatcccctggagatcataaacaagaaaaggccagcgcagtggctcacgcctgtaatcccagcactttgggaggctgaggcgggtggatcagttgaggccaggtgttcgagaccagcctggccaacatggtgaaaccccgcctctactaaaaatacaaaagttagctggacgtggtggcacacgcctgtaatcccagctacttgggaggctgaggcaggagaatcacttgaacccggggggtggaggttgcagtgagccgagatctcgccactgcactccagcctaggtgacagattgagactgtctgaaaaaaaaaaaaaaagagaaagaaagagaaactgtaaaaaaaggaaaaggaaggaagctgtacctctacttcacaccattacaaaaatcaattttacacagattgaaaacctaaatatgaagggcaaaacgatgaatctttaagaataaaatgagaatagctccattactaggggtaagcaaatggttgcatgggtgttcaatttagaattgttctttaaactgcgcaatatatttgatgcactctatttcaaacagccttatcaaggtatagcctacataaaacaaagtgtgtgttgcttaaagtatacagaggctgggtgtggtggctcacacctgcaatctcagcactttgggaggctgaggcaggaggattgcttgaggccaggagtttgagaccagcctgggcaacaaacatagggaagcctagttgctacaaaaaatttaaaaactagccaggcattgtggcatgcacttgtggccccagcaacttggaaggccaaggcaggaggatcacttgagcccaggagttcaaggttacggtaaactatgattgccactgtactccagcctgggagacagagtgagacctatctctaaaataatgataataataaagtatataattttgctgggcaccgtggcatgcgcctgtaatcccagctactccggaggctaaggcaggaggattgcttgagcccaggagtttaagaccagcctgggcaacaaacatagggaagcctgggcaacatagtgagacccccatctctaattttaaaaaataaataacataaagtataccatttggtccattttgacacaggtatgcacccttaaaaccaccacaatcaaggtaatgaacatagctatcaaccctaagagcttcctcctgcatctctgtaaatcctccctcccaacactccccgtatcccaatctccgggcaaccccgatcagctttctgtcactatagattagtttgtatgttctagagttccatataatcatacagtatatcctctcaatgtggcctctttcagtgtaattattttgacatgcatttaggtagttgcctgcttgaatatcatattccttttggttgctgaatagtattcctttgcatggatgtaccacaatttatcattcaccctctgaaggacgtttgagttgtttccagtcagaactactacaaataaagctgctatgaatataaaaattcacagagaggttaattctgggtcgagaatgcagattgaacagtaaagctgtagtaaagcagctttggggagaaaaaaaggggcataactcgacatgaatgggaagggcaggggatgacacaacaggaacaaggtttggagagccggacaaacagctctccgaatgtcagagggcaagctgcagagagggagcccagggcccaggaactggagctgggggcggagggggcactaaaataaagaggactgggtgaaggttggccgcagtgactcacacctgtaatctcagcactttgggaagctgaggcaggtggatcacttgaccccaggagttccagaccagcttgggcaacatggcaaaaccccttctctatcaaaaatacacaaattagccaggcgtggtggcacatgcctgtaatcccagctactttggaggctgaggcacaataattgcttgaacccgggaggcggaggttgtaatgagctgagattacgccactgcacttcagcctgggagacagagcaagaccctgtcaaaaaaaaaaaaaggaaaagaaaagaaaagaaaaaggactgggtgaaagctggttactaatggttactaagcactctgagctccgggtgctagggtaacctattgtcccagccactttcagtgctgccagccccatgtcctctgaacgccctcagtcccaggcaaacctctctgcccgtgtgcccctgggcaactgtgcctcctccatcctgacagaaatgggggactttattctctggagagggcaaaggagtcagtgaactgtgggacaccaggtccaattgaaggcagtgaaattgtacccggagcagagcgacgctgtgagccggcactgcctgcaagcactgagcgacgtcccctcccctgctctgctcccagatctctgcaaccaggtcccggccctccaggcagcttgttacaagtgtcttctctagggaatctgatgtccccagagcttcttgtcgttctcccagactgaaaggcaggagctgccaaatggaaaaggcccacagtatgccctgcgtgtggctgacaacagagcctcccccaggcacatcaccatgacatctcagagcacggaggacatgaggaaggttcaacgagcttccaaggagagttcagtgtagaggcaggaagcagaatggccggcttatatttttgtaatgaaacggtcagtcaagtgagaaacagcacaggctcaggaaaaaagagtcgatcatcctcacaggtcctagacatgggagacacggcccggcacacgaggccccatggggaagcaccagggggtcgggaggcagaatacaggggcgacaggaagactgaggccagagcctttactggggtttccacagcaaaggcaaggccagcagtttaaagagcttaagggcacagggcttgtccctggttgcctggcgcctggctctgggatgatgaaggcagagggaggacgaaagggcctgggctgctcagtctgcacaccaaaggcctgttagcagcagggcccttccttctctctaagaattggctggccctgggaggacagtctctccagccagaaagagtttttttgttttcgtttttggagtttttagaaaagatgtctaaacattataatatacaggtaatgtatgtgcacacacacacacacacacacacacacacacacagacgcaaacacacacacacaatacacacactgcaatggcaacacctggagctaatggagcaattccctccaaatgctggaggaaaatcatttccaacctagaattccacatgtagccacatcatcaacggcatcagtggacagaaggttgtcagacatgcacgttctcaaacatttctctcccacacactctttctcagtgcgccaaactcagggggtagacaagaacaagacgacaagggctacagggacaccagtgccaacagacaggagacacaaaggagaccccgggaggagggttcagcctgaccagctcccaggcttgagggcagccagcctggaacggcaaagtgtgacttagagacagaggtgtgcagtctctggttcccatcccagccctgtcaggtgcacgactgcagacccctgtttcccaggagtcgctaacaaccttgcccactggctttcccagaaatgaactgtcagggaagccgaggccaggccgtgacccagaaactccgtccagcttccttctcctgggagccttggcctagagaaagggcaagcggttgccctttccttactcaccacttggttttctatgcatcacctttcttgtgcatttctacaaagcgagacttccctgtcactccatctaaactcacaaccctcccactgcctgtcatgctagactctggggctagaacactgaagaaatccgcaaagatgccatttcctccttgacaccgataacaaaggcaagagaggtgcaagtgtgtttgcggaagttattcattcagtgaactgacatgtgagtgccgaggatgggccaggcacttccagatgctggcttgagccctgttcttggggcacgctcctttgagcggagaagaccaaagtgaacacctctagaatctggaacgttcagtagcgataggtgcttggaaggaaggcagagctaaggcggagagcaggaccaggtagcagtggcagtggcagctgctgttccatatgtgctggatggagagggtttctcagtggccaaggccatttgagtaattgattctgatttcctttgcagcatgatatattatcctcctttgtaaatttgtccttggaactagatagcgcacattctctgtagtgtacacagtttgacacatagttttagccagcttgtttccttctcttggttttgccccaagaaaaagactgtgtcatacttctgcccatttcttcttcacctacttccagcaaattgtgctttctctaataaatgctgcccggttcataaagattcattacagttacctctttatggcaaagtggtctccttattgacataaaattatacttttttgataccatttaatgttctttgagttctgctttgccagacaccattactacttttttcattaatttacatttattcacccaaactgaaagaggttgctgagagcagatgggtctctgaagagttcagacagttgttcaattaactggcacttctgagggacaaaccagtgacccttttcttggaatggcagggccatagggcataagtcagtagctggttcacaggaaatcatccccattttcgaaataagtgattatctggaaggaaacattctggaaccaagtctagcaaactcagatgcgaggagcaacagcggtctgaacagtggcggtgagcagttctccatctacgttgttgttactgtgagaaagccaaaatgtctaaagctgtggggtaacaacaagtgaaaagctgaacaaaccgaaaaatcaacagcttttcttagacctataagaaaagctcacttccactgccctggaagttggagagacagacaggtggatacagagaatcacgactgggcagaaacatccgtgggaaccactgctggaggggagacctgaactgtaattgacgaattgctggaggctaggtatggacaaatttcagagcgaaaaacttcaggggtggccactgatggggtgagcacacttttgtgagttttacctccaggagcttgaccaggttctcacagtaaatatcagagaataacttcctcatgcttctggcagggggagggaaaaggaaccattttgaaatcattacctccaacttctcagaaaccctggaagcaaggaaggagcagagtgaaatgttttcagtgttgagagagactctgcaccgacctagaattctgtactcccggaagttatccttcaagagtgatggagaataaagactttctcagacaaataaatattgagaaaatgtgttgccagtagacctgcattgcaggaaatggtaaaagaagtcctttaaagagaaggacaatgacatagggtagaaacttggatatatgtaaggaaaggagagcatcagagagggaataaatgaaagtaaaagaaaaacgtttatttttcttattcctgattgatctaacagctaacattttcttcaaaataataatagcaacaatctatttgattatgtagcctaatatacaggtgaaatgaatgacagcaatggcgcagggatgagagggaagcattaagattattgtgttattataaggtactcacactacctgggaagtggtacagtgttatttggaagtgggcttggattagttgtaaatgtatatggcaaactctagggcatctgctaaaaaaggtattaaaaaagaagtatagctgatatgctgagaaaggagagaaaatagaatcatatgaaatgctcaattaaaaccacaaaaggaagaaaaggagcagaaaacaaaaatagaaacaaaagcaaaaattagaaaacagcaccaaatatcattaaatgtcaatagtttaagtacaccaattaaaagacagagattggctgggcatggtggctcaggcctgtaatcccagcactttgggaggccaaggtgggtgcatcacctgaggtcaggagttcaagagcagcctggccaacatggggaaaccccgtctctactaaaaatacaaaaattagccaggcatggtggcaggcacctgtaatcccagctacttgggacgctgaggcaggagaatcacttgaacacgggaggcagaggttgcagtgagtgaagattgcgccattgcactccagcctgggtgacagagtgagactccgtctcaaaaaataaataaataaataaataaaataataaaagacagagattgtcagaggaagtcacaaaacatgacccaattatatgttgtctacaggaaacccatttgacatgtagacacctgtagattaaaggtaagtggatggagaaagatatatcatgctaacagataatcaaaagaaagcaagcagcagctatattaatttcagacagagcagacttcaaagcaaggaaagttatcatggataaaaaagggcattacaggctgggagcggtggttcacgcctgtaatcccaaccctttgggaggccgaggagggtggatcacctgaggtcgggagtttgagaccagcctgaccaatatggagaaaccccgtctctactaaaaatacaaaaaattagccgagcgtggtggtgggtgactgtagtcccagctactcaggaggctgaggcaggagaattgcttgaacccgggaggtggaggttgcagtgagccgagatcgtgccattgcactccaccctgggcaacatctcaaaaaaaaaaaaaaaaaaaaaaggcattacataacaataaaggggtcaattctccaagaatacacaacaatcctcaatatgtaagtgcctaacaacaaagtgttcaaatacatgaggcaaaaactggtagaacgacaaggagaaattgatgagtccattgacaaagttagagacttcaatacccctctgtcagaaattaacagatccagcaggcagaaaatcaggaaggacatagttgaactcaccaacaccatcaatcaacctaatataattgacatctatagaatactttatccaacagcagcagagtacatgttcttctcaagctcccgtgggacattcaccgagatggaccacattctgggccataaagcacaccttaacaaatgtaaaagaataaaatcacacagtgttttctctcagaccacattggaattaaacaagaaatgaataacagaaagataactggaagtccccaaatacttgaagattaaacaacatgtgtctgaataacacatgggtaaaagaagaaatctcaagagaaatttataagtattttgaactaaatgaaaatgaaaacacagcttactaaaatgtgtgggatgctgtgaatgcagtgcttagagggaaatttatagcattgactgcatatattagaaaagaagaaagatctaaaatgaataatctaagcttccaccttaggaaactagaaaaagaagagcaaattaaattcaaagtaagcagaagaaaaggaataataaaaattatggcaggccaggcactgtggctcatgcctgtaatctcagtgctttgggaggctgaggcagaaggattgcttgagctcaggagtttgagaccagcctgggcaacatagtgagaccctatctctacagaaaataaaaataaaataaaatttaaagtaaaaattatagcagaaatcaataaaattaaaaacagtaaattaatagagaaaatcaatgaaatcaaaagctggttctttgaaaagaataatacaatttgtatggctctcgctaactaggaaaaaaatagagaacacaaattattagtatcagaaatgaaagagagaacatcactgtggatcccatggacattaacaggataataaagaaatcctatgaacaactctatgcccacaaatttggaatctacataaaatgaatccattccttgaaagacacaatctgccaaaactcacacaagaagaaataaacaatctgaataggcctatatcttttttttttttttttttttttttttgagacagagtcccactctgttggccagactgaagtgcagtggtgcaatctcctctcacggcagcctctgattcccaggttcaagtgattctcttgcctcagcctcctgagtagctggaattgaagatgcccaccaccacagctggctaattttttttgtatttttagtagagatggggtttcgccatgttggccaggctggtcttgaactcctgacctcagatgatctgcccactttggcctcccaaagtgctgggatgacaggcatgagccactgcgcccagcctgaataggcctatacctattaaagaaattgaatcaataattaataaccttccaaaaaagaaagcaccaggcccagatgggttcattgttgaattctaccaaacatttaaggaagaaattacagtcatgtggcacatcagagccttccactcaatgacagaccacatatatgatggggattacaatgcttaggatatgtttagatacacaaatacttaccattgtgtcacaattgccaacaaaattagtacatgaacatgctgtacaggtttgtagactgggagcaataagctaatccatataggctacaatttaagtttgtataagtacactctgtgatgttcacacaataatgaaattgcctaatgatgcatttcctggaacatatccccatcattaagtgatgcataactgtataccagctctttatgatctctttcagaagaagctgagagaatacttcctaatgcattctatgaggctagcatcaccttgatgtcaaaaccagaagacataccaagaaaactatagaccaatatccctaatgaacatagatgcaaaaatcttcaacaaaggattaacaaatagaattcaacaatgtatacagagaattatgactatgaccaagtaggatttatcccaagtaggcaaggctggctcaacattcaaaaatcaattaaagaggccgggcgcggtggctcacgcctgtcatcccagcactttgggaggccaaggcgggtggatcacctgaggtcaggagtttgagaccagcctgaccaacctggtgaacctctactaaaaatacaaaaattagctggctgtggtggtgggtgcctgtaatcccaactactcgggaggccaaggcaggagaattgcggaggttgcagtgagccgagatcacgccattgcactccagcctgggcaataagagcgaaactctgtctcaaaaaaaaaaaaaaaaaagaaaagaaaaaagaaagaaagaaaaatttgtccaagcgtagtggtgtgctcctataatcccacctactcgggaggctgaggcagaagaatcgcttgaaccttggaggcagaggttgcagtgagacgagactgcgccattgcactccaatctgggcgacagagtgagactctgtctcaaatcaaacaaacaaacaaaaaacaaacaaacaagaaaattgggtcgaaaatctttagagaaacctccccaaagaagatagacagatggcaaataagcatatcagacgatgctccatatcatacattatcagggaaatgcaaattaaagcaacaatgagacgccagtacacacctactagaatggccaaaatccagaacactgataacaccaaatgctggtgaggatgtggagcaatggaaactcattccttgctggtgggagagcaaaatggtatagccaccctaaaagacagtttggtggtttcttataaaactaaacatacacttgccagatgatccagcaatcacactccttggtatttacccaaaggagttgataagttatgtccacacaaaaacctgcacatggatgtttatagcagctttattcataattgctcaaacttgggagtaatcaagatgcctttcagtaggtgaatggataaataaacggtggtatatccagttgatggaatatcattcagtgctaaaaagaaatgagctctcaagccatgaaaaaacattgaaagaagcttaaatgcatattacaaagtgaaagaaggcaatctgaagaggctacagactgtaggatttcaactctatgacattctggaaaagataaaactatggaaacagggagaatatgggaattctctgtaccttcctctcaattttgctgtgaacctaatagtgctctaaaatataaagtctttaaaaagaaatctggccttccctctccctcaccctgcaggggcaggtcctgttgcctgcctgtcccaggatccaggctcagctggtttctggctgggtttgaccataggagacccgagccggagactagagggaagaagaagtggggggagcagctcggcggcagctgcagctcctaccaaaaggcccctgtggttctaggccttctctctgtggccccccaacctcgggtgggctgtgctgatcccctatcaacctccaagtagtcctgggtaccctttccctggtatttagtgccctaagtcgaagtggtttctgttttcctggggcgactctaaactgatgaaatagtcacttggagactgatatgatttggatatgtgtccccacccaaatctcatgttgaattgtaatccccactgttggaggtggggccaagtgggaggtgattggttcacgggggtgggtttctcatgaatgatttagcaccatcctcttggtgctatccccacaatagtgagtgaattctcaccagatctggttgtttaagagtgtgtggcaccctggagccccagctactcaggaggctgaggcaggagaatcacttgaacccgggaggcataggttgcagtgagccgagatagcaccatccactgcactccagcctgggcaacagagtgaaactccgtctcaaaaagaaaaaaaaaaaaaagtaaccccgacaatgtaaaattaaagtgtagctgatgcaaaatggtcaaagataactttactagtgaaagctaatggaacaagagatttaaatgtattatttaaacatacaaagaactaaagataacagtggatggtgttacatacatggtcatatatcaggtgtgggggtccccaataccacctgcaggaacacccaggcctgctggagttaactcttgctacacagaaagaggagagaaatgtgtcccatccagcaacaaaaacctatccttccatgttttgtgtataggttgacgctaaaacctgaaaagcaaaaacaaaaattcacattagaaagtctatgtaaatattttcagtgccaggtcaagaagaggaatgctaggattatatttctttcttatacgtctaattcgatagtccctgagtcatttgaaaagagaactttcctagcacccaggtcccaatgattctcttcttaccatgaattaggaaaattatgatctattttactttacttctggcttttttcttttttctttattttatttttattttttgaaatggagcctcgctctatcacccaggctggagtgcagtggtgcaatctcggctcactgcaacctccacctcccaggttcaagcaattcttgtgcctcagcctcttgagtagctgggatcacaggtgtgcaccaccacacccagctaatttttatatttttagtagggacatgttggtttcgccatgttggccaggctggtcttgaactcctggcctcaagtgatctgcccacctcggacccccaaagtgctgggattacagacttgagccactgtgcccggcctgcttcttgttttgatcataactttcttttttttttttttttttttgagatggagtctcactctgtcgcccaggctggagtgcagtggcgctatctcggctcactgcaacctccgcctcccgggttcacgccattctcctgcctcagcccccgagtagctgggactacaggcacccgccaccacgcccggctaaatgtttgtattttttagtagagatgggatttcactgcgttagccaggatggtctcgatctcctgaactcgtgatccgcccgccttggcctcccaaagtactgggattacaggcgtgagccacggctccttgcggatcataactttcttgtatagttctttccttctggtatttttaattgcttttccttattttcttgtactatttgccatcatcgtatccaacttcagactcccaatcacaccatctaatatgttgaattcacatatacacaattttttttttttttttttttgagacggagtctcactctgtcgcccaggctggagtgcagtggcgcaagctcggctcaccgcaacctctgcctcccaggttcaagcgattctcctgcctcagcctcctgagtagctgggattacaggcacccgccaccatgcccggctaatttttgtattcttagtagagacggggtttcgccacgttggccaggctggtctcgagctcctgacttcaggtgatccacccgcctcagtctcccaaagtgctgggattacaggcgtgagccaccacacccggctatacatatatatttaattcttggagtcctctctcccagagcctaccattctcctactccaacctggactgattgccaaccaggctttctgcccagttggcatccctggtatttcccatcacagctctcctggattagatccattgtcttatggatcccacattttcctttttcttggcttgcacccttgatttgctgcagagcatccccaagtagcttcctaagaaagtacatttcagaggcaaattttcttagctcttgtgtatctaaaaacatttttattccattatcacacataatggatattttggatggtgtacttctatgtggaaaatcattttcccttggaatttggaaagcattgccctattatctttttcttttcttgttgtcctgtgatcttttatcattcagtgttgttatgaactctggtgctactctgattcctgttcctttttctttatttcatttttccataattcttgttagttgcttgccagacttcctagatcactcctcaaagtcctcatattttctctcatatctttgtctctattgttttgttctattttctgggagacttcttcagttttattttccaatatttctattgaaatttgaatttcaataattccttcttgttctctgattgctctttttacataatattctgttcttgttttatgaatacagcattttcttttagttctgtagatatgttaattaaattaaattttttgatacattccctgaattttcttgaattccaagtttatattttttctacaggtttatcttgactctttttcctgttgaaggctttcatcaaatttctgataatatttactgactggtttatatttaataaggaaggactggataagtattgtggatttaatctgctgttgggcaaataggtctgttttcctgctgtgactcttctctgtgtaggacagggaggtgacgaacagagtatcccctagatgccggaatgaggaaacaattgttcaggggttgtcagcatccatgctggaagccttagctctccaccgacatttcaatcaatttctttacagaactgtcaggtgttttccctgtaggtctgtgccagctcccagctcagctgtctggtggggagaggaggttccaactggtacagtcattctgtactggtgccttcaattaatccccatgtgttcagtcctatttaattctatcgttttctaccacatgcctactgattctgattgtctggtgttatatctagcaaactcactcccacttcttctgtggctcccttgtcaaatattctcacctggatttttactgcctattttattcatcaatcaattcccatatgctttctataaagttgttgtcctttgatgataacctctcatcctcaccacattctcttcactctggtgggtttattcctttcctttttttttttttttcagacggagtcttgctctgtcacccaggctggagtgcaatggcacgatctcggctcactgcaacctctgcctcctgggttcaagcgattctcctgcctcggcctcccaagtagctgggattacaggtgcgtgccaccaggcctggctaattgtttgtatttttagcagaggcagggtttcaccatgttggccaagctggtctcgaactcctgacctcaagcaattcaccctccttggcttcccaaagtgctgggattacaggcatgagccaccacaccctgcctcctttctgtttcttgacattcttcttttagtgcacttctatgagtaaagaaggaaaactgtgtgtgtgtgtgtgtgtctgtgtctgtgtgtctgtgtgtgtgtctgtgtgtctgtgtatgtgactgtgtgtgtgtgtctgtgtgtctgggtgtgtgtgtgttcatgcacatctgtgcctgctcatggtgtcttatatcagaatttattcatttcttatctattttctaacaaatatggttaaggctattaatttttctaggtgacctctgtagccttatctcctaggttttaatatgtagggctctcaatgttggtcatttcttttgtttttagagacaggggcttgctctttctcccaggctggagtgcagtggcatgatcccacctcagcctgttgagtagctaggactacaggtgcgcacgtgcccagctaatttatttcatttttgggaaaaacggggtctcactttgttgcccaggctgatctcgaactcctgggctcaagcgatcctcctgccttggcctcccaaagtgctgggattacaggcatgagccagcgcccctggcctggattagctcttctgaaatatatatattctctatcagtttaagagatttttagacaaatggagtaaaagtttgtgttgtttgtcatattgataaaatccttctggttgtgggctttctgtcaattaccatctatactagattttcctggtttttatcttctacagtcctgtttttaagaggaccttaaactattacagtcccattttttaaattactgatttttaattctaatagtaaataattttgattatagtatatttttcttttttttcttttttttgagatggagtcttgctctgttacccgggctggagtgcagtggcacgatctcggctcactgcaagctccgcctcctgggttcaccccattctcctgcctcatcctcccaagtagctgggactacaggcgcccaccaccacacccggctaattttttgtatttttagtagagacggggtttcaccttgttagccagaatggtctcgatctcctgacctcgtgatctgcccgcctcggcctctcaaagtgctgggattacagacgtgagccaccatgcccagccgattatagtatatttttctacttttcaatggcaagtgtgaaactgtataacttaagttccttctattcaacctaaggaatttagcaagattctcttcattattttttaatatttcaaaaacttcttgagttctagtcttgtacattattctttccaatctagatttaagttgttatagcccatgaaacttcttgacttttgattgagcaaagaatttccagagttattgatgaagaattaacatttctataatgttaatgcttcccctccaggaatacggtagcgtctgtttttgtttttgttttcttcaggtcttcttttagatttttcagtaaagttttatagctttttgatgcaggttttgacatttcttattaagtttattcccagctgttttataatttttgtagtgagagtgagttgaatcttttttccctcattacattttccagctttttattactggtcgtgtttacatgcctgcatcctaacaccggggaactgacttgaaatgggcctttctccccgcagagacgcaccaagaatgaggtttaaaagagaatggaagaaggatgtatgtggggctttttatttttgttttttaattgacacatatttagggagtacaatttgatatttcaatatatatttatgttgcacaatggtccaagcagggtagttaatatatccatcagctcatgcatgtaccatttctttgttgtgggaactttcaaaagtctctcttctaggtattttgtaacatacaatatattgctgtcaaccatagtcaccctgctgtgcaatagaacaacataatttttttttttgagacagaatctcgctgtgtcacccaggctggagtgcagtggtgtgatctcagctcaccaggttgctctgcctcctgggttcgagcgattctcctgcctcagcctcccaagcagctgggactataggcacccgccgccatgcccagctaatttttgtatttttagtagaaatggggtttcaccatgttggccaggctgcactcaagctcctgacctcaagtgagtcacccacctcagtctcccaaagtgctgggattacaagcgtgagccactgcacctggtcaaaacaccagaatttattcatcttatctaataataactttgtacctgttgaccaacctctgcccatcctcctctccccgatcctctccccagtctctggtaactactgttctactctctgcttctatgatatcaactcttttttgtttttgagattccacatatgactgagatcatgtggtatttgtctttctgtttctggtttatttcccttaactttatgtcctccaggttcattcatgttgtcttaagtgacaggatttcattcttttttatggccgaatattattccattgcatatatgtaccacattttctttatccattcacctgttggtggacacctaagttgattctgtatctggctattgtgaatagtcattcaataaaaatgggagtgcagataactcttccacatactgatttcatttcctttggatatataccggtagtaggattgctggtagttctattttcaatttattgagaaacctccatactgttctccatagttgactatactaacttactaccccaccaacagtatgaaagtattcccttttctccacatctttgccaacttgtcttcttttgtctttttgattaaagccattctaactgaattgaaggggtatctcattgggcttttgatttgaatttccctgatgatgagtgatgttgaactttttttcccctccctccctccctcccttccttctctttcttttttcgagacagggtctcactctgtcacccaggccaaagtgcaatggcacgatcctggctcattgcagcctcaaactcctgggctcaagtgatcctcccaccccagcctcccaagaagctgagatgacaagtgtgcacaaccatgcctggctaattttttgtttttttagagacagtggtcttgccatgttaaccaggctggccttgaactcctggactcaagtgatcttcccacctcggcctaccaaagtgctgggattacaggtgtgagccaaggtgcctggcgagatttttcccatatacctgttggtcatttaaatgttttcttttgagaaatgtctattcaggttttttgccctctcctaaccttttattttatctatctatctatctgtctgtctgtctgtctgtctatctatctatctatctatctatctatccatccatccatccatccatccatccatccatctatttcgagatggagtctcgctctgtcacccaggctgtagtgcaatggcacgatctcggcttactgcaacctccacctcccaggttcaagcgattctcctgcctcagcctccagagtagctgggactacaggtgcgtgccaccacgcccggctaatttttttttgtatttttagtagagatggggtttcaccattttagccaggatcatctcaatcccctgatctcgtgatccgcctgcctcggcctcccaaagtgctgagattacaggcgtgagccgtcgtgcctggtcacctttttttttttttttttttttttaaagacagggtcttgctttgttgcccaggctagagtgcaatgtgcaatcatagctcactgcagcctcaaactcctgggctcaagtgatccttccacctcagctttccagggagctgggactacaggtgtgtgccaccacgtctgtctaatttttaaattttttttgtaaagacggggtcttgcttcttgctatgttgcccaggcttgtcttgaactccagttctctgatttttaaaaaaaatcataagtagatgttgaattttatcaaatgctttttctgcatctattgaaataattatgtagtgtttttccccttaagtttgttaaggttgggtttctaattttaaaccatatttgcattcttaggataaaactcaactcggttgtgatagatcatatactgcaggattcagtttatttgtctagaattttaaaacttatttccacatcttgtgtcatacttttcttggctcatcatagtagatatattagtctagtaaaataagtttggagacatttatttcttttctgtgtatgattggaattgcctactcattaaagatttggtagaagtcatccataaagccctcttggtctgtttctctctctctctctctctctctctctgtgtgcgtgtgtgtctgtgtgtgtctgcgtgtctgtgtctgtgtgtaggaggatgggtagctttttaaatacatagtcaatttcattgtggttacagggattttctgtttctaaagtcggttttggtaagctgtactttcctaggaatgtattccttttgcttatgttttcaaatttactgacacacagtgcataataaaaccttttcatgagtaacataatttacttttctcttttctctttatatccagcttgttagagggttggcttttgtttttcagcttttcaaagaagcaggtttaaaattttctcaatcctctccatcatttgtttctatttcattaagttttattcatccttatttttctttcttctacttttgcaggcttactctgtcatttctttatggcttcttgaattggatgttcagcgtgatgacttttggactgctttagccgcatctctatacttcagcatcgcacacccaatggcttactcaacatctccactttcacaccactgggcaccccaagcttaatacagccaaagcagaactcttgatctgcacctctgaaaatgtacttttcctgtagttctccccactatggtgaaaagcacccttatttccccagttgctcaggccccaatctcaggaatcatccttgtttcttcccttgctctatgccctacatccaatccttttgttcagttctgaaaacatatcttgaatctcacaacttctcagagctgcactgctgccaccctagttaaagctaccatcaactctttctcctagactgttccagggccttgcaactagccttgtgctgtagttttgtttcatcacgtccagttctccactctacacctgcaacatagatcagacagctcctggctcaaaatcctctgagggcttctcatcttagaataaactctcggttctggccgggtgcggtggcttacgcctgtagtcccagcactttgggagtccgaggcgggcggatcacttgaactcaggagtttgagaccagcctgggcaacatggtgaactcccatctctatcaaaaatacaaaaacttagccaggcgtggtggttcgcatctgtggtcccagctacttaggacgctgaggagggaggatcgcttgagctcagggtggacgttgcagtgagccaagattgcgccactgcactgcagcctgggtgacagaatgagaccccatccccaccccccccaaaaaagaatgaactcccagttctcatagtggccccagctgcctttccaatcacattccctaccactctccagcaacactgacttcctcgttagtccccaacatgccaggcatagtctctcctcatgtcctttgaacttgcctggaatgttctttccccagatattcatatgagggagtaaaatgagggtgaaaaccagcagatatctaaatagcacccccttcacttagtttatctttctcaaagcccttatcactatgtgaaatgatatattatacttatttgtatgctagtatgaatcttcccggcaagaatgttagtttgctgtctgttcagtaccgtgcatccagagcctggaagagtgcctggcacatagcaggtagtcaataaatgaatgggggcaagcagccaaatcagaatcaggttttcttgctaagcatagaactaacagaaggatcattgaatggattggataatgactggcatcagggtaaggtccccttaacaaacactcctgtcctgaacacctggttagctaacagttttctcatactcttattttcccaaaacacaattgctggatctcagctccaaatcaactcttctaggaaagtgaaaaattgctggatctcagctcccaaatcatatcttccaggcagagctaacattgccccttattcacacctccaccaaaccatctgatccaacagtgacaggtgtcacgaggccttggcatgcactctcttcccccgccagagttctgcgaaagccagggttgcgatttgttgtcagtttattccccgcctctatgagagtgtgagcactgggcaggctcggatgaaataatgcattgagtaggcctctgaaaccaaggcccctcagctggggcaacgtcaggctccagggtgggcaactttgctgcttctgccgaagatagtgatattgagaaaatgtgggtgcaatgaaacgcttattgcagcgcactcggtgcatctgtggacagagggtcaatcgcccctcagagcagcgcaaacaggcgtcccaagcctaggccttcacttgccccagcatccgcaagggtccattaatccttaacattcaaattccgcccactaaaccagtccctccgcgcccaagccgcctcttttccccaaacgacggccgaaagcagccaatcaacagctggaggggtccgcccccttttccctggccgaaatggacaggaaatctcgccaattgacggcatcgccgctgagactcccccctcccccgtcctccccgtcccagcccggccatcacagccaatgacgggcgggctcgcagcggcgccgagggcggggcgcgggcgcgcaggtgcagcagcgcgcgggccggccaagagggcggggcgcgacgtcggccgtgcggggtcccggcgtcggcggcgcgcgcgctccctcctctcggagagagggctgtggtaaaagccgtccggaaaatggccgccgccgccgccgccgcgccgagcggaggaggaggaggaggcgaggaggagagactgtgagtgggaccgccgtggccgcgggcggggacccttgccggggggcgggggtcaggggcgggacgtggcgcgggaggggcccgcggggtcggacgacacggctggcggatggcgtccctcctctctaccctccccctcccgccgccgccggtggcgactctcccctcggcccgtcacccctgctcgcgggtgaccgtcctcggcgcggcctccctggagccgccttcgcctgacgcccctcttcctcccgccctcgacgcgcatcccggcccccggccccgcgggcgcccctgtcgccggggcttcgcctgtcggggctgcgcgcgctcctgcccttctcggggctttgggccgcggcgccgtcgcgcgcccgcggccccggcctctccctggatcgcgctctccccctccctccctcgcgcgccccctctcccgttactcggcccccccaccggcgcgcgtgcgcacttcgcctcccgtcgggagagtgcgccacaagggctcctgagctctcacccccatctctgggctttgcctccccctccttctcgcccattccatgaatttctgccccccgctacccccccgcgagcgagtaggtccaccggctcctttccccatctagcaggaacaagtaggtggggattattatccacaaaagggactagacattgtgttctgggtcccacaactcatcataaagaggtggttatagttcccatcaggagccgtgggtaggggactgtgcgtccagcagcacccgaggctcttcggcgccagaggctctaaggtgcgagcgtgtccccagggtgctcagaggttctttggagtgctgtggcctcggaatgtgagcaccctcccatcctaccctccccttcgccggcgatcttccagttacataagtggagtgggacatagtaggtaacgggctctcatcgccctggagcgctcgggatcaccggtaccagatggggcaagttcatcgcgacgctgtggctcctgttaattgtgcctgaaaggttatcctctgttcagtttggtcatgaccgaatcacccaaactgaaactcagatgacttttatatggcagtggcaatgtttctgtggttttgcactaaagacttaaggtcattatgaagagtgtaaaaggattgctgtcgcaggggagaccgtttatgacattgctaagtatggaccccgagggggaaaaagctcattctggaattgctctgtggcggttgcttctgttgcgagtgtgttcgggtgtgggttggtcacagcagaaatgggctccaccacaaaattgatattcctgactcatggtcaggcagatgtgtgcttctggttatttttccaggaacaggaatgggctctgccgagcctttcacacgttgtgtctctgctgtgcgggatcagtaccccagactgtgagataacaggatcgaattcaggggttggttggtgatccaggaaccatacctacttggatgtgatactgagtggcctagacgttgtaggactctcataagttttagacattttgttatactgtaaaaatgaagcatatacggcctcagtagtaacattgcactaataggtaattattactctagagaattttgggttccatggctggaatgttcatcagtatctcagcaatttcagttaataaccagattaagctgacctcttgagtcttttgaaatctgctgggtccctataataagacagggtctggattttttaatcttttgggaatttccaccaaggatttagggaaataggcttttatgggcttttcaggatttctatttcaaatcccaatgaggaagtctaggaaacacttgcttttattttcttgcctgaatatgtcagaaccttaaatcacccaatcaatctagaagtactacagttgattaaagtaagtcaccacaggtcacccattcgtggcaggtcagctaggtggctgatcactggaatacagtcatatccccaggcatacacacgagcctcacttgacgatcccaaagtttgtacatctgagcttgagacgtgacaagttgaggtctctgctttgttcttcatagttggcagtttgtctcctcgggtgcccctccggttagctgtttatcatacgtctagccctatcaacagtgcaggcagcttccagagtatagttttctctgcaaagtgcctggtggaggggtacctccttttccattgtcctaatggctccactgggcttccataccagccctttccagtgtcttaacagctcaaagaaacccatctgtggctttcttgttagcactggcctatcacaccttcctattgcctgttaactaaaattttgcctggaatgctttaagcttagagtactgggtctttgtttcacccgattgataggagagtgtcatgcagtcagccgaactccgacttctgtgctgtttaaatccttaggtaggtctggggcaaggcacaaaccactgtgtattcaaagggttatggtgcttgcattctgtgtgtatatgtttgtaatttccaaccagagtcgtttcccgtgcctgccctgcctctgtgcaatctagtctagtagggtagggaggcaagctgtggagtttgaaaaaaaaaaaaaaaagctagatgagtttaataggctgttaccccctccagaacattcctcccatgtggagatgaaacgagaagttcatttctttaacctaaaataaagaacaacagagataaaattgttagttccttattggagcctggtttccattgctaatgtacctgcttgggactctgcatgataaatgacgtgtcctggaacctgaaatcttttataaaggttaatatcagcagaaatcttttaattagctaagagcagcttgttctcaagctgcccgagttatcttggaggagagaatcacaggaaatgtttgatatttctagtaaccagtgttttcagtgcgtggggtaaagcacactcctagactggccagtcccaaagagtgtggcaggacacctgcttgttttccctgccctctgctatggtgacatccttgcagaccagtcttgcgtggctggcagacgcaatctttttttcttgggtagagcattatcaccgctgcgatggaaggaccttgtcctcggtgcctccataccagccctttccagtgaaactactgctgtcccggcaagcccctgtgcgtgtgcatcattccgggtaggacaagatgtgaacaggtccctcttctttgggcttaagtagaagttgtgctcttctgcttttacctgtgtgctcttctgcttttacctgttctcttctgcctttctcttgcaagaaacctgtcgaaagcttgctttgcatgccattgcttaaatactttgatggtatgtatggtatgtgggataactgagtgggagccggaattggggggtgggcagggcatccccacccccacccccacatcaaagggggaatgaccatttcgttagagaataaagcctgagtcttataacttcttcaagcacatgtatgctgggtctcctggcgtgtgaatgtgttcccgctgtgctgtgtggctgttttgcagttactgtagacactgtagtctgggctctcattattgcctctgaagttgacaggaccaagccttagtaaggatgcacttgtcttcctagcccaagagctaggggtgttttatatatatattaactttcttttttagatttcataaactgctctcattttctcttttctttctttctttttttttttttttttttgagacagtctcactctgtcacccatgctggagtgcagtggcacgatctcagctcactgcaacctctgcctcccgggctcaagcagttctctgcctcagcctcccaagtagctgggattacaggcacctgccaccacgcctggctaatttttgtatttttttttttttttttttttttttttagtcgagacggggtttcaccatcttggccacgctggtcttgaactcctgacctcgtgatccacccgcttcagcctcccaaagtgcagggattacaggcgtgagccaccgcacccagcctctggctcttttctttttgacatgaaatcttaagttaattatcttaaactttaagaactagaaggattcttagtccagcaccatcagtttacaaacaaaaaaaacttgtgtccctgagaagttgtgacttttccagggcctcctagccaggataccagtttggtttttattatatagctagccgagtaatactattaacttgacttctgggatttcaaagtattctatgacttgactgtttaagggaattatgaggcctcactgaacctcaaaagataattttaggtaccatcctggtagctgtagagcagcaacagaccagtaaaagacttggttggtgttgcccttcttctgggtttgattacatgagtaattgtgtgaatagtctctaagttgtatgctctgagctttcgtttttagcttataaaagtgctactcttgggccagcatagtatcagaaattagctaattcatatggggcagtttaggctttaactaggaaatgatggttatcttaatgacaaaaaaggtactgacaaaagtccttttttgaacatgtgttcaaaagaaaaagagaaactatcaaactaataactgagtttgttgaacatcgagattgactgatctgagaggcttaaaactgattgccctgaaatagacttgcatgttttggatgatggctttgggtctcccagagcacttggtttcccttggtgctgattttttctctcaggattaaagcccctttatgtgatgttgttacagcagcttattgcaacttcattcagctgcttgaaaaagaagggagactgcctctaggttccatgtgttctttcagggatggtattttgatgttgcgtattctcttgaacatgtattcttccctgagaatttctgtgtgccgtggtagaagaaatacttgccagaaatcgccactcatggtatgcttttgtagtgtcgaagtgtcccctagaggtgacaaggcttgtgatagtgttgattctaacaagcatgaatctttcctttattttagcactgtgtgttacgtgccagtaatttgcagcttatcctttgtttctagctaggtaagctgggaaatagcctagtactttgtctatgtgtttatcttcaaaatgtcccaaatagccctgggaaaaaggtcgtgcagctcaatgggggctttcaacttacaattttctttgttttaggctccataaaaatacagactcaccagttcctgctttgatgtgacatgtgactccccagaatacaccttgcttctgtagaccagctccaacaggattccatggtagctgggatgttagggctcaggtaagtaaccttcctttttttttttttagtatatgtcctggtttggccatctgttttttttttttttaaaaaaaaaaaaaaaaggaaaagaggaaaaaaatatactactcttggacagtataaaagtaccccaaagactaaagacataactgtgccaaactgtgccatataataaaaaaaagtcacttccctgagccctgaaaggtcagtgtgtgtagggttacttggtcgccacagcgtgatctgggggcgggcgtcagattagagccggaactggtgatctgcaacttcagttcaccttgaagcaggtcagctgagctgagagcgcttgcactgagcccttttgcgctgctgctgttgccttagcggtcttcagcatgtgtttgctttggtttggggtaaatggcttagtggtcaacattagtgagcagtggtaatgcattttcagatatgggaactggtatgtggttggttccctagaaggacaccctcctgaaagctgtctcagaacaccgggggccatggctaatgtcatgtgcttgctacactcctcccatggtaactaaagagagtacccagatatacatctggttcttgggactctagaggaggatgagtactttgtaaaaacctgggggccccagtcattctaggtctgacactcaggtgctgtatcagctgcagtttgaactacttggcaccattgtgtggactttagttttgtaaaaatgaatggttccttaatttctcaaccttcaggctcaacatctcaagctgtttgttgttgttgttgttgttgttgttttgttttgtctttttgattagtggtcactccgcatttgatgttttgacatgtggatttcagaacttctgtgtggtaaagcagaatgttccaattgaattttcccattttttttcccctaagcaaaaatgtgagttttcacttatgcggccattgtgattccgactgagaccctaagtcgttctttgttgtctctctagtggtttctgacacctcagtgtgaagctgttgtagacatccataagaaatagcctgcttagggattatgtgagggcaaggtttggctgaaggagaatagaaggtgtggaaggaagcggaagaccagaagagcatcacactgcctcaagtcccaaatttgattctgctcctgatcctgtgactcaaattgtcattctcttttactgctgtggggtgtgctctgggcccagctgacaggacattctttgtactccacgtatttatgctggtgggagttgtatggctagtgctttgtgctttgtctcagaaattgtgtggactaaatgtaatatgggcagtgaatgggtttcttctggaagatgttaggcctggagggtggtttgggtttttacgagtctttttctcagattacagattacgaatggatgttataaaacaggcagtgttgacaccatacagtttctcctaagaaatgtacagagagttcaacctgaggaagctaattgaaaataaacttttaaaaagaaatgtagaaagaggaaatttaaaaagtatcttatgaatgggaaagatgtagccatttgagcttcaaagaacttttgagggaattctcaaaggacagtacccgtctttagtagataaatgcttgatatctatttttcttcttttactttttaaagaattactaaaataatacatggatttatagaaaaatcaaaccacttaaaaattgatcaggtggctgggcaaggtggctcatgcctgtaatcacagcgctttgggaggcctaggcgggtggatcacctgaagtcaggagttcgagaccagcctggctaacacggcgaaaccccatctctattaaaaatacaaaaattagctggccatggtggcttgagcgtgtagtcccagctactcggaaggctgaggcaggagaatcacttgaacctgggaggcggaggttgcagtgagccaagatcacaccactgaactcctgcctgggtgacagagtgagactcggtctcaaaaaaaaaaaaaaaaaaaagtatcaggtaaaaaaatgaaagctccccgcttaatctctgctcccactacccagaataactgctgttaatagcttaatgtagatccttctaagtcttctaagactaaactgtgtactttttgtgttgtaattaacaggagggtttttgttttgttttgttttttctttttttgagatggagtcttgctctgtcatccaggctggagtacagtggcacaatcttggctcactgcaacctccacctcctgggttcaagtgattctcctgcctcagcctcctgagtagctgggattacaggcgcctgccaccacacccagctaatttttgtatttttagtagagatgggtttcaccatgttggccaggctggtgtcgaactcctgacctcaggcgatccacctgccttggcctcccaaagtgctgggattacaggcgtgagccaccgtgcctggcctcaggatggtgttatatatacatattctgcatttttccatctcatatattcatctctgcctcatttcttttaaatagcagtgtagtccagggctgacttaccgtcatgcatttcgttgtctctctatgttattaaaaatgctacaggattgaaattcctcatgtgccagtcattttgaagaatggctgcctagacttggaatttctggtggataccaccacatcactgtccaaaatggctatcccagttcccacaacagtctgagaaagtgccattttcccatatcgtcccagaattggatatacatcttttaaattggtgccgcttggattattactgaggctaaacctcaataatcattgtcatagctcttaatgtattaaagatgttaactctttgtcatgcagatattttcctgttttgtcttacgtcttgattcttgtctttctgatatataaaatttatgttatgatttattcttttgctttcatacttaggaaatccttttttactcttttttttttttttttttttttttttgagacggagtctcgctctgtcgcccaggttggagtgcaatggcgtgatcttggctcactgcaagctccatctcccgggttcattccattctcctgcctcagcctcccgagtagctgggactacaggcgcccgccaccacgcctggctaatttttttgtatttgtgagacagggtttcaccatgttagccaggctggtctcgatctcctgaccttgtgatccgcccgtctctgcctcccaaagtgctgggattacaggcgtgagccaccgcgccccgccaggaaatcctttcctactcttaacaacagatcaatagtcatctatattttcttcctaaaaaacctgatgatgtattatattcatacatacgtatttaatacatacaaaagggccagatgcggtggctcatgcctgtaatcccagcactttgggaggctgaggcgggtggatcacctgaggtcaagagttcaagaccagcctggccaagatggtgaaatcccgtctctactaaaaatacaaaaattagccaggcgtggtggcgggcacctgtaatctcaactactggggtgactgaggcaggagaatcgcttgaacccaggaggcagaagtttcggtgagccaagatcacgccactgcactcctgcctgggcgatagagtgaggctctgtctcaaaaataaaaaataaaaataataattttatagttaagttgccctgtgtttttcctgtgattaaaaaaaaaaatacctgttttgtatttaactttggggtgggataaggtatagcccacttagtcagttgtgtctaagccacttgatgaaccagtcaatccagtcttcacctttaacaaatgctgatttcttcaagtgagcaaaatatctcttaaactttttcctattttctctataaagttgcttttttctgaattttttctttatgaggcttgatgggcagccctatcagcagacaatcattcattcacccaacaaatatttgagtatctgcttcaagccaggggcagtgctaagccctggaagtggtatcttctccttatccgggagtggggctacagtgttcattccagaagactcaagaaaatagcagatcatcacaaaagtaggttttacataaatgaggaggaatccacagggttgtgtatatgtgtgtgtattttaaattctgacataagttggagctttagggtagactgtgacataagagtagtttgttttccaactcatgtaattgccggctgatttttgtcttgaattatgataatggtaacttctgttgaaacaattctgtattcatcttagcttggttgggatgcaataaaagttttgtactggtaaaaatgataattttcttccatgatgattttgaagcttttctgtaacacctgataaaaatagaggggccaggcatggtggctcatgcctgtagtcccagctactcgggaggatgaggtgagaggatcccatgagcccaggagttttaggctacagtgagccatcatcacaccactgtactcctgtactctagcctgggcagcctcgttctttagagtaagacactgtctctttaaaaaaaaaaaaaaagaaaaaagaaaaaaagaaaaggcttttagtgaatatatttttagggtagcaagtgtaatttttataaattgcattatttgaatctaataaataccctcaaagctgaagtcgaattctgattttgattgaaaatattttttacttaaaggaagagggatagaataaatgacacgattaaggaaaagacttcttgtataaggccggggttttttaaatgattttttgaatagttagatggacaatacggaattaaaaaggtggtgtaaaaagttatacggggctgggcacagtgactcacgcctgcaatcccagtactttgggaggccgaggtgggtggatcacctgaggtcaggagttcgagaccagcctagccaacatgacgaaacatcatttctactaaaaatacaaaaattagctgggcttggtggtatgcacctgtaatccagctactcgggaggctgaggcagaagaatcgtttgaacccaggaggcagaggttgcagtgagccaagatcgtgccattgcactccagcctgggcgacagagtgagactccatctcagaaaaataataatagaaaaaagttatatggggctgggcatggtggctcatgcctgtaatcccagcagtttgggaggctgaggcagcttgatcacttgaggtcaggaattcgagactagcctggccaacatggtgaaactccgtctccactaaaaatacaaaaattagccaagcgtggtggtgcgtgcctgtagtcccagctacttgggaagctgaggcaggagaatcgcctgaacctgggaggcagaggttgcagtgagccaagatcatgccgttgcactccagcctggacgacaagagcggaactccgtctcaaaaaaaaaaaaaaaagagttatattgtaaagtatctctgctaccctgccccaaacattcatttctttccctggaggcagccactattacctgtttctttaaaaaaaaaaaaaaattgtggccgggcacggtggctcacgcctgtaatcctagcactttgggaggtggaggtgggtggatcatgaggtcaagagatcgagaccatcttggccaacatggtaaaaccccatctctactaaaaatacaaaaaattagccgggcatggtggcgggcacctgtagtcccagctactcgggaggctgaggcaggagaatcgcttgaacctgggaggcagaggttgcagtgaactgagatcacgccgctgcactccagcctggcaacagaatgagactccatctcaaaaaaaaaagcgtgtgtgtacccgtgtgttaaatttttattataaaatatatataacaggctgggcgtggtggctcacgcctgtaatcccagcactttgggaggccgaggcaggctgatcacgaggtcaggagatcgagaccatcctggcgagcacggtgaaacctcgtctttactaaaaatacaaaaaattagccgggcatggtggcgggcgcctgtagtcccagctactctgagagcctgaggcaggagaatggcgtgaacccaggaggcggagcttgcagtgagccgagatcgcgtcactgcactccagcctgggcgacagaccgagactccgtctcaaaaaatatatatcgatatatataacaatttacagttttaatcatcttaactgtacagttcagtggcactgagtacattcacattgttgtacagccattactaccatccatctctacaacctttcgtcttgcaaaactgaaatttcatacctattaaacactaactcccacttctcccctttcccccaccccaccctctggcaactactattctactctttgtctctattggacatatttttgtgtgtttaggtttgtgtatatattttacatgtgtgtataaatacacaagggtatgtgggcgttgtgtttttacacatactataaaatattgtgcacatttgtttattttaatgtatcctgtagattatttagaatcggttcatacagagccgtatcattccttttaagggttgggtttaaatagtctgttatggatgtaccacaatttatttaaccagtttttaaattttttacttattttttttaatgtttttttagagacaggatcccactccatcacccagactggagtgcaacagcatgatcatagcttactgcagccttgaactccggggctgatgtgatcctcccacctcaggctctcttgtagctgggactacagggatgtgccgccatgcctggctaaattttttatttttatttttatttttatttttggtagacacggggtttcactgtgttgcccaggctggtcttgaactccttgggcttgagtaatcctcctgccttggcctcccaaagtgccgagattacaaccatgagccatggagcccgacaagagtagccttttatttgcagaccattagagaaaaagttgcgtgtaagtagataagcatacgaatttatcactgcaatactgtttgtagagatcacagagctgttaggctaggaagaagtttttagcagttagcactagaaagcaaaactttggaaacttccatttcatcaaaagtgacctcatctgagtagggcatgtgagggaaggacctttttactcgacaaggggaacttgcccagttcttgtttgtgaaccttgaagaaagtggagcatttttattttgggaccattctaggttgtggtagttccttggtactcggggttggagaatctccctctgctgctggaccttctgcctcctcatgctgtaatatgcataagaggtgtcctagaagtattcaggaacaggctgtggttgctttgttgttctgtgactgttgaactctttatatagcagtacttttttaagctgtactaattgagcatttattatgtgtcagttactgtgctagctgctggaaactatcctaccctcagcagtcttctggtctaatgggaggtacagacaggcaaatgggctatgactttacaagaggctaacttctgtgatggagagaagttccagccactaagggagcacataaaaatcagaggagatcctaccaagaattgggaggtaggtcagggaggagacttctttgaaaaatggcatctaagacctgaacagcaaggaaacattagctaggtcaaggacaaagcatcagtggggagagatgcatgagtcttttggaaggaccagcatgtgtagaggctctgacaggagagaatctctcaggcccattcagagagtccactgtgtgaagacgaggcatgaacaaccagccaggacatgtggagaggagcatttttctttttttcttttttctttctttttttttttttttttttttgagacgtctttctctgtcacccaggctggagtgcaatggcatgatctcggctcactgcaacccccacttccagggttcaagcaattcttctgccttagcctcccaagcagctaggattacaggcacccgccaccatgcccggttaatttttgtatttttagtagagacggagtttcaccatgttggcctcaaactcctgaccttaggtgatctacccgtctcggcctcccagagtgctgggattacaggtgagagcccccacgcccggccaggctcggctttctttccaggccccgtcacactcttagatgttccctgggccccagaaggcagcgtgaggtgctctgcccatctatgctgtccttttccaccccaccctatccactgggcccctggggctcccactccactccaggtctcttcatggacccttctttcccttcacttctgtcccaggagacctgggagactcatgggaacaggcatcatcttctccagcacagttcattgtctaatgcacgaaagtgctgggctgtgagaaggtcaggagcttacatggaatgggagtcagctgtggtacaaagtacgctgcttagttctactgattttttattttttatttttacataagactttgatggtaaaggaagcagtgtgtgagcaagctgactcctgtcttgtcaagtaccaggtccactctgatgagcccctgtggacagcactgctgtaactccccaagcctgggctcaggaggtgggccctaagcgctgttcccagctcttcctccatgctgtcagctcttccaccattcttcctggcgtcattctaaggtcctgtcttcccccgccctcttccttcctggcttctacgctcagctcaagtagtagctgtttgggtacttttcacccagacttaggaaatgttatcagttggtcgtattcctgtcagccctcttactatggaactcaaataggacagattcagctgaattcccagccctgtggttgcactctttgtctgccctgcttccccaaggtagcctgctccctaaaggtcaccgagatactccccatgcaaggtttttgttgtattacacatgacaacatggaataaagtgttttgcaaatttactggatgatatcctactatgtggaacatcctacaacttactcttttcactcaacatttgacttttgaacctggtctgtactgctccgtgcagaccaatgttcattcatttgatatgtctccttgtgccatagaaatagttttacaatagaagcctgtccagagccatgagggagaaggggattgtagagaaacaaggattggcatctggtttatgtttacatcctttagtcctgttaaccgagaagaagatatttttatttccatgtttgcgaaagctttccacaaaaaaagcatccattttctagacttattaatagggcagtccaaaggttttatttttagatttgaaagaaagcaaagtaggcttctgagatatgcacatttccctgtgtccctgtctcttttgcaacattccacattgctgctaaaacttgaacatgagcactttcaagcatgtgcttactttctatgtatgactcattttttaaaacattaaagcattttcggccgggtgtggtggctcacgcctatattcctagcactttagaaggccgaggcgggtagatcacttgaggtcaggagttcaagaccagcctagccaatatagtgaaaccccatctccactaaaaatacaaaaattagccgggcatggtggcgggcgcctgtaatcccagctactcgggaggctgaggcaggagaattgcttgaacccaggaggtggaggttgcagtgagcagagatcgagccactgcactctagcctaggtgacagagcgagactctgtctcaaaaaaataaaaataaagcattaaagcactttgtctggtggtatgtaagttttggcattacttagataagttgtattttaagtctttctacacacaataacttatttttaaaatacaagtttctgtgtacttccgggttttgtgtttttgtaaacagcagaaggtattagtccatattaagtactaatttgttctaatattttcagctgtttttggaattacacttggcaaaaaaatagacaaatgtctgcagttgtgacagtttgtttttttgttctttttaactccagaataaataattctagtgagtttttttcttggcttgtaagaacatgggaatgattagagtcatcataacacttaagtagttatagaaggttgaacatctgtagtcagttgtataaaatttcctagtcatccttccaggttgtttaagacaaacaaatacatagtatttattaagctcttataaattttaattgtaaaacatcattgtacaaaactttgaaaatgcgtataggtacaaagataaaaaattaggccaggcatgccatggctcacgcctgtaatcccagcactttgggaggccaaggtgggaggatcttttgagcccaggagttcaagaccagcctgagcaacatattgagaccctatctctacaaaaatatcataaaacaaaatagaatcactctggcgattccactatccaaaaaaaaaaaaaactgctgttaatatttggtatgtatctttctagaccaaggcctccaactttggttgagaattcagccgggtctgtgaccttggatgggaaaaacattcactctttattttcactaatgtctctgaaaacccagatttttagctgggcatggtggctcgtgcctgtaatcccagtgctttggaagcccgtggagggcagatcacttgagcccaggagtttgagaccagcctgggcaacatagcaagaccctgtcttttaaaaaaaaaaaaaatccagccgggtgtggtggctcatgcctgtaatcccagcactttgagaggctgaggcaggcagatcacctgaggtcaggagtttgagaccagcctgaccaacatggtgaaatcctgtctctactaaaaatacaaaaatcagccgggcatggtggtgggcgcctgtaatcccagctactccggaggctgaggcaggagaatcacttgaacccggaaggtagaggttgcagtgagccaagatcacaccattgcactccagcctgggcgacagagcgagactctgtctcaaaaaaaaaaaaaaaaatccacattttcttcaatgacaattgtaagcaacagatcatggtagtattagaatagcagtgactgtcaccagtagagatcaaagatactttcatatcatattatagttgttacagatattttgaaatatatatgtccatcactgcttcaaacttaaggtaattattagacccatctctagatctggttatttaatgatttactgaagaagcacatattatttgagaacgaactcttgaaatatgttgttaatttctgtgcattttacacatttcaaaacattcttctgaggaggggtccagaaggccaaaagggtccatggcagaaaaaggttaagaacacctgttctgtactttgtaccatgtggctacaaatataaaaacagacgttaagccgggtatggtgatgcacacctgtagttccacctacttgggaggctgaggtgggaaaatcacttgagcccaggagtttgaggccagcctgggcaacagagcaagaccccatctcttaaaaaccagtcagcacttgactagtcagttagtgggggaaaacacaggtacagtaaaaggagtcaaaattacacttaaacttaggtcatcttattatatcaaacatttattaacatgtttagtgttttgtgtatattatgcaaagtgtaatgcaactaaaactgtttaacacttctcgatatcacataaatttgttggtgcataatagcctaaaagttacttttgctgttggcattttattttattacttacttatttatttatttatttatttattttgagacagagtcacactgtcgccaggctggagtgcagtggtgcgatctcagctcactgcaacctctgcctccctggttcaagcgattctcccgcctcagcctcctgactagctgggactacaggtgcgcgccaccatgcccagctaatttttgtatttttagtagagatagggtttcgccatgttggccaggatggtcttcatctcttgaccttgtgatctgcccacctcggcctcccaaagtgctaggattacaggcatgagccaccacgctgggcctgctgttggcattttaaacatccttctagagtctttcttatttgcctgtaagcacgtacacatgttgttgttgttttgagacaaggtctgtcgcccaagctggagcacagtggtgcaatcacagctcactacagcttcgacctcttgggtgcaagtgatcctcccaatcagcctcccaagtaggtgggactacaggtgtccgctaccatgcccagctaatttttgtattttttttgtagagacggagtttcaccatgttgcccagactggtctcaaactcctttgctcaaacgatccttccgcctcggcctcccaaagtgccgggattacaagtgtgcacctctgtgcctggcccacatgttgttttagatgaatgagatcatatatgtacttttgtaacttgctacctttcctcaacaaaatgttgtaaatatccatgtccataaaaatagacgtatatcttcacttttccctaaaatgaaaataacttaacttgcattttcttttttgtttttgtttttgttttgagacaggctcttgctctgttgctcaggctggagtgcagtgatgtcacagctcactacagcctccacctccagtttcaagtattccacctacctcagcctccaagatagctaagactacaggcacatgtcacgacgcctggctaatttttaaaatattttttgcagaaatgggatttcactatgttgcccaggctggcctcaaactgctggcctcaagtgatcttcctgccttggcctcccaaagtgctgggattacagtcgtgagccactgtgcccagcctgcattttcttattataaaagtaatacatgttcaatggacaaaaaattttcagaaaatatgcaaagatgaaaagtaaaaattgtccataaatctgtcatctacagataaagataacttctggataatgtttttctaccatcatttttagtaatcacataacatttcgttgtatgtctatgccttcatttaattaagaggcatttccattatttctgcatgttcatgactctgaatgatgatatgtctgcctgctgatggctacaaccctgtttctgcatttcaaacctctctcttgagctccagatttgatggcctcgtcagcatttacttgagttgctcataagtgtctcaaatttaacaagtcccagtcttgatttttttcccccttcaaacctattcctcatgttgtctctatttcagtaaacaatatcaacatccacccagttactcagtccaaaattctaggagtcatccttgattctgctctttctttttttttttttttttgagacggagtctcgctctgtcgcccaggccggactgcggactgcagtggcgcgatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctcttttttttttttgatacggagtctcattctcgtcatccaggctggagtgcagtggtgcaatcttggctcactgcaacctccgcctcccgggttcaagcaattcttctgccccaacctcctgagtagctgggcctggctaattttttgtatttttagtagagatggggtttcaccatgttggccaggctggtcctgaactcctgaccttgtgatccgcccacctcagcctcccaaagtgctgggattacaggcgtgagccactgcacccgccctgattctgctctttctctcatcatccctgatctgtcagcaagtcctgttaggccaaccacttctcagcatctgcactgccagtatgctagtccaagccacaaaacacctctcagaggtacgcaacaggactttgttgttgttgtgtgtgtgtgtgtttttttttttttacggtagaattattttataacttgaagtgtagggatgaccttccttttaaaattttatttattttcttaattttttattcccatagattttaggggaacaggtggtatttggtgacatgagtaagttctttaatggtgatttctgagattttggtgcacccatcacccgagcagtgtacactgaacccaatttgtagtcttttatccctcaccccctcccaccctttccctcaagtccccaaagtccattgtatcattctgatgcctttgcatcctcatagcttagctcccacttatgagtgagaacatacagtgtttggttttccattcctgagttacttcacttagaataatagtctctagttccatccaggttgctgtgaatgccattaagtcattcctttttatggctgagtagtattcctttgtatatatatgccacaatttctctattcactttctgattgatgggcatttgggctggttctatatttttgtaattgtgaattgtgctgctataagcatgcgtgtgcaagtatcattatgcaacgggacttcggatgacatattgaacaacttcctcactgatatccttgtgaaacgctacatatttcatgggtctgtttgttataccaacactcaattctgaatgatggaattatttcacatttagtctctttttcatctagccattatagtttagtttaaacaccaagttccattcctgctgcatgctgaaggatttgcagtacatcaggctatagtccatcaattcattccacaattgagtaagtaaggtatctatagtacctcaggccctgtgttaggcagggatggggtaacctagacagatttggtacctgtcctcatggagcttgactttagcggcagagacagatcttagataattgtaccagtacttaagtgttcagaaggacaagtatggaggtgggagccactccagtcctctacagtcacgtgctgcacaacaacgtttcaaccgacaacagagcacacatacagtggtgttcccataagattagaatgccatatttttactgtaccttttctatgtttagatatacaaatacttaccattgtgttccagtgatctacagtattcagtatagtaccatgctgtacagttttatagcccaggagcaataggctatataccgtatagcctaggtgtgtagtatgctacaccatctagatttgtgtaagaacactctctgatgttagcacaaataaatcgcccaatgacacatttctcagaacatatccctgttgttgagcgactcatgactgtacaatgggggaacagctcagcctgccttccccaaggaggcaacgccgatgcagggaaccgagggttgaacagaagtgggcaaggtgcagagaggaaaaaggctttccagatggagaagagcatgtgtgaaggccctcagtctggcaagagcttagtcctgtgtggcaggagctgaacgaggggttaggggagagtggcaaagggtccgggccatcagagaggtcaacaggggctggatcatgcaggattttgaatgttaacatcagagcgatagaaaacatgaagggtaaggtggtttgggttttgaatttttatcaaaatattgcaactactcggcaacaagttagatataacaaaagaggtcatcgtaaaaacagcagtctaccccttccccttcccttccctgactcagacatgacagcttttaactgtttctgattttagttcctttgatggttacctccaaaattaaatcatatgcttatacatctttcttgatttgccaactttagggaactgtgttaactccctgaaatgaaagagaatgacttagcttacgttacctccccatgttgaaattcatattcacatttctctgtaattttttttttgagatggagtctcactctgtcgcccaggctggagtgcagtgatgtgatctcggctcactgaaacctctgcctcccgggttcaagcaattctcgtgcctcagcctcctgagtagctgggactacaggcgcacaccagtgcactgggctaatttttgtatttttagtagaggcggggtttcaccatgttggccaggctggtcttaaactcctgacctcaggtgatctgcctgccttggcctcccaaagtgctgggattacaggtgtgagctaccatgccaagcccacatttctctgtaaattttaaacagtattttagtccatatgtcagttcccctctgtttaagataaggatattaataaccctacttttccttccactttccctccttaacttctgcgtcttaaaagctgtacttgaccatacccattcttgcatttgttaacatgtgtgttctgccctgcaaccacagccaagttgtagcttaattctaaagtcgaaaataacattatttacattattacacatgtgagtattgttcttggcgagaccaaataatgaatgtgcccaggattacatttccttctttacagatctggaccactcaaaggagaatgaccaatcaaggtcaaatggattcccttttcttagactctgtcacctgcttaaaatccttgctaggatttaatctacttcatattcaaaccttggcttgcttatatagctctttgttttgcccaccatttctagttgcctttttattttgtttactattcctccttgattatgttgtaaaatgctattagcagtgctgtttatttcgtacgattcggctttttccccactgaagacctttctcttggaaggcctctgcccttctgcaatctgggcaagtatctgctctttgatttaaggttgcatatacagctgtacctggaccttctcctcactgggctcttgggttggagcccgtgtcttaaaacccatatcttcctttcacatggtttactccctcgttttctggactgcatccttaaataatgtgctcagatagagtgcatggggagtaaactgtagtggataccgttgtcacctaccccatatccatttcttctttgcccattcctaacagaatcctgatattattcacctttctaccttattcccaacttcagaaaggatccttaagtcattccacacattgcattcctttggcaactgttactggtcaaggatggacatacgatctaagttggttcactcagactgaagggaaggacttccatggcacgttcagggaagactttctctttttctctcactggagtaagtgagaaaggtgttgctgggggctcttctgtaacctcagactgagggacaaagcctgaggataaagcctgctcaccaaggaaggcggagcagagaaacgggaagaacctgggtcttgatgccgttgcttagctggtgattgcactgtggctggggcctgtcctacctgagctagggactcagataggatggactttcttactgaatgagccagcttcagttttcttttctgttacttgtaaccaaaagcattgtaacagataggtcttctgagtcactgcatgcctgaaatacctttcttctactcttacacttgattggctgagtatagggttccaagttgaaaatcattttttctcctaactttggaggcatctcttctagtatgcagagtaacaaatgcaacaaatgcctgatgccaatcttattatggttcttttgtaggtgcccttcttttctcttccttccctggaagtttttaggatttcgtctccttatttttagtgtcctgaaatctcatgagaatatgtctagagttgtgtcttgttcactcgttgtactgtggtcattcaatctgaatacttttgtcaactcttttttttaaaaaaaaattactaatttacatgctttcattttctctatggggactactgtttaactttggacctcttatattggtcttctgtcttctctcatatttttcatttattgggcggtggggggtgctctgaattttggaagatctcctgcatttattttctttttccttttttctttttttttgaggcagagtcttgctctgtcacccaggctggagtgcagtagcctgatctcggctcactgcaacctctgccttccaggttcaagcaattctgcctctgcctcccacgtagctgggattacagacctgcaccaccacgcccggctaatttttgtatttttaatagagatggggtttcaccatgttgccaggctggtctcgaactcctgacctcaagtgatccgcccgcctcagcctcccaaagtggtgtgagccaccgcacccagcctcctgactttattttctatcccttctgttaaattctttatttcagccaaacctttttttttttttttttaacttactgtgaagcctgtgtgcctactgcctagattagacaattgttaacattttggcgtattttcctggtctgtatagatagggtgcatttttatacctttttgctcaccatttaaaaggaactcacagatgtcacgacatttcacccctaagtacttcagtatacatctcctaaaaataaggacattttccaatataagcacaataccccgatcacatctttaaaagttaacaataattctctaatgttatcaggcacccactttaaattcagatttcctccaaatgtctcttatcgctgttgaggggctccaaagcaattaagatttatacattgcatttgaatatgcttcctttgtctcttatttatttatttattttattttgagacagagtctcgctgtctcccaggctggagtgcagtggtgtgatctcagctcactgcaacctccgccttccaggttcaagcgattctcctgcctcagcctcccaaatagctgggattacaggtacgcaccaccacgcccagctaacttttttgtatttttagtagagacagggtttctactaaaccatgttggccaggctggttttgaactcctgacctcaagtgatctgcccgcctcggcctcccaaagttctaggattataggcgtgagccaccatgcccagcccctttgtctcttttaacaagaacagcctacccacctctccttcacttgtgatactgactttttgaagcagtcagcccaattgtcatctagaagggcccacattttaagatacatatttttagagatggcgtgtcactatgttgcctaggctggccttgaactcctggcctcaagtaatcctcctgcctcagcctcccaggtagctgggactacaggcttgtgccaccacgactagctggcccacattttagatgtctctcttttcttgtgatataatttaacttgtttgtccatatatattacttgtagacaagaagttaggtctacaggcatgttcaggttaaacattttgggcaagaatatttcataggcagtactgtgtacttcatatagcatcagctcaccaggcacttaatggttggttaccctgtggtttgtgatgctacgttttaacacttgattaaagaaggaggtgactgccaaatctccccattgtagacatacagttttcctgtggtaattgatatataatctgtgatgtgatgctttggcaccatacaaatatcctattgcccaacagccatttgcataattattttagcattcattgatccttgcctgaaaccattattacattgggggttgcaaaatgatagtttttttaattgtcacctcttctacatttagtactgtcattcctctgtaatgaattttccctcatcaaataaggaggcattatatttcctcctaaaaagacagtatagatgcttaatctttgcctttattacatttcagagtaaggagttggtagaataatcacctcaaatggtggcaaaatatttgctgttgtgtttccttttctctttcatgtcaatatggactcatagggatttatttattaaatgttttacaattcaaattgggtcaacaagagtcccttcatgttggttcctatattctcctggcataccctcattaattagtctttgagcaatttcttgttttctggcacaagatattccatcccaatatgtgcttttcgtgtcctagaactgattccaaggagctctggttccttatagtggcaacggtatttagaatccaacatgtgggtactaaatgtgctgattcttactggggtaacattatatctaggcactttcagaggacatcgctagaaaatatattcagtttttattttttatttttaatttttttgtagagacaaggtctcactatgttgcccaagctggtttcgaactgagctcaagcgatcctcccacctcagcctcccaaagtgctgggattacatctgtcagggcaaactgctggtaaatattttcacaaaagaaaaataaaaaaaccaaagtgctgggattacagatgtgagccactgtgccctccattttttttttaagtcataaatacataatgatgtcttctatggcaatttaacattacagggttcttccttaacttttttttttttttttcttttttttgaggcagggtcttgctctattgcccaggctggagtggtgcagtggtacaatcctaattcactgcagcttcaaatgcctaggcttcaaacaatcctcctccctcagcctcccgagtagctaagactacaggtgcatatcaccatgcccagctaatttttaaaaattttttgtagagatggggggtctcgttgcgttgcccaggctggtctcgaactcctggcctcaagtgatcctcccatctcgatttcccaaagtgctgggattacaggtgtgagccaccatgcctggccaacttttatttgatctgtatatatcttttccttacactgaaaatgttgggtcttactaatgttaacatagttacttatttgctttatcttgtaatagacataaaattacaaaattataataccaatattacgataaatagctgggcatggcggcgctcgcctgtagtcccagctactcaggaagctgaggtggagggactgcttgaacctaagagtttgaagctgcagtgagctgtggttgtgccactgtactcctacccggacaacagagtgagtggggggaaaaaaaagaaataatggaagatccagagaaagccccaaatatttaaaaattaaacaatacactttgcagcttcctcacctctctcagccttcatagaattgaagagagttagggccttgcactagattaggctttgccttaaggaaatgttgtgtttgatttgatcttttatccagaccattaaaacttccttaacgtttattagtaataaggctatttcactttcatatcatttgtgtgttcactggagtagcacttttagtttccttcaagaactttgattcacaacttggctaactttggtacaagaggcctagcttttggcttctcggctttcaacatgcctctcactaagcctgatcatttggtttttggtttaaagagaaagacatatgactcttccttttacttgaatgcttagaggccattgtagggttattaattggcctaatttcagtactgtcttgtccaagggaatagggaggcccaaggagagagagagagatgggggaacagctgattggtggagtagtcagaatatacacatttatcacttaagttttgccatcttttctttttctttttcttttttttttttgagacagtcttgctctgtcacccaggctggcatgcagtggcatgatctcagttcactgcaacctctgcctcctgggctcaagcaattctcctgcctcaacctcccgagtagctggtattacaagcgtgcgccaccatacccagctaatttttatattttttagtagagacagggtttgccatgttggccaggctggtctcgaattcctgacctcaagtgatccacccgccttggcctcccaaagtgcggggattacaggcgtaagccactgccgcctggccaagtttgccaccttttttattttttttattttttgagatggagtctcactccatcacccaggctggagtgcagtgatgcaatctcggctcactgcagtctctgcctcctggattcaagcgattctcctgcctcagcctcccgagtagctgggactacaggcatgtgccagcacgcccagcttgttttttgtatttttagtagagacggggtttcaccatgttggccaggctggtctccaactcctgacctcaggtgatctgcccggctcagcctcccaaagtgctgggattacaggcgtgagccaccccgcccggccaagtttgccatcttttatgggtgcagtttgtggtgccgcaaaatgatgatagtagtaacatcagagagcattgatcacagatcaccataacaaatataataatgagaaatttgaaacattgtgaaaattaccaaaatgtgacagagacatgaagtaagcacatgctattggaaaaatggcactggtaaacttgcttgatgcagggttgccacacaccttcaatttgttaaaaactcagtatctgcgaagtacagtaaagcaaagcacaatcaaatgaggtgcgcctgcatattacaaccaagaggcttttcgcagaaacacgagtgtgcttcaacattcaaaaatcagttggtgtaattcaccacattaagataataaaggaggccgggtgcggtggctcacacctgtaatcccagcactttcagaagccgaggtggacagatcacttgaggccaggagtttgagagcagcctggccaacatagtgaaatcctgtctctactaaaaatagaaaaattagccgggcagggtggcacgcacctttagtcccagctattcgggaggctgaggcaggtgaatccttgaaaccaagaggcggaggttgcagtaagctgagatcacgccaatgcattctagcctgggcaacagtgagacccagtatcaaaaaaaaaaaaaaaaaaaaaaaaagataataaaggagaaaaaccatatagtctattcaataaatacagaaaacgcatctgacaaaattcagtgccctttcatgataaaaattcagcagattagaaatagaggaagtgcatgtatgaaagagctacagatagattgtacttaattgtgaaatattgaacatgttaccccgaaaatcaggaaaaaggcaaagatgtccactctaaccacttctattcaacattatactagaggtcatagccagtataatgaggcaagaaaaaacataagaggcattaatatttaaaggaagtaaaactgtttctatttgtaggtaatgtcgaaaatgtgaaagaaactatcagaacctgctagaactaaaaagtgaattcagcaaggtctcagggtacgagatcattcaaaaactaatcagaaatgaaatttcaaatgcaatatcgttaggaataatttaataagaaatgtacaagatttacacgctgaaactgaaaatgttgctgaaagaaattaaagacctaaataaatggaatgttgtaccatgttcatcagctgaaagactaagtgtctttacagtgtcagttctcccttcattgaactgtagattcataaccccagtcataactgcagggttttttttgtagaaattgattgtaaaatgtatatggaagctgggcacggtggcttatgcctgtaaaccagcactttgggaggctgaggcagacagatgacttgaggtcaggaatttgagaccagcctggctaacatgacgaaaccccgtctctacaaaaaatacaaaaattagccagacatggtggcacacacctgtaatcccagctacttgggaggctgaggcatgagaatcacttgaacccggaggtggaggttgcagtgagccaagatcatgccactgcacgcccgcctgggcaacagagtgagactttgcctcaaataaataaataaataaaacgtatatggaaatgcaaaggacctagaacatccaaagtaaacttgaaagagaacaaaattaaggggcttatgtgatgtgactttatagtcatttgatttttaacagaggcaccagaacagtccggtgcgggaaaggaaagtcttttagcacgtgccggatgatggcaaatgacatccataccagacaaaaatgaaccttgaccttaccctaaatattagtttcttagagttgccacaaactaggtggcttaaaaccacagaaatttggctgggtgcggtggctgacgcctgtaatcccggcctttgggaggccgagtcgggcagatcacctgaggtcaggagtgcaagactagcctggccaacgtggtgaaactttgtctctactaaaaatacaaaaaacttagtcaggtgtagtggtgcacacatataatcccagctagccaggaggctgaggcaggagaattgcatgaacctgggaggttgcactgagccaagattgcaccactgcactccagcctgggtgacagagtgagactccgtctcaaaacaaaaccacagaaatttgctgtctcataattccagagtctagaagtccaaaatcaactgtcatcagggccatggtctctgtgaaacctgtaggggagtccttccttgcctcttcctagcttccagtggttggcaacctttggcattctttgatttgcagctgcattacttcaatatctgtcttcctcatcacacagcattctccatgtatgtctctgtctttacatggcctccttcttgtaagaacaacagtaatattggattggggcctgccctactccagtgtgacctcaccttaactaattacacctgcaacaacgctgtttccaactaaggtctcagtgtgaggtactgagggttaggacttcaacatatcttttttgggggacatagtccaacccatgacactacttcacaccatacataaaaattaattcatgagagattatagacctaaatgttttaaaagctaaaaatataaagcttctgcaagaaaacataggagaatatctgtgcagtccaaagaataaggttttttttaaacacaatttcactctgttgcccaggctggagtgcagtggtgcgatctcagctcactgcaacctctgcctcccgagttcaagcgattcccatgcctcagccttccaagtagctgggattacaggtgtgcgccaccatgcctggctaatttttgtatttttagtagaggcagggttttgccatgttggccaggctggtctcaaactcctgacctcaagtgatctgcctgcctcggcctcccaaagtgctgggattacaggtatgagccaccgtgccaggccaaaaaaagatttattaggatacatgaagcaatagctattaaaagaaaaaataaattggacttcattaaaatttaaaacttttggtcctcaaaagataccattaagaaaatgaaaagacagagctgggcgtggtgaggcttgcctgtagtcactactgggtacttgagaggctgaggcaggaggatcacttgagcccaggagttctaggccaacataggcaatatagtgagacagtgtctcttaaaaaaaaaaagaaaaagaaaaaacaaaagaaaataggctgagagctgtggctcatgcttgtaatcccagcactttgggagtacaaggcagatggattgcttgagctcaggagttcaagaccagcctgggcaacagtgaaatcccatctctacaaaagatacaaaaaattagccaaccatggtggcgtgcacccgtagtccatagtcccagctactcgggaagcagaggcaggaggattgcttgatcccaaggaggtcaaggctgcagtgagctgaggtcgcgccaccgcaccccagcctgggtgactgagtgagaccctgtctcaaagaaaatgaaaagacaagtccaccaagaaaacagttgagaccagtcatagaaaaaatagaaagtcatatctgacaaaggatttgtattcagaagaattcctataactcggtaataaaaagacaacctgatttttaaagggtgaaaatattttaatggatacttttttttttttttttgagacagagtctcactgtgtcacctaggctggagtgcagtggtgccatcatacatagctcactgcagactcgaactcctgggctcaagtggtcttcctgcctcagcctcctgcgtagctaggactacaagcacgtgccactatgcctggctaatttttaaattttttgtagacatgggctggtgtgtgtctgtgttgtctaggctggtcttgaactcctgggctcaagtgatcctcccacctctgccccccaaagtgctgggccaccacgcctggtgtggtgtcaccagagatgagccaccatgccctgcctgatacttttcttttatcatctgtttatttcttgtttatgggtgtttctgttctgattttatgactattctgtattctaagatttctctgagaatattatttgtttcctctaaggacagacttggtctctcttccatggggctggttcttgagccgccagggatggggggaggacctgggtagctgctgcgctgccccttctctgctgtggtggagtggcccgttgcctgcggggtctgtctctgaagggtggtttggagaagttctgtggaggcgaggcaggggtcagctcttgccccatggaccctcagagactgggaaaaggtaggcatcacctgggctgctgccagccacatcaagagcctttggggtgggtggggtgggggccggggaagggaaggttctagctgttgatttagaaaagacccattgatttcttgcctgagggaagaagtggcaccttgccactccaagtttgctctgctcaccagccccaacagcatcagcctcacctgggagcttattgaaggtgccctgccccaaagcttgtgggtcgggatctggcagtcagcagcccccaggtgttgcacacatgacagcactgcttgcccctcctctcgtctggtctggtctggtctggtctggtctggtctgagagcttctttggggctctgacaggtatacaggctctcatctgctctacagctctcttgtagtacattcctctctgttccattagtcaacatgttcttgcctacttccagcatctagaaatttgctgagtgtatcttatccgttcagaggtcctctcctgctattgcctctgttagaaatttcttccctttcatatgtctgtacttcggtttctttgaggtttgaagggtcaagtggcaattacatgtaggcagttggccatcctctggtgaaggctttaaagcccaggaataacaagatccattatgtctaaaactagcaaaaaccctacctgtcacatggtgaactgaattagaggtgatggggacagaagccagattggagtgagtggaaggtgagggagtggagattgggtatagacaactctctttaagaagttttgttgtgatggtgaccagaaaaataggagtggggtagagggggatgagggtgtttttcacgtgggtgaatatgagagcatgtttacatccttctgggaatggcccaggagagaggggagcgtgagaaggaggaaatggggacctggaggagcagactccttgtgtggaggggggaagcggcatctagagctgttgcaggaggtgggctttgagtaaatgcttcctctttggtaaagacggggaacgggaacggtagaagttgcacggaccctttgttaaagctcagaagctgagcgagaattagagcttaagtttatggagtagtcagaataaagtacccctaactgtattcttgcacagtgcaggaagccaggggtctgaaatcaagatgttgcagggctccattccccccagagcctctagcatggatccttccttgcctcttccagcttttggtggctgcctggcagtcctagactttccttggcttgcagttgcattgctccattctctgcttgtgtcttcacatggccttctctgtgtccccgtattcttctctggatgcttgtcactgtattaggcccaccctaaatccaggatgatctcatatcaagatccttcacttaattacagaagcaaagaccttccaaataaggtcagagccacagggtctgggggttaagacatacacctaactattcggggctaccatcgaacccctgtagaagcctgtccatttccaggatagcagagcccaaggaagggccagaagtccccccaaaacagttgtttgcattcaccagattctaagctataagcagatgggcagtggcagtcggtcctaatccatataccattggcaacaatagtttagttcactgtagacataatgagatgcttatcttctgctaagtagtcctcatggtaacagccatattactcctggctttgagtgacagcgctgtgctcttgtctggtgcccatatacttcagcagctggaaacaagacagtgctcatgattcaccggaaagtttctgtagttaaaatcaagtgatcccttgagtctattctaatatttgtctgtaccatgttctgtgacgagacatggaaacaaaacattaagaagtgaaagtatctttgattatgctcttgaagacaactttttgtttgtttgttttgtttgagacggagtttcactcttgttgcccaggctggagtgcaatggtgtgatctcggctcactgcaacctccgcattcccgggttcaagcgattctcctgcctcagcctcccaagtagccaggattacaggcatgcaccaccacgcctggctaattttttttattttagtagagacggggtttcaccatgctagtcagactggtctcaaactcctgacctcaggtgatccgcctgcctctgcctcccaaagtgccgggattacaggtgtgagccaccgtgcctggccgaagacaactttttaaagatgcatatgctctgggctgggtgtggtggctcacacctgtaatcccagcactttgggaggccaaggcgggcagatcacctgaggtcaggggttcaagaccagcctggccaacatggtgaaacaccgtctctactaaaagtataaaaattagccgggtgtggtggcgggtgcctgtaatcacagctactcaggaggctgaggcaggagaatcgcttgaaccccagaggcggaggttgcagtgaattgagactgtgccactgcactccagcctgggcgacagagtgagacttggtctcaataaataaaataaaataaagatgcatatatgctctgaaggctggctacattttattttttctcaaacaacttttacagtggatagtgctgtaaaagttgtttagctctggtcattttatcttttttgtgatctgcaaaaggagatccttttccttttcactgcctctaatacccaactccaatactcctttgacctcacaggcacttagaatccatcagtggctccatcttttctcagacttcacctccttcgtatccttattcctctcctttgtagcttcagtgccagtcagacgtcgttactccctggcacactacctcagcccttcggcactttcttgctttgttatattcagtcgacaaagccccagcctcatgaaattcagtcatgtctgccccatgcctgctccgtcctgaagctgaatgtgactccttcattgattccccctttaagttcatgtctaccccaggtaaacttcttgccgccaagcccacctgcatactgcagttccccggtctctcctagcccctcccaccctcctcatcagctgtcacacctccttgcagctgatatcttagttcccagagagcacagaagcaagctcaagagagtgtctacaggccagcgtctactccttcgctctgcctccctcatgctgtcacggagcgcctgtcccaggccctcactcctgttctaaggcatctctccagtcctctactgcactctcccccatcagagattcctccctcgcctgccctagaaacttgttgctacttctcccaccttgacaaaagctgctcccaaccccccacctgtctagcatctctgttttcctttaccagcaagactccagtccctgtctccacaccctcttcaaccttctccagttgttcctttgctgccacagctctgccaagctgctccatgaggtctccagtgatgaccttcatgttgttaaatctgggagctgcttgtcacttcttttcccagagctgtcgtcgtcagttaaccccaatacccatacgagacaatcctttccctcccttgagtctctgcactgatgtgcaccttctcagtgcaaaccacagcttttgtctctttctagctgaatacatgactgactgtgcttatcttagctgtcacccctgctggagcagaagctccacaggacaggattgtctccttgattcacagatgtagctcaagctcctagaacagtgcctggtgtctgtgggtcctcaggaagtcctaggtgagtgtgtgaatgtctgtcctcctcggtcttttctgtttcgcatgtgatgttggaaggcctcaggttcaggcttttcttctccaccctcactcccgaagtgattccgtccagcctcatggctcccaaatttatgtctccaggctgactgggtcacgggaactccttatcctccctagaccttctctttccctggtcttctcctttccagtaaacagcaactccaactcctgctcctcaggccagaaacctggcgctggttacctcatttgttcacaaatactgttactccacctgcaagatggatacaaaatctcatgagttcccctgcctccatggcccccaccctggtccaggtgtccagcttccctgcctctgcccttgccccctggttctttgtttagtcctgcaatattgtgctcttctgttcagaaccctccagtgggtccctgcttgctcagagtcacagcccaacaggatcacctctcttgccactctcccaccactcatgcactgcggcctcactggcctcctggctcctccctggaccctccaagtatgcccctgcctcaaggccttgacctctcctctgccctctgtcccaggtatcacacatgtctgctcaagtgtcaccttcccaatgtggccttccccgagcacacccatgtctgtaagtcaggcagcctgcctctgccccaccagttccccctgcctagcataggacttgtcaccatctgccacaagctgtgttactgcttggttttgtttgtgctctcccactcccttcccctccctccctctccccacccctatagaatctgagtcccatgaggacagagatttttttttttgcctcttcctcaatatatccccagtgcctagaatcatgcatattttaatttattgagtgaattaacaaataaattctgcagtgggacattgctctaaggttttgtcttataagagggacagaagaacatgcagcctgctctgctgttggctccttagcttctccatggctaacaggaacaatattgtttatgagataatcaaagccatagtcatgagttagaaggtacatataaaggcaaatatgtggagattgagttactttggcgggggcggaggggtgtgtagttatctgaaaacatggaacaaatcaatgagagtctaaatagcacccacatatttgcccctcttttaaaacatacctcctttatgagtgtagaatttaacagcacagtttcccagtgcagctttgcgaaacaagagaaatgaattttaaaggctgtcaggtgcctttgcaatctgtggcttagtatttgtgtaacaacatttgtgttttgccaacagatgtactgcttaaagtacccatgagaatggcctctgtggttttctactttctcggatggaaccttaggaactgattattgagaagaggctgatactgcccacctcagctcccaggcaggcttcagggccttggttactactcctttgggccctcactgacccttgcagacgtcttttgcaacctctgtagccagaagagacaactgctttctggcatgttgctctttccctaatggctttatgagcttcttgaacaccaaagcatgtgtgacttcctcacgccttcccctgtatagtatagcacccctaactgtatgtgtaaggagaaggagtgagcaattgatggcgtccccctggatctccaagggaatgggaaggggcagggtttctggattcagtcatgtggaatctggtcgttggtgtctaaatgtgcctgttacttgtgcccaatgtccaggttcaccaggaggcttagcctgctcatttccctgctagtagctatattttgggagagcattttttatgctctaattgaactttgtgggtctcagcaatttgaacaatgttttgtttttcttctggtcaggttacaaaggaaagaaaaggaatctggtgttgtaggaggtggtgtgttgtgtaattacttgttttttttttttaagtttttttatatttttgcaacaaggcaagttttctttgaataaataatgctgggagcttatcacatagaaggcatatgtgttgtactcagtacattctgaattatctgggtttatttttatctcttgaattcacttataaacaattcaaaggctgcttttttagctaacagaaataggaagagaatctcagaatctgttttgtcattttttcaatgggttgagttatagtgattatgctaactcggtggaaaagcagtgtagtgagtaaaccccacatacggcatatcatgaacattttgttgcttttttggcttctgaccatcttcatacctttttttgtgttaaaagtctccccattgtgtatatcttagtaagaggcaggtggaccctagtttctacctaagaaaacctgaagatggggttgggggcctgtggtgtacttccttctcatgctgtccatgaccactgcagtggctttgtaaggatccaggacccagggcccctcagtgggtgtcttccatttctcaagattgcctcttggttgtgagatgacggttgctgctctagtcattgcatccactcctccaggtaggaagaaagaggtcataggggaaaggcaaaatggcacttgacatcttaacttctaggcccattcaatatttccatttccatcttcacacccatcatcttgtcctagggaacaaacagcaccagcagctcagtagctataacagcaattattatttctcacacatgggtctgggtcagctgcaagatgggattcagatctgttctcaagcctgtcgttccaggacccaggagggagaagcagctgccaggggaagtctcttcgtaggcggaggtcaggagtccaagaggagtgagcagagtcacagaagcctcttaaagcctcttcttcccccatcccatcaacacgtgagcaagcccagagtcagtgggtgggaggtgtgctccgcccatagtcagtagaacaagagcaagcttgaaagagaacgatgaacaggagtgcactcggccactgtctccttagccataacgtagtcccatggtctgctgggaagcggggaataactctccttagctgagcgcagggtctcattagtaaggcagatggagaacatggatgttgggggacaactggcagtgcctgccacaggggaatggatatattccctccccttgctctctggaaactaggggatggcgatgaagcctaggtttggccaaacccattctgccttcagggactttgactcttgagggacagtgagggattagtcatggtggtggcagttgagtcacaaaaccagcagtggtggctaatgtccagtgatgacatgcaacagtgcccagggtgggtgtcccaaccagcaggtccctgcagtataaccttggctgtgtttgcagtggtgcagcctctattcctgctgcttttctgagcctagttctctagttctctctccatttccagatctgctgcccaagaactcctttgtgattgaatttaaccagagttgatttctgttgcttgaaactcaggaccttgatgcagtgtgcagggtctgggcaaggtaaaaacacactttcatgatttcgcctcaagtatagtagatgagcttaggctttttgagccaggtagccttgggattaattctcagctcttgcacctagcaggtgacctcagcaatcaagtcacttgccctccttgagcctcagtgttgccctcagttaaacattgctctcgtgtgttgctgagcattcagtgagattgtatataaagtgatcattgtgaaggtattgggacataatttgggaaagcgtcctggtctaagcttttgattggctctccatcatttgggtaatgggatagtgatttaggagtatcatagcagctcaaggggcccttctggaaagggtatgaggaaggtcagggacaagtctgaaatgaatcatcctaggcttaatgcctgtgactgggcagtgggtacaattatctcaggctagtcagtagtcatttattgtgagaatacatgggcagattttttaatttccttctcagtctagacttgaatgcaaacagttcttattgctaacttaccactagtcaccactaatgaacaaagactatgaacaggaaattcataaaagaagagatacagatggccaatgaagataggaaaagagttctgcctgctggtaatcaaagagatgcaaacgagaacaaaaatgatgccttttcacctaccaaatttgtcaagattaaaaagaaagcaaagagccagcgtcagctgatgttcatacctgcacctgctcggtagcttgctaatgttctgcctgctccacacgccaggccagcctccacggcgcagccaggtgaggcctttccttgtatacaggcacgtttggattcactgttgcataagtgagacatgtgcatgcttcacaattcaggaagtgcaaactccagagtgatgcaaggtctgagtgtccctgctgccctggtctcccagctgcctaggcctctcttcagggaacggctgcatccagggtcttgtctgtgtcttttgaggtgttctatgtacacgcagacacatctaaacctatttttattttccctgcacctgcttgggctactgtaagctgttaaatttttttttctaggaatttgtccattttgtctgactagcataaagttgttcatgttatagtttatacatttgcaacatctgtaattatgtctgctttttcattcctagtgtttgttgtttacttgtaccttctcccgtttttccttgtcttggtaaaagctcattaggttcattggtcttacaagaagcagacatgtaggcattattgccctgtattactctgtgtctcttttctagttcattaaattctgcttttgcttttatctttattattttttctatggtcttagagtacattctctgtgttttgttgttgttgttgttgttgtttgttttttgttttgagagagagagtcttgctctgtcgcccaggctggagtgcagtagtgcaatctcagctcactgcaacctccacctcctgggttcaagtgattctcgtgcctcaacctcccgagtagctgagatttacaggcatttgccccacacccggcaaattttttgtatttttagtagagatggggttttggcatgttgaccaggcgggtctcgaactgctgacgccaggtgctccacccgccttggcctcccaaagtgctgggattacaggcatgagccaccacgcctggccctaacttcttaagttataaatttggttcattgatttttctacccttttttcaaatgtaaacatttaaggctaaccctctggaactacttcaactgtatctagcaagttctgatagtattgtcactttaagttagcccaaagatattttaaattttctttgtttcttcctttgactcacatattattttaaaatgtgtttttcaatttccaagcacatggctttgggtttgttttttttttttcctagttgctctagaaaaaaaaattgactgcatgaggtggctcatgcctgtaatcccagcactttgggaggccgaggcgggcagatcacctgaggtcaggagttcgagaccagcctggccaacatgccaaaacctcgtctctactaaaaatacaaaattagccgggcatggtggcacacacctgtagttccagctactcgggaggctgaggcaggagaatcacttgaaccgggaggcagtggtcacagtgagccaagattgtgccagtgtactccagcctgggcaacaagagcaatactccgtctcaaaaaaaaaaaagaaaaaaagaaaaaatcaacttctaactaaatggcactgtgatcaaagaacttggtctgtgtgacaccagttcttgcagttggttgagaagtgctccatgacacattatccacaaccagtggacagaatatgtcaccaccaagcatgggtgcaggattctacatatattcattacctctgtcttatccgtttgttgtgaaagtattttctcttcttactgtcattttgtttacttgatttatcaactgatggaatacgtgttaaaacctactgtggtgatggacacatcagtttctccacagagtttggtcattttcattttattatttattttgaggccacattttcagttttagatacagtttcacattcctggtgtattgaaccctttggtattatgaagcgaccatactaatatgttatttttttttaaattattatttattttatttatttttctttcttttttttttttttgagacagggtctccctctgtcacccagtctggagtgcagtggtgcaatctcagctcactgcaacctccgcctcctgggctcaagtggtcctcccacctcagcctcctgagtagctgggattacaggcttgcaccagcgcgcctggctaagtttttgtatttttagtagagacagggttttgccatgttgcccagactggtctcaaactcctgggctcaagcagttcaccagccttggcctctaaaagtgttgggattacaggtgtgagccaccacgcccggccatcccagttttttattttcctcctttctgtgtctttatgcatcagtgaggtggagcttttgaaaatgtcagatagctagattttttttttttgagacggagttttgctcttgttgcccaggctggagtgcaatggcgtgatctcggctcactgcaacctccacctcccaggttcaaaacaattctcctgccgcagcctcctgagtagctgggactacaggcacgtgccaccacacccggctaattttgtatttttagtagagatgtggtttcaccatgttggccaggctggtctcaaactcctcacctcagctgatcacccgcctcagcctcccaaagtgttggaattacagacgtgagccaccatgcccagctgatagctagattttttttttttttttttttttgagacggagtcttgctctgtcgcccaggctggagtgcggtggcgcgatctcggctcactgcaagctccgccccccgggttcatgccattctcctgcttcagcctccagagtagctgggactacaggtgcccgccaccacgcgtggctgattttttttttttttttttttttgtatttttagtagagacggggtttcaccgtgtcagccaggatggtctcgatctcctgacctcgtgatccgcccgcctcagcctcccaaagtgctgggattacaggcgtgagccaccgcacccggcctcgagattttttaaaaaatccattgtctgtttcgtcctttaacatctatttgatttctgatgtatttagattcatttatagcatatttgtgcattctatttttccatattttctgttcttttaaattttccttctcctttcttgccttctcttagacttttaaaaaaattgtagtaaaatacacatcacctaaaatttaccatttttaaatgtacagttcagtggcattaaatacaaattggaggccaggcatggtggctcatgcctggaatcccagcactttgagaggctgaggtgggaggattgcttgaacctggaggtcgaggttgcagtgaggtgtgatcacactactgctatagcccaggcaacagagtgagaacctatctaaaaaaacaaacaaacaaacaaacaaacagattggcatcacacagtgtgtgtgctgctgtgctgtgctgttatcatttaacattaaaacataaacatcagcactgttatggactgaatgtttgtgtcccccaaaattccagtgttgaagctcaaacctccaatgtgatgttatttggagatggggtatttgagaggtggttaggtttagatgaaatcaggagggagggtgggtttcgcatgatgagattagtgtccttataacaagagacagcagagagcttgctttctccaccatgtgagtatgcaatgagaaggcagccatctccaagtcagaaagagagccctcaccaggggctgaatgtgctgacaccttgatcttggacttctagcctccagaactgtgagaaatttcagttgaataggccccccagtctgtactattttgttatagcttgagcagactaatacacccatgttatgaaaagctataaacatccctttaaaggccacctaacgcgtcgtattacctcatgcatcttctctgctgagctttccaaaagagtggcttaggctgggcctggtggctcatgcctgtaatcccagcactttgggaggccaaggcaggtggatcacctgaggtcaggagttcaagaccagcctgaccaacatggagaaatcccgtccctactaaaaatacaaaattagctgggcgtggtggcgcatgcctgtaatcccagctacttgggaggctgagccaggagaatcacttgaacctgggagatggagggtgcagtgagccgagatcgtgccattgcattccagcccggccaacaagagcgaaactccatctcaaaaaaaaagagtggctggccgggcgcagtggctcacgcctgtaatccccgcactgtgggaggccgaggtgggtggatcacgaggtcaggagttcaaaaccagcctggccgagatggtgaaaccccgtctctactaaaaatagaaaaactagccaggcgcagtggcaggcgcctgtaatcccagctacttgggtggctgaggcaggagaatcgcttgaacctggggggcggaggttgcagtgagccaagatggtgccactgcactccagcctgggtgacacagtgagaccccgtctcaaaaaaaaaaaaaaaaaaaaaaaaagtggcgtatgttcccggtctccacctctcattcgccagcccctgtgaccaaacccctgggattagatctccatcgggtccctcccctcaccctaacctcacatgcagtggttcctgagaagctgctgtttatctgatcacgggatccagcaggatctgagggctcattcactgaatctgtactacccaacaaggcaggcttgtccttacccacacttttcaggtgaaaacttaatcagattcaagcgtttatcttagtggcctcttcgtggtgtgtgatttccttcttgcagctctttactggctaaaactcttcactgggagttaaaccaggtgtggtccttgaccctcatcattttgtcccatctcctatgctgggctctgtatccttgtctccaagcagtctcgtgtgacagggaagttacctattattgtatggtcccctcttcttgtcacctctggtgtggcacttgttccatttcttgttcaatgaatgtgatttgtgaatgtgccacatctgtgggaggaaggcagttcgcagcaagagttgtagttcccttgctttgccctgagggccaggactttacactagatttttttgttgcattcctgcactcataaagtacacgtaaacttagaggtggtgtgttaaatgctagaacttaaaactgagttcagctaggctcaagtgccccacaatttttgtcccaccagacaatttcatgaatatctacagattgttccctcaatatgcctcaatattgaggcatattgatttggggagcacagacaagtcaaggttgatgtgcatccgctgaacatgatcttaagttgttgaagtaggtattattaatgaacgaacgtctattttagctccaagagcccctggtcttccagaagagactcccaatgatcttccagaagcagctgggcttcttttggtcctcccccacccaggtgcagtcccgttctccctgcctgggtgagtttgattcctctgccgtggaataggctaggctgctacctcttgagcctcttccaccaggccatccattaggtggcgacagagagcactaaaaggaactactatggaaataaaacttgttttgcttcttggggggaaaaaaaaagaaaaaggcttgtggggcgtgtgtgcattttagtcagattttactgtgcaaaacatttgagagatttctgccctctttctcccttccattcttctcaacccactgggcgccctaccacccctgtctccttcaagataaggtagatcagaagaccaaatagacaaatgccatgtccactgttttctgtcacagttgatagccataccagtcacccaagctggaaacccaacaggcccctgcccttcactgcccacatccaagggagccaccaagtcccacaaattgttcctttaactgtttgtccctcttttgtcttctgtcatcccttctaccgctgtcctggttcaatccctcatcttgctctgggactcccatgataacttatgatctttcctccacctctctatcttccacacaatccctatcatcaatctcattcccctgctttaaacccaagagtggcaccctgtgtttgagtgacatcagggcccctcatgtggctcctgcttctctttgtggccccttctgttgctgctgcttttcttatggacatagccctcagcagtccaggactgcttgtagttcctcccaggtaccatgtttcttgcactcctggcctttgtcattggctcccctgcccaagtccccttctcttctcctttccttcccctgtggccttgccttgtcgtgcttatccttgaagaccctgtcaggtatctcttccccaaagagccctgcctaaccaccgcccccctcccccccgcgacacacacacctgggttaggccctgcctctccacgcctgtgcctcctgccaagtcctcagaggtctctgatcccatgtgcctccaggcatggcatagggggactgtgacacagcctctcggcccacagacccctgattgtgggcttgctcactgccccagtcagtcctcttattgaggattccgtgccagttcctgactccagcacacacacgcatgtaggccgccctcctagtgcctggctccttccctgtctcttctgccactcattcccatggtcgtatcctggagttggtcatctctggaactccacccacggagttctaacttagctctgcctatgatgaggacttactgtcttcccagcttgcagtgtcaaccactgtttgatgcccctgggactccattggtcttccctcctcttgtgaactgtgcccatcaccagacgaacttgttttagaatttaccatcgtaactgagctcccttcagcgcatacctccttggctcctgctcagtctctgtttctccttttagccaaactctctaagagttctctccactcatgggccctcttccttgcctgctgctccttgctcagcttgctccatgaacacttgcttttccacattccatgaaataatcttaacagtcatcagtggctgtcactccttctcagccctttccttgtgtctcttctggtacctcatactctccaggtggccatctcacctcacatcttgaaccctctgggtttgggagaattctcacctcacgagttgatgggaggcctggcgacctctgattgtagtcactgcaaatgccagatgcttatttgcctagcttccctttcggtcagggcagcagttggcaaacggtatctcaagggccaagtccggcccactgcctgttttcgtaaatgaagctttaccaggacccagttccaccccgtcctttgtgcattgtccaagactgctctcctgtacaacagcaggtgggctggttgtgacagatactgtctggcccacaaggtggaaaatactatctggccccttacagaaagaaattacctgagttctacacgagggtgtaggtatgtaccctggcctctgccagtcagactcacatgctaggaggagcagggccaggcaggagagccgtgtctcctggcattggggctgcaggaaagacgagctcctaggccacagtgccagtggccagtgctgctgccttgcagggtcgcacaggcagtgctggctgtttggactggcttggcagaaggatttgaagtattgttcctagccaactggactcaaacctgttcctccaaccctctagggattctcttatcacccagtagccttttccccctagttttaaaaattgcagtaaaatacacaaaagataaaatgtactgccttaaccatttttaagtgtacaattctgtggtattgagcacatttatattgtgcaaccatcaccacatgcatcttcaatagcttttcatcagtccttgtctgcataaatcagctagagttggtttctattgattgccaccaataatcttgacagatatgtctgatcttccttctctgcactgactcctctttctctgtctcctctgctgattctttctcctcatcacaactccaaatagcagggggagggttgtttacacttatattcagcacgccctcacgcactcgcctggctcttcagacctctcccctgaactccagattcatacatccagctgccctttaggcctctagaaagctaaatacctcagtatcaaaaacatgagaaacggaagccagagtcctggatctctcgccctttcgctgtcccggtgcccatgcccttcagggatggcacctagaccagctccctgcatccctgcctagactctgcagtagtctcacgtggcagacccggaggtcactctcctctctggatgccctgcggacactccggttagcctcagctgcaagagcctcctcacccaaggtcacgccatttccaggacagcaccctggtgactgagcgaggtaagggtacaaggcccttatagggccttctctttgacttcttcccacctccctttatggatgtcagttcctgatgaacatcttacacctcaaaccgtgacccaacatctgcttctgcagagcccccctgtggcatcttgtgccctcctgccccactccctctactctatatcttcccatagttagaatgggctttttttttttttttttgagataaggtctccctttgtcacccaggctggaatgcaatggcacagtcacgactcactgcagcctcaacctcctgggctcaagcagtcctcccacctcagcctcccaagtagctgagactacaggtatgcaccaccacacctggctaatttttatattttttgtagagactggggtctccctatgttgcccgggctggtctcgaactcccaggctcaagcaatcctcccgccttggcctcccaaaatgcaggattacaggcgtgtaccagtgtgcccagcctcagatgggctctttgaaaaatgtttattagatcaggttactcccttgagaaaaaccctctcagaataaaacccgaagtccattacttgaaagcagagccagcttcatgggcctttgtaactgcccatgggcttgctggaacccaggcttggtttaatactctactctcaccatctcaaaattcttaatttttgaacaagaggccctgcattttcattttgcaccaggctccacaaattgtgtaactgggcctgcctcagcagccacatggaacatgatccctccttgcctatttgagctcattctctaccattctctcccttgctcacctggctcccactgctcttgctcttcctggaacttgccataatgttgctagagtcagagccttggctcttgctgctcctcattggctggacccctctttacttgacctgctccctcaccactcacttccttcagatctgtgttcagatttcgtcttctcagagaggcttttggcccctgtccatctctctgaatttacctctgacctctcccccaccaccactgcgctaagctgcctcagaactttgtagacattctgtctggtcttctgatgtttcccccttggaagaatcccaaggtgcctgaagaatgctttctttatccttgaagttgagtaggttgactagagtctggcttgctattgagcattctttatcaaattgtcctgggaacatggtgtattctttcagtctgcagatgtagtcgttgctgtttcaggtcagctctcttatggatctttgacagcatcttctgttccatttgttgagttctgtacttcagggacacaaattcctcatgttggattgtctttgtctctcttccaatgctattagctttgccgtaattggtttagcttttgtctttttcatctgcattcactttgtctaatttgattttcagctatgtatattctgtttctggctgtttttcaatgtatttattagtttcataatgatgtgttttggtctgcagtttgtttctctaggttggaaatttgtcttttcatcttattctgttttatcatcccatctttgaactcttttattgggaacatgttcttatgaagttgtggggaatttttttcccttccttgtgtattctcttcttggtgggagactttgcctttctcgtgccatctccctccctgggcctcttttttttcttctggccataatatgtttgcctagttaccatgtcacttcttttcgtcttggctcaggcttggatggctctgcatagtcgttctgtttgctttgagacagtggaggaattcttggctctctcttcccagtttcttggcatcttctcttgctgttttcccctctgagctatcgcgtgcaggcttgttatcttgtatccggagagaatttgcacgctggagggagctgcagccatgtagtcttcagccctatctggattcttctctttgttctaagaactgtgttggatgtcttactaaggctcactctagctgcacgagggatgtgtgtgccatttccatggggatagggggcacctcagtctctgggtggttccataatctgtgtatacctaagagcagttgcttcccacagagctgggctggctcactgggcactttgccatttctcctgcacctcccagctggagtttctgggtctaaaaggaaaaagtgaaggactcccacttggttgcttctctccagcttactgactgcaaattcccagggcgttgcccgctccctagggtggtttctgggggacggggcaggagcctggctttgctgctgctttgtcctctggagtcttttctcagactgctttgaattacacccctttcctttgtgtgctgaaatcttcccttcacactctccttccctgcctttcttttgtgtcttatcttactaggactggaagagggcagttgtgcaggaggtctgcatctaattccctaatccatgtgagagtgctcctgttgtgtgctttgtgacatgatggtgagaaatactccctagagcagtggctaccagaaggaagccatccccccccctgcacacacacacacacacacacacacacacacacacacacacacacactccttctggctgtcctcagatgcctattctaggtaaatgtcagattccaaagaaaatccagttgagatcttttttctttttttgagacgagagtcttgctgtgttgcccaggctggagtgcagtggcacaatctcggctcactgtaacctccgcctcctgggttcaagcgattctcctgcctcagcctcccaagtagctgggactacaggcgcgcaccaccacaccaggctaaaatttttttgtatttttagtagagacagggtttcactgtgttggccaggctggtctcgaactcctgacctcgtgttctgcccgcctcagcctcccagagtgctgggattacaggcttgagccatcgcgcccggcctccagttgggatcttgactggaatgactggtgttcaatcattatagtttccacctaatttgtatttgtacacaggacagttactaatttgttggtacttgtttgatccccagtccctagagttgtttatggggtggagcttcagtccctgctgcttcccctgtggcagcagctggagtcagggtggggacccagggtgctgctggcagattcttgagacaggtagaatctcctctatattggtgtctctctctgtcccagcagtgcccaggaaaacctggccagcctgtcactgacctctccacctagggcactggtggttcaggtccttctatttgccaccggcaaaccgtacttctgccagtctggctcttaggcccagtttctctgatcttgcagattttcttgggctctgctacggaatcctcatacctccggcaggtccctcctttgcccatgtgtttaactgtggtggaatcgtgtgagagctgcttctctcgcatggatcccagccacaccacattctacagcggttcctctgaaggcattgatagagatatttcctcctgttttgcatttcgttggtcatttcagtagaatcagggtgaaataaacatgggggctcagatgtcagcattacgaaccaagtacgtcaggcaggctgatgtggactgacctacactagtgagacgcaagatgacgaaaacaagggcactcactccaagttactgatgagatgtttggatcaaatgagccagtccttaagcagagttctctagtaaaagagatctcctttctgccctttcttgttccccaaaatgtgttgccttcatggtgaaaatttattttggcagattttctcttctttgataaaagcagccaacactttgttaaaagtctgtgaaacttatttacatgaagtatgtaaaggtaagaaaaaaacattatcaacaagaaatggagaaagccagcagctgaggacagaaaagtcatgcacagtgtcagtgtctatggaaacaggccacttggaccttgaggactaggtatttggaattggaggtgagcttggcctggtgagtctctaaccacttgtgtgtaggatcagtgtgagaaccctgctagaatatagtggcagagatgcaaggggaaatcattggagaagttaccagggaatgatgagctaatctgaaaaaaatacatgtttctaagttgggcgtggtagctcatctgtagtcccagctacttgagagcctgaggcaggaggatcgcttgagcccagcctgggcagcacagcgagaccctatctccctaaaaaaaactttttcgttgtttagttttgggatttttttttttcctggtcttttttccccctttttgtgaataacgggatctcactatgttgcccaggcagatctcgaactcctgggcccaagcaatcctcctgcctctgccttcctaagattacaggtatgagccactgtgttaagcaaaaaaacttttttaaatgaaaatcattttttaaaagacaggctttccaggggagggtattattccacttatatgaagtgtcaacagtaggcagatttgtggagacaaatagattagtggttaccaggggctgagaggagtgggagtggggagcaactgcttaatgggtaaagggttgtctttggaactagagagtagtgatggtcgcatgacattgtgaatgtactaaatgctattaatgataaattttatgttatgtgtattttaccacaattaaaaaaaaaagatcaaatgtcctcagaatagccaacaaccttccacttggctaaatgcctactcattaaacttcttgaactaaattcctttctgattgtcatggttattgtgtcctgggcttcagagtttcacattcaggttggcttggtccagtctgtcatgtatcactataggtccccacattggcctcttcctcagacggacagcccatctatctgccggggctctgtgccacagccagatagacttgctctgagacagctgtgtgggctctgagcactggccaggcatcacaaaacctatctttatgatttagaataattggtggtcagctgctgttttaatgttgttgttttttttaatttagatataattcacataccatgaaatttactcatttaaagtgtacaattcattcttcagtataattcataggctcacagaaaaaattgtttaaaaataaaatgtgcaattcagtgtcttttagtacattcacagagttgtgcaaccatcgcctctgtgtcattccagaacactttcagcacccaaaagaaaccccagacacaggagcagtcacctcttattacccgcagcccctggcaacaactcatccacttcctgtctctatggatttgcctattctggacatttcctataaatggaattatgcactatttggccttttgtgtctggcctctttcactgagcgtaatgtcctcaaggttcatctgcattgtagcatgtgtcagaatttctttcctttttgaggctgaatgatattatatcctatagataatgaggttttgattatccacccatcccttgggaatgcatatttgggttgcccccaccatttggctgttgtaaactgtgctgccatgaacactggtgtacggatatctgtttggttactggttttggttttttgtttgtttgttttggttttttgagacaaggtcttgctctgtcgcccaggctggattacagtggcacgatctctgctcactgcaacctccacctcccaggttcaagcaattctcctgcctcagtctcctgagtagctgggactacaggtagcactcaccaccatgcccggctaaatttttttgtatttttagtagagacaaggtttcgccatattggccaggctggtctcaaactcctgacctcaggtgatccacccacctcagcctcccaaagtgctgggattacagacgtgagccaccgcacccggcatagttgtggctttttgagagtgtatggctaggagtaaaattgccaggtcatatggtaactccatgtttaacatttgagaaactgccaaactgttctccacagcaggaattttttaacctgtatgtggtgggcttgtgtttcggttttcattttacacatctataaagatgagatttgctgtatggcactggttgcctgtatttggggagggttctgcttttggttggcaagaactgcattttatttaagcttagcaaaacataactggtttctcgcatcttctcaaaagtggaggattaagaaatggactgcgaattcagagcagggcagctgaacctcaggctccacccttgtagccttcaagctgaacctcattctctcttgctccctggagaccactgagacactctgcctgtgccagtttgatttctcacatttttaaagggccaaagcttgtgtctcaaagtgctatagcctttattgattcatgcagagaagcctccttgattccgtaattctgcagctaatactggaagtagaaagaattggaaacaccatctggatgacactttagggtggaagcagccagtacaagggggggctcattatttcctctggtcccagactgttcacctggagctgtagccaccaccctgcccttaggttaactgcctcgagtggtagtttagctctttgtgctgtgccgagggataactggaagtgaaaggtgctgagaaatgccatctcctgaaagtggcgagcatgagtgaatttacgaaaggttgggatattgctggggctctggaagtttctctggagctcactccaggggacagggagggggctggattccaattcaagtgaaaaatacctttcatctgccttgttcacctggcttttttgcctttttgtaaaatctgaaaacctcagggattgagtagtctttccttaactgcagttgcctgtctggccacacctgccagctgttgcttgtacccctgtaatttgcacggccttccgggcctttctcacaagatcactgcaggtcacattcatgaggaaaatgcaggcagttcctgccatcagacccctcaggatgtcatggtttggcctgaaaacaagattcctgcaactctaattttcctttgctagatcaaatgaaggatttgatctaatgtttgcattctagcagcaaaatcattgaatattttatttcttaagagccttacttcatattttgtaggtattttaagattttgtaaaggcctttctgcttcaacgtgtgatgtgtgcattcttagaaaaagatcttgtgttctgtaaatcacacaataaaaacatgagttcgtgcaggaaaaactggggcggggtggatcactccaaacttgtgtggtgtggtaactggagctcactgatgaaaccatgaacagttctggctgaaagaaccccacagtacactgaggtctgttggcatcgccgccagcaccgccccggtccctttgtgcgcgccaccacacctggctaattttttatttttagtagagagggggtttcaccatgttggtcaggatggcctcgaactgacctcgtgatccgcccacctcagcctcccaaagtgctgggattacaggtgtgagcctccgtgcccagccttcagctttttttcttaatgtctttgtgtaatatgaaggcattctctttaattgttaaaaagcttgcctaccactgcttcaaaatattactgtcagttggcatagcttctgattatattgatgtcatctcccttcttttaaacatgttaccatattggcactgtatttcccctagcccattgatcacttgagagttagtcatagtcctcgtgctgtttcactcctaaacgtttaagcatgcctttcctaagagcagacagtacagttaagacactcaggaagtttagcaatgagctaacacagaaccttacatttctccacataccccataaatgccttttttagagcctttgagcctggaatgcagagtccaggactgtgtgttgtattcgattgtgtcatcccttcagtctcctttatcagaaatgttcccccacccccttgttttctctcatcatcttgagtccagaccgtggttgcatggcacgccctctctggactcttcctgctgtctcctcacggtaagcttcagtctcctactcgtgatgctggttcatctcagcagcactgaggggcctgagctcagtttggtcgtgtgttaaggtggtgcctgccagatttctccacagaaaagggccccgtacttttatttgctcttcagcctgtgtattccttcctttcttgccagcttgtgggtggcttctctagcagcttctgtaagatactcagtttggcagttgtagttgtttcagcaggagaggtgtctgcatacctgaccaccacatggctagaagtcgatccatcctctggcgtaaccatcctccatgctactgtccctggggcactgaggccctcctcagtgacttcctccacctcatcttccgccatctccaagccaccagtgtccaacggactactgatatgtcccaaactcatcatttgtttattcaccaattcagagcccacctttttttcagcactgagctagcctctccttgctagaagcttacggtcgaaggtctccagccatcagaagaagcacgtggagcgctgcgtccgtgttgtggttattcatccagcatgtgttgagtaagggttgcacctgtgcctggcattatgcattgagcggggagatgggggttggcacgcacagtggggtgttctaagtacactgagggctcgggtgccctggctcatagagcagggagggaggcaggagcagggaaggtgtctcagaagtgccatctttttttttttttttttgggaagtggaatcttgttctatcgcctggtctggagtgcaatggcactatctcaactcactgcagcctccgcctcccaggttcaagcgattctcatgcctcagtccccgagtagctgggaccacaggcgcacaccaccacacccggcaaatattttgtatttttagtagaggcggagttttgccatgttggccaggctggtcttaaactcctggcctcaagtgatctgctcacctcggcctcctaaggtgttgggattacaggcatgagccactgcgcccggtctagaagtgccatcctaactgaacctgaaagatgaaagttctccagatgaacctgaaagttctccaaatgaaaaggtgggagggggtgacagggttaggcccagagcctctggtgacacagggtgggcatcattggtcactttttcctcgagggaggggcgtcacacgggtgatagggtgggagctataaccatgttgatagtgccgcctctgcccatctggcctggcatgccctgagccctctgtcccacctgtggaactcataagccctgacagcccactcactcctgattcattatccacacccctgtgcttccgctgtgcctggagcaagctttcttcagggggaagggaggctggaactatgttgtagttacctatttgtcctcccttccaaactgtgagttcttggaggtggaaggatgctgcaggatctggctcaggacgaaggcagttggtgaacagacacgtgtgtttttgactcacggtgatctcagacaagttcctctgtctagtcgaacttctttttttccatctgtaacactcaggagttgaataggtggtttttctgaggatacttcaactgtaaaatgtatgaacttgtgaactagctatttagttctcctcataatcaagattgtgtgtgtgtggggggttctgattagagggaggatgaagagaggtgtatggggttttttttgttttgttttctgtttgtttgtttgtttttgagatggagtctcactctgtcacccaggctggagtgcagtggcacgatttcggttcactgcaacctctgcctcctgggttcaagtgattctcctgcctcagcctcctgagtaactgggattacaggcatgcaccaccatgcccagctaatttttgtatttttaatagagatggggttttcgccatgttggccaggctggtctcgaactcctgacctcaggtgatccacctgcctcggcctcccaaagtgctgggattataggcatgagccaccacacctggcaggtttctttgaaaaagtttgtgtttcggcaaacaccataaaccccctgggggacagccttggggagtcacctggcaccctagcccagcctccctcccttgggtcctgcagtgaaggcttagtgagggtgtgcaaatgcccaggtcaccctgggactgggcaggccctctgggctaagggtaaactcatttggaatacctgttttctatcattgttttttatttgttaaatttaaagggtacaagtgcagttttgttgcgtggatatattgtatagtagtgaagtctgagctttcagtgtaaccatcacctgaatagtggacattgtacccgttaagtaatgtctcatccctcaccccctcccacccttcccagtctctccagtgtctgccattcctcactctgtccatgtgcacatgctattcagctcctgcttctaagtgagaacgtacggtatttgactttctgtgtctgagctgtgtcactgaagacaatggactccagctccatccacgttttttatcatttttacctgcactccacacccagcacaatccaggcttctttgtgggttttttgaaatttgtctttaattataaaagtagcagccagcaaattaacaaacacccatgtgcctttcattgcacagaattgaaaatcatcatactatatttgcttcaagtaatttccattagaaagaactagaatattacagtagagttaaagaccctttatttcccatcttcagtgctcttaaaagttcatttagggccaggcatggtggctcacacctataatcccagcactttgagaggcccaggtgggtggatcacctgaggtcaggagttcaagaccagcctggccaacatggcgaaaccccatctctactaaaaatacaaaaattagctgggcgtggtggtgcgcatctgtaatctcagctactcgggaggctgaggcaggagaatcgcttgaactcaggagggaggcagagcctgtatgcagtaagccgagattgcgccaccacaccccagcatgggtgacagagcaagactccgtctcaaaaaaaaaaaaaaaaaagttcattcattgtacacttagaaatagttaaaaaggtaaactttgttttgtgtgtgtgtgtatatatatatatatatatatatatatatatatatatatatatgtatttttttttgagacatatatgtgtctggtttgttcgcccaggcaggagtgcagtggcatgatcaacggctcactgcagcctcaacttcctaggctcaagtgatcctcctgcctcagcctcccgagtagctaggattacaggcacacaccaccatgcccagctaattttttttttttttttttttttttgtagagacagggttttgctatgttgcccaggctggtctcaaactcctgagctcaagcgatccacctgcctcacctcccaaagtgctgggattacaagtgtaagccaccacacctgacctgttttgtatattttaccacaataaaaagcctttaaaaccccaagcagacagttcattttcattcaggcccaactcagaatctgatcacagcggggtttcccccctttctagcgagtagctgaagaactgttttctctccttgatggtataactgtctctgtgggtgttgctcccctgccgctccagtggttttgtttttgtttttgtttttttgagacggagtcttgcgatctcagctcactgcgacctctgcctcctgggttcaggcgattcttctccctcagccttccatgtagctgggacttacaggcacctgccaccacgcccggctcatttttgtatttttagtagagacggagtttcaccatgttggccaggttgggctcgaactccagacctcaggtgatccacctgcctcagcctcccacagtgctgggattacaggtgagagccactgcacccagccggcccctcagtcttttccttctcaatcagtggcaccaccatcttcccaggctttggacatggtccctgactcacccttgcccctcacccccacactaatccacctgcgagctctgttgcttcaccacctagaccagccccaaatcctcaactgcccccaccctgggccacacctggaccactgctagaggcctctcatgggccctccctgtttttctcttgcactccccgggctttctggcacaagatgccccagaagcagaatcacatatctctcctgggagccaatctagtgtgtttactgcccctggagtgttattgttggccttagaatatgtcccactacaggtttgcagagcactgtagtcaaaagtcatttgaaataaatcttttctctgtggtatattgtcaatttgatatagaattaaatttgtttcttttcttttttcttttctttttttttttttttaagagacagggtcttggccaggcgtggtgtctcatgcctgtaatcccggcactttgggaagccaaggtgggtggatcgcctgaggtcaggaattcaagaccaacctggccagcatggtgaaaccccgtctctgctaaaaatacaaaaattagccgggcgtgatggcaggtacctgtaatcccagctactcgggaagctgaggcaggagaaggcttgaactcaggagtcggaggttgcagtgagccaagatcacgccatggcactctagcaagactctgtctcaaaaaaaaaaaaagagagagagagagacagggtcttgctctgtcactcaggctggagtgcagtgatgtagtcatggctcactgcagcctcatactcctgacctcaggtgatcgacccgcctcggcctcccaaagtgctgggatcgtaggctgaagccaccatgcctggcccgaactcatttgtttttatttgcattaagtgtaataaggttttgttacttttagtttgaattttattttgggtaatataaacatttacatgattcagaagtcagaattacactgaggcatgttcagctaggcctcactcctgtgcctgtacccttacctttttccccctaccccatgcagggaatcaatttcattagttcctggtgtgtccttccttaatacccccccttctttctttggtagaatgcagtagatatgtttgcgctttgctccctttgcttcacagtggatcctggaaatgactccatcgcagttcttagagctcttgtttagtccctttggatctgcacagtactccagtgtgtgggcgcaccataagtttattcagcaagtgccctggtgatagggatcgggggtattggaagcctttggctggtaaaaataatgttgtagcaaataacatcatgcatatgttctttgagatttctggaggtgtctctttagcatagatttctagaaggcattccttacgtcacgtttaggtttatagtttgacctcatggtgattaaggtatttgggaaatgcaaatgagagtttcgaagaagccagatctttcccattagttcactgtttttctctgacattaggaccgtccgggttctagggagcagccctggcgttaggcagtgccatgatggattgtgtagaagtagcgattcccatctgtctgctttcttggcccactctgctggtggctccccttccctccctcctttatggggagctggggagctgcctaggggtccattctcaaaggctgatctctggtgggcaacaggccacacctagctttccagggttcttcgtcatttcccattgagagctgtaagactcagagacatgaaaaggaagctctggctgggcacggtggctcacgcctgtaatcccagcactttgggaggctgaggcgggtcgatcacctgaggtcaggagttcgagaccagcctgcccaacatggtgaaaccccgtctccactaaacatacaaaaattagcctggcgtggtagcacacgcctgtgatcccagctactccggaggctgaggcaggagaataacttgaacccggcaggcggaggttgcgatgagccgatattatgccatcggcaacagagcgagactccatctcaaaaaaaaaacaaaaaacaaaacaaggcgagctctgtgctgggacagattagggacccctctttacagcaagaaagactgctctgtgggttgtaggatgcctttgtgtatgcagtggctctaggtgactctggcagccacactctgggccctaaacttctggaggaagatacaggatagggaggaactcaggggtgagtcatggtggggacaagacattccctcactctaagaccttgtcactagattggaacatctcttgcctccctacacctgacctgatggttctggagagatacgtccttgcagcttctgagtcccagcactaagcagcctttggtaacttccctacatcatttgagttctggtttcctaaggatgcttgccagtgagtgccatggtgccctcattgcacagtctgtgcagtgtagacaagaggggaagtctcttggggtagaccagccgcaaggcggtgactagcactgatgtgaaccacatgggacaggggagttgtggggctgagaacacggagggtgggagtagtcatgctcttttccagaatgaactgctaacgaagggactcgcaggtggctgctgcttctttccaagctgcccctgttgttgcagaggctctggagtcctaggaggtttcacggtggcatactcgacagagtactagagcatcatggccagatagtgatgctggggtgtggggcctcacggtggccatttctgacgagaccccaccgggccaaagtgatgtgtagagaaggagctgcttcggtcaccagaaaagaacggggaagcctcccacactagaataggtagggtgctcttctccaccggcaggaaggggatgtatggctctgcctggaccacacctttttccttgctcttccctccgcatctgctgtggccgaggccattcctcatcagggaacatgtgttagaggctcacgccacctgggaccacttgtcttatcacccccaggaccctaggcggtagtttcctgtggcctgagttagctgatatttatatagtgccattgtgccttttctcctgtgatgctcacagtaaggatgcctagatggggttacctgttgtcaagataaggaaactgaagcacagaatgctgaggtcatttgctgggttcatgtttggaaagcggcaaaggatttcagtgcaggttggctggctccaaacctgtgtgtgctttccatgacactgtactgtgtgcctcattgagcctcattctagaaaaccaaaaacacacccaaggcccggccttcacaaaggagacccctcccccatttggctccctttccagcagtcgacggcctcttgtcagccatcgagcccagagtcccttgaagtgcgactcatgctggggtggtatgctcaggagccgcagtgtttccgctcagaggaaagggctctgattctcctgcagtgctaggagacttgtgggtggccacagtgcaggtcaggcacaccggccagcaccacccacagcccaaattcctaaagaaatatttgggtcccagcttggcccgagtctctgttgtcctggggaaggacatcaagatctgagtgtatgatggcctggggccttgcatgtggtgggggtccaagcctgcctctgctcacttgttctgcagactggcatgttctctgtgatacttacatacttgtttaacacttcagggaagaaaagtcagaagaccaggacctccagggcctcaaggacaaacccctcaagtttaaaaaggtgaagaaagataagaaagaagagaaagagggcaagcatgagcccgtgcagccatcagcccaccactctgctgagcccgcagaggcaggcaaagcagagacatcagaagggtcaggctccgccccggctgtgccggaagcttctgcctcccccaaacagcggcgctccatcatccgtgaccggggacccatgtatgatgaccccaccctgcctgaaggctggacacggaagcttaagcaaaggaaatctggccgctctgctgggaagtatgatgtgtatttgatcaagtaagtaagagcaactcctatctctacagggcagggagggcagggacaaggatccctcatggagcaggaaaatgtatgtgcccagggtggggtcggggggaacataaacaatgaacactgagaccaggtgtgcttgaaatgaccgtgtacagaggtcgctgccctgagtgggaagttctcaaggtagcaggccctctatcctctccacacctcaagtctttatctggggatggaatagctgcggaagcagaggaacttgcagagctaggggttcagaggggtgaagaagcatgtttcagttctgccttttaaatgatcccaaaaaggttagcagttttcaaatgacatttgcagacagcctcatttaattccatgagaagggtgagcaaaggattatcttgttgaaactgattcctggagagactgagcaccgtacctgagttcaaacttgggaatgttctagatggtgactcaggcccaggcaccaaccagcagaatgggcctcagcctgacaacccttctgtaccaggcctgactctttggttgctgaactttggagaggcctgggggggtcagcggcaggcagacgagtgagtggctttggtgacaggtcctcaggggcagccaggcagtgtgactctcgttcaatagtaacgtttgtcagagcgttgtcaccaccatccgctctgccctatctctgacattgctatggagagcctctaattgttccttgtgtctttctgtttgtccccacagtccccagggaaaagcctttcgctctaaagtggagttgattgcgtacttcgaaaaggtaggcgacacatccctggaccctaatgattttgacttcacggtaactgggagagggagcccctcccggcgagagcagaaaccacctaagaagcccaaatctcccaaagctccaggaactggcagaggccggggacgccccaaagggagcggcaccacgagacccaaggcggccacgtcagagggtgtgcaggtgaaaagggtcctggagaaaagtcctgggaagctccttgtcaagatgccttttcaaacttcgccagggggcaaggctgaggggggtggggccaccacatccacccaggtcatggtgatcaaacgccccggcaggaagcgaaaagctgaggccgaccctcaggccattcccaagaaacggggccgaaagccggggagtgtggtggcagccgctgccgccgaggccaaaaagaaagccgtgaaggagtcttctatccgatctgtgcaggagaccgtactccccatcaagaagcgcaagacccgggagacggtcagcatcgaggtcaaggaagtggtgaagcccctgctggtgtccaccctcggtgagaagagcgggaaaggactgaagacctgtaagagccctgggcggaaaagcaaggagagcagccccaaggggcgcagcagcagcgcctcctcaccccccaagaaggagcaccaccaccatcaccaccactcagagtccccaaaggcccccgtgccactgctcccacccctgcccccacctccacctgagcccgagagctccgaggaccccaccagcccccctgagccccaggacttgagcagcagcgtctgcaaagaggagaagatgcccagaggaggctcactggagagcgacggctgccccaaggagccagctaagactcagcccgcggttgccaccgccgccacggccgcagaaaagtacaaacaccgaggggagggagagcgcaaagacattgtttcatcctccatgccaaggccaaacagagaggagcctgtggacagccggacgcccgtgaccgagagagttagctgactttacacggagcggattgcaaagcaaaccaacaagaataaaggcagctgttgtctcttctccttatgggtagggctctgacaaagcttcccgattaactgaaataaaaaatatttttttttctttcagtaaacttagagtttcgtggcttcagggtgggagtagttggagcattggggatgtttttcttaccgacaagcacagtcaggttgaagacctaaccagggccagaagtagctttgcacttttctaaactaggctccttcaacaaggcttgctgcagatactactgaccagacaagctgttgaccaggcacctcccctcccgcccaaacctttcccccatgtggtcgttagagacagagcgacagagcagttgagaggacactcccgttttcggtgccatcagtgccccgtctacagctcccccagctccccccacctcccccactcccaaccacgttgggacagggaggtgtgaggcaggagagacagttggattctttagagaagatggatatgaccagtggctatggcctgtgcgatcccacccgtggtggctcaagtctggccccacaccagccccaatccaaaactggcaaggacgcttcacaggacaggaaagtggcacctgtctgctccagctctggcatggctaggaggggggagtcccttgaactactgggtgtagactggcctgaaccacaggagaggatggcccagggtgaggtggcatggtccattctcaagggacgtcctccaacgggtggcgctagaggccatggaggcagtaggacaaggtgcaggcaggctggcctggggtcaggccgggcagagcacagcggggtgagagggattcctaatcactcagagcagtctgtgacttagtggacaggggagggggcaaagggggaggagaagaaaatgttcttccagttactttccaattctcctttagggacagcttagaattatttgcactattgagtcttcatgttcccacttcaaaacaaacagatgctctgagagcaaactggcttgaattggtgacatttagtccctcaagccaccagatgtgacagtgttgagaactacctggatttgtatatatacctgcgcttgttttaaagtgggctcagcacatagggttcccacgaagctccgaaactctaagtgtttgctgcaattttataaggacttcctgattggtttctcttctccccttccatttctgccttttgttcatttcatcctttcacttctttcccttcctccatcctcctccttcctagttcatcccttctcttccaggcagccgcggtgcccaaccacacttgtcggctccagtccccagaactctgcctgccctttgtcctcctgctgccagtaccagccccaccctgttttgagccctgaggaggccttgggctctgctgagtccgacctggcctgtctgtgaagagcaagagagcagcaaggtcttgctctcctaggtagccccctcttccctggtaagaaaaagcaaaaggcatttcccaccctgaacaacgagccttttcacccttctactctagagaagtggactggaggagctgggcccgatttggtagttgaggaaagcacagaggcctcctgtggcctgccagtcatcgagtggcccaacaggggctccatgccagccgaccttgacctcactcagaagtccagagtctagcgtagtgcagcagggcagtagcggtaccaatgcagaactcccaagacccgagctgggaccagtacctgggtccccagcccttcctctgctcccccttttccctcggagttcttcttgaatggcaatgttttgcttttgctcgatgcagacagggggccagaacaccacacatttcactgtctgtctggtccatagctgtggtgtaggggcttagaggcatgggcttgctgtgggtttttaattgatcagttttcatgtgggatcccatctttttaacctctgttcaggaagtccttatctagctgcatatcttcatcatattggtatatccttttctgtgtttacagagatgtctcttatatctaaatctgtccaactgagaagtaccttatcaaagtagcaaatgagacagcagtcttatgcttccagaaacacccacaggcatgtcccatgtgagctgctgccatgaactgtcaagtgtgtgttgtcttgtgtatttcagttattgtccctggcttccttactatggtgtaatcatgaaggagtgaaacatcatagaaactgtctagcacttccttgccagtctttagtgatcaggaaccatagttgacagttccaatcagtagcttaagaaaaaaccgtgtttgtctcttctggaatggttagaagtgagggagtttgccccgttctgtttgtagagtctcatagttggactttctagcatatatgtgtccatttccttatgctgtaaaagcaagtcctgcaaccaaactcccatcagcccaatccctgatccctgatcccttccacctgctctgctgatgacccccccagcttcacttctgactcttccccaggaagggaaggggggtcagaagagagggtgagtcctccagaactcttcctccaaggacagaaggctcctgcccccatagtggcctcgaactcctggcactaccaaaggacacttatccacgagagcgcagcatccgaccaggttgtcactgagaagatgtttattttggtcagttgggtttttatgtattatacttagtcaaatgtaatgtggcttctggaatcattgtccagagctgcttccccgtcacctgggcgtcatctggtcctggtaagaggagtgcgtggcccaccaggcccccctgtcacccatgacagttcattcagggccgatggggcagtcgtggttgggaacacagcatttcaagcgtcactttatttcattcgggccccacctgcagctccctcaaagaggcagttgcccagcctctttcccttccagtttattccagagctgccagtggggcctgaggctccttagggttttctctctatttccccctttcttcctcattccctcgtctttcccaaaggcatcacgagtcagtcgcctttcagcaggcagccttggcggtttatcgccctggcaggcaggggccctgcagctctcatgctgcccctgccttggggtcaggttgacaggaggttggagggaaagccttaagctgcaggattctcaccagctgtgtccggcccagttttggggtgtgacctcaatttcaattttgtctgtacttgaacattatgaagatgggggcctctttcagtgaatttgtgaacagcagaattgaccgacagctttccagtacccatggggctaggtcattaaggccacatccacagtctcccccacccttgttccagttgttagttactacctcctctcctgacaatactgtatgtcgtcgagctccccccaggtctacccctcccggccctgcctgctggtgggcttgtcatagccagtgggattgccggtcttgacagctcagtgagctggagatacttggtcacagccaggcgctagcacagctcccttctgttgatgctgtattcccatatcaaaagacacaggggacacccagaaacgccacatcccccaatccatcagtgccaaactagccaacggccccagcttctcagctcgctggatggcggaagctgctactcgtgagcgccagtgcgggtgcagacaatcttctgttgggtggcatcattccaggcccgaagcatgaacagtgcacctgggacagggagcagccccaaattgtcacctgcttctctgcccagcttttcattgctgtgacagtgatggcgaaagagggtaataaccagacacaaactgccaagttgggtggagaaaggagtttctttagctgacagaatctctgaattttaaatcacttagtaagcggctcaagcccaggagggagcagagggatacgagcggagtcccctgcgcgggaccatctggaattggtttagcccaagtggagcctgacagccagaactctgtgtcccccgtctaaccacagctccttttccagagcattccagtcaggctctctgggctgactgggccaggggaggttacaggtaccagttctttaagaagatctttgggcatatacatttttagcctgtgtcattgccccaaatggattcctgtttcaagttcacacctgcagattctaggacctgtgtcctagacttcagggagtcagctgtttctagagttcctaccatggagtgggtctggaggacctgcccggtgggggggcagagccctgctccctccgggtcttcctactcttctctctgctctgacgggatttgttgattctctccattttggtgtctttctcttttagatattgtatcaatctttagaaaaggcatagtctacttgttataaatcgttaggatactgcctcccccagggtctaaaattacatattagaggggaaaagctgaacactgaagtcagttctcaacaatttagaaggaaaacctagaaaacatttggcagaaaattacatttcgatgtttttgaatgaatacgagcaagcttttacaacagtgctgatctaaaaatacttagcacttggcctgagatgcctggtgagcattacaggcaaggggaatctggaggtagccgacctgaggacatggcttctgaacctgtcttttgggagtggtatggaaggtggagcgttcaccagtgacctggaaggcccagcaccaccctccttcccactcttctcatcttgacagagcctgccccagcgctgacgtgtcaggaaaacacccagggaactaggaaggcacttctgcctgaggggcagcctgccttgcccactcctgctctgctcgcctcggatcagctgagccttctgagctggcctctcactgcctccccaaggccccctgcctgccctgtcaggaggcagaaggaagcaggtgtgagggcagtgcaaggagggagcacaacccccagctcccgctccgggctccgacttgtgcacaggcagagcccagaccctggaggaaatcctacctttgaattcaagaacatttggggaatttggaaatctctttgcccccaaacccccattctgtcctacctttaatcaggtcctgctcagcagtgagagcagatgaggtgaaaaggccaagaggtttggctcctgcccactgatagcccctctccccgcagtgtttgtgtgtcaagtggcaaagctgttcttcctggtgaccctgattatatccagtaacacatagactgtgcgcataggcctgctttgtctcctctatcctgggcttttgttttgctttttagttttgcttttagtttttctgtcccttttatttaacgcaccgactagacacacaaagcagttgaatttttatatatatatctgtatattgcacaattataaactcattttgcttgtggctccacacacacaaaaaaagacctgttaaaattatacctgttgcttaattacaatatttctgataaccatagcataggacaagggaaaataaaaaaagaaaaaaaagaaaaaaaaacgacaaatctgtctgctggtcacttcttctgtccaagcagattcgtggtcttttcctcgcttctttcaagggctttcctgtgccaggtgaaggaggctccaggcagcacccaggttttgcactcttgtttctcccgtgcttgtgaaagaggtcccaaggttctgggtgcaggagcgctcccttgacctgctgaagtccggaacgtagtcggcacagcctggtcgccttccacctctgggagctggagtccactggggtggcctgactcccccagtccccttcccgtgacctggtcagggtgagcccatgtggagtcagcctcgcaggcctccctgccagtagggtccgagtgtgtttcatccttcccactctgtcgagcctgggggctggagcggagacgggaggcctggcctgtctcggaacctgtgagctgcaccaggtagaacgccagggaccccagaatcatgtgcgtcagtccaaggggtcccctccaggagtagtgaagactccagaaatgtccctttcttctcccccatcctacgagtaattgcatttgcttttgtaattcttaatgagcaatatctgctagagagtttagctgtaacagttctttttgatcatctttttttaataattagaaacaccaaaaaaatccagaaacttgttcttccaaagcagagagcattataatcaccagggccaaaagcttccctccctgctgtcattgcttcttctgaggcctgaatccaaaagaaaaacagccataggccctttcagtggccgggctacccgtgagcccttcggaggaccagggctggggcagcctctgggcccacatccggggccagctccggcgtgtgttcagtgttagcagtgggtcatgatgctctttcccacccagcctgggataggggcagaggaggcgaggaggccgttgccgctgatgtttggccgtgaacaggtgggtgtctgcgtgcgtccacgtgcgtgttttctgactgacatgaaatcgacgcccgagttagcctcacccggtgacctctagccctgcccggatggagcggggcccacccggttcagtgtttctggggagctggacagtggagtgcaaaaggcttgcagaacttgaagcctgctccttcccttgctaccacggcctcctttccgtttgatttgtcactgcttcaatcaataacagccgctccagagtcagtagtcaatgaatatatgaccaaatatcaccaggactgttactcaatgtgtgccgagcccttgcccatgctgggctcccgtgtatctggacactgtaacgtgtgctgtgtttgctccccttccccttccttctttgccctttacttgtctttctggggtttttctgtttgggtttggtttggtttttatttctccttttgtgttccaaacatgaggttctctctactggtcctcttaactgtggtgttgaggcttatatttgtgtaatttttggtgggtgaaaggaattttgctaagtaaatctcttctgtgtttgaactgaagtctgtattgtaactatgtttaaagtaattgttccagagacaaatatttctagacactttttctttacaaacaaaagcattcggagggagggggatggtgactgagatgagaggggagagctgaacagatgacccctgcccagatcagccagaagccacccaaagcagtggagcccaggagtcccactccaagccagcaagccgaatagctgatgtgttgccactttccaagtcactgcaaaaccaggttttgttccgcccagtggattcttgttttgcttcccctccccccgagattattaccaccatcccgtgcttttaaggaaaggcaagattgatgtttccttgaggggagccaggaggggatgtgtgtgtgcagagctgaagagctggggagaatggggctgggcccacccaagcaggaggctgggacgctctgctgtgggcacaggtcaggctaatgttggcagatgcagctcttcctggacaggccaggtggtgggcattctctctccaaggtgtgccccgtgggcattactgtttaagacacttccgtcacatcccaccccatcctccagggctcaacactgtgacatctctattccccaccctccccttcccagggcaataaaatgaccatggagggggcttgcactctcttggctgtcacccgatcgccagcaaaacttagatgtgagaaaaccccttcccattccatggcgaaaacatctccttagaaaagccattaccctcattaggcatggttttgggctcccaaaacacctgacagcccctccctcctctgagaggcggagagtgctgactgtagtgaccattgcatgccgggtgcagcatctggaagagctaggcagggtgtctgccccctcctgagttgaagtcatgctcccctgtgccagcccagaggccgagagctatggacagcattgccagtaacacaggccaccctgtgcagaagggagctggctccagcctggaaacctgtctgaggttgggagaggtgcacttggggcacagggagaggccgggacacacttagctggagatgtctctaaaagccctgtatcgtattcaccttcagtttttgtgttttgggacaattactttagaaaataagtaggtcgttttaaaaacaaaaattattgattgcttttttgtagtgttcagaaaaaaggttctttgtgtatagccaaatgactgaaagcactgatatatttaaaaacaaaaggcaatttattaaggaaatttgtaccatttcagtaaacctgtctgaatgtacctgtatacgtttcaaaaacaccccccccccactgaatccctgtaacctatttattatataaagagtttgccttataaatttacataaaaatgtccgtttgtgtcttttgttgtaaaaatcaagtgattttttcataaggttcttttactattggaaaagatgggcagcacgcagttttattttatttttgtaagttttttaatacatgtgaaagcaaagaatactcagcatgcctttctaagtgacgcgtttgcaccttttgttgggaagtactgtatcctgtgctgttagcattctcgataaatctctctgtgaaagtga

SEQ ID NO: 7 - DNA, 41256 bp, Homo sapiens
  source 1..41256: mol_type = genomic DNA
cgttttcttgcttggggcgaaagggggcagcggagcggagcgcccgaaacccagcccctgcggaccgcaatctttgggaaaaaggcgcaaggtgggaacgcagggccgcacgtgggaaccgttcgcggctgccgggtttgcagcccctgcccgcgcagctgggagccgcaggaggcggcccgggactccagcctgcagcccctatcccgcctcctcccacgctccagccacggcgcggcgctacctgctgcagcctctcttctccggagaggcccgggctcctccctacacccccgcggcccagccccgggtcccaggctccggctccgggtcagcatcctcgcgctcaaggcggtcatgccggactcctgcggactacacatcccggcggcccatgcggccccgtcacgtgatgcaaggatcgccggcctttccgccagagggcggcacagaactacaactcccagcaagctcccaaggcggccctccgcgcaatgccgctaccggaagtgcgggtcgcgcttccggcggcgtcccggggccaggggggtgcgcctttctccgcgtcggggcggcccggagcgcggtggcgcggcgcggggtaagtggcggtccccacggggcaagtggcggtccccacggggcagcggcctagagaggcggaccccgcagtgtccgggtcccgggccctcacccgcgcccactgcaacccgactccggagctccgagcatcccttagttttaagtcatggcgggtgcgaacgggtctctgctgcaggcggctccgtgacagctcctgcttcacatgggtagaggagagacggcaaacgtcggggctcccaggacttcgcggcggcagtcctaacccgtgcactgagtcgggcggggcgggcggcagcgtctgagtagagagctctctagaccaggcctggtgtctcccgggctttcctaggtgcctgtttgcgagctggtcagctgggctgtagttgagttctcccagggagtgtgggaggaaaggttatgcccaccagagacccagggtcctgacggctggaggtccgcagtggggaaggtgggcagaggtgttgctcagatgtccccattcctgtttcgtttgcacagaggggttttctggtgcgtcctggtccaccatggccaaaccaacaagcaaagattcaggcttgaaggagaagtttaagattctgttgggactgggaacaccgaggccaaatcccaggtctgcagagggtaaacagacggagtttatcatcaccgcggaaatactgagagtgagtgagctacctgtgtctttgctaggctagagggaaatgcagagaaggctgggtttggtcttgcaccaggttctgtgggagacgggttgctggcaactgtctacacaggaatgctgtctccagtacttggaggccgacatgtccttcctcaggagacttcgaaagtcaggatcttggtgacctggttcaggcacacttgagttactattcagatgttgatgaaagaaagcccatcttatagatgaggcctgagtatcatcatcttcacaggtaaggatatgtccaggtgttacatgataagatgtgagttcctgggagaagtaggttctttattttattttttttttgagactgagtcttgctctgttgcctaggctggagtgcagtggcacaatctctgctcgctgctacctctgcctcccagtttcaagtggttctcctgcctcagcctcctgagtagctgggactacagacacgtgccaccacacccatttaatttttgtatttttagtagagatggagtttcactatcttggccaggctggtcttgaactgctgacctcaggtgatctgcccgctttggcctcccaaagtgctgggattacaggcatgagccatcgcacatgggctaggtcgttatcttttatgtgtgtttgtgtctttgtcacacatgcctggcattgtgttttgcccatgagtaaatgctgaatttttgcacttgtaaagttttctacttagaaacaactaaaacgttcatcaactgatgaataaaatatagtccatcctggctgggtgcggtggctcacgcctgtcatcccagcactttgggaggccgaggcgggtggatcacctgaggtcaggagtttgagaccagcctggccaacatggcgaaaccccgtctctactaaaaataccaaaaattagccggtcatagtggtgggcgcctgtaattccagctactcggggggctgagacgagaattgcttgaacccgggaggcggaggtttcagtgagccgtgatcgcgccactgcactccatcctggggaagaagagcaaaactccgtctaaaaaaaaattgtgcagtttgaaattgtatttcatgttatgttttatctcaatacaacatttgcagttgtgaaaaaaaattgcacattctcaactcctcgggatggagcagtaaagcccctcagtaaatctttttttttttttttttttgagaccgagtttcgctcttgtcacccaggctggagcgcaggggcgcgatctcggctcactgcaatctccgcctcctgggttcaagggattctcctgcctcactctcccgagtagctgggattatagacgcccaccaccacgcccagcaaattttttgtatttttagtagagacagggtttcatcatgttgggcaggctggtctcaaactcctgacctctggtgatccacctgccttggccccccaaagtgcagggattacaggcctgagccaccgcggctcgtcaagtgaatcttgattccagaaagatctgttttaagtctctagtctggaaaatgcagtgggagtctttaggtggtttgtgacttgcagttaaggagaccgtggcctgagcactggcccctttttcttctttcatctctctccaggaactgagcatggaatgtggcctcaacaatcgcatccggatgatagggcagatttgtgaagtcgcaaaaaccaagaaatttgaagaggtaggtttatccagttgagctactagagagaggcacgtagactattcagagcctgagtttgctttttttaggaacatggttgacagctgactgccgatgatctggtttgcactttttttttttttttttttttgagatggagtcttgctctgtcgcccaggctggcacaatcttggctcactgcagcctctgcctcctgggttcaagcagttctcctgcctcagcctcctgagtagctgggattacaggcacgcgccaccacacccggctttttgtatttttagtagagacggggtttcgccatgttggccaggctggtcttgaactcctgacctcgtgaaccatatgcctcagcctcccaaagtgctgggattacaggcgtgagccactgcgcccagccagtttgcactgttttaggggaatttagctttcatcgtagtgatggggaagctactggaaatgccccgaatacaaccttgagggaccaatcaagcgtggaaatggggagcaaagggattaggcttttctagcaacaccagaaaggatttctatgccgagcgggggtgcgggggcttatgcctgtaatcctaggactttgggaggccgaggtgggtggatcacgaggtcaggagttcaagaccactctggccaacatggcgaaaccccgtctgtactaaaagatgatgagccgggcatggtggcacatgcctgtaatcccagctacttgggaggctgaggcaggagaatcgcttgaacccgggaggcacaggttgcagtgagccgagatcgccccactgcactccagtctgggtgacggagcaagactctgtctcaaaaaaaaaaaaaaggaagagtttgtagtggctgatagaaacgcatgctcactcgctctctcctgttacaagttcaggccaagaaaaatcaagaaagggtttgttccacagagaacaatcctaggcacgctggtcttggtgccattttgggagggtgactggtcggtggtattgggcgacctcacggacatagaaatatttattttgggcaaacattgccagactttcctgatgacttgtggacaggacaggaagtggtcattttgggagtgcaggttgctggtagagcacctgagggctctgcccttgccttgcccagcatttgtgtgtgggagagcagtgagacctggacctctcatgctcagatctgctaagaggagagtgattgctacctctgcagcagctcatctgaaacgtgctggccgtacgctaccaaagataggtgtaaagaacaggtgtccttagccgggcgcagtggttcacgcctgtaatcccagcactttgggaggccaaggtggatggatcacctgaggtgaggagttcgagacccgcctggccaatgtggcaaaaccctgtttctactaaagatacaaaaattagctgggcatggtgtcgggcacctgtaatcccagctacttgggaggctgagggaggagaatcgcttaaactcaggaggcagaggttgtggtgagctgagattgtgccattgcactgcagcctgggcaacagagcaagactgtctcagaaaacaaaaaaaagaacaagcgtcctgcatcctgttctgaaagttgtttgtgtgggtacggggcagcctgtgagtggataaataggcctccgaggctgggatggtcccgggccctgtgtccacggatctttgcagctcaggttgcaacggtaagagtattgtcaatgagacaaaggaggtgagagtgccagttgtctgaattggttgggatgttggtcagatgacatctaaaagaacacggccattttgttattatttggttagagacaaggtctcactctgtcacccaggccggggtgcagtgtcacaatcatggctcactacagcctcaacctgccaggctcacgtgatcctcctactttagcctctcaagtagctgggactacaggcatgcagcaccacgcctggctaagttttgtattttttgtcgtgacagggtctcactgtgttgcccaggctagtctgaaactcctgggctgacgtgaccctctcccctctgccacccgaagtgctgagattacaggtgtgagccaccgcacttggccagaacacggccattttagttcccctccttagaggagtaaggccaggaatgagcctgtggtctgaaagccgtggctgttggttaatgtggagaagggaaggtggtgagagccagcccaaacccctgccgagtgagactgattctggcagctttagggagcagggatgagcccctcacaggctgggtggtagttagaggaggcagatttcagaaggccacgcagcgctctttctcagcaggtcaggcaggcagcagaggtcgggcaggggcatggggtcgagggcccgatgctggtgtgttcactagaggagagccacaagcagggattctgggtcaggtgcaggcctagggcttagtgtgcacttgtggttctgagactgtcccatgacttcctgccagcattccggcagctctagtgggactccctcctggtccaggtgaggccaccattgctgccctggcttgctgctgtcctctcagcccccagtctgtcacctggtgggagttaaagggacctgctggggtttgaggaagctctgagccgttccctgtacgaagcctgtggtcatctcaggctgcaggagacacaggagatacgagctttggaggtggggctctcagtcacaagcccccgttgttcctccctgtcctccgctcacggcactgctccagttgccggggccagggttcttggagagcacatcctcaccgctgtcccctctgctggtgacagcacgcagtggaagcactctggaaggcggtcgcggatctgttgcagccggagcggccgctggaggcccggcacgcggtgctggctctgctgaaggccatcgtgcaggggcaggtaaggcccagggcgacgctgggatgggtgacgtcaggctgcccactgactgtcctgtccctgctgggccgtgtttggactcctgcctcggtgagttgctgggcacagggtctaggggctgatgggctctggagctggatggcctgtggggtctcctggtgtcatgaggtctgtgtgaccgtaggcactgcctcctcgcctgtaaacagatggtcactgcaccttcctcttatgggatgttctggggatcatatgaggcagttctcgcagagtgctgagatcgtacctggcagctggtgtggggctacggtgttgttttgcccttgcaccctttcggggccactcccctgctcactgcattccatctgtgctggtcttggctgaccctgaacacccaggcctcttggtgttcctgcctcccctggtcggccacttctactccttcatgtcccagctgctcagaagggccgtccactctcacaggctctcctgggtttcccccactcaggccttgtcctcagtctctgagcacaaggctgtctgccctgcaccgagtgcaggggtcgggcaggagctgtgtcatcccctgctctgcgccacccgctgtgccaggtcccgacacacagcagttgctccccatacgccgctctgcggtcggccggtgcatccggccccctgccctgtacaatgctgatgctgcagacctgtctcttgcagggcgcctctgtgggaaggagaggggtccagggctggagtccgggtgcccctgcacttcagggacttcttggcagccgtgtgggcgacgctggcaggctctgctgatcctgtggcttttgtctttagggcgagcgtttgggggtcctcagagccctcttctttaaggtcatcaaggattacccttccaacgaagaccttcacgaaaggctggaggttttcaaggccctcacagacaatgggagacacatcacctacttggaggaagagctgggtgggtgccaccttgggttggaggtttctctggccttgacgatcaagtgtaacctggatgggaaggacctggggctggggaggggctgccgttctcagggatggcctgcagcgggtatgcccaccctgcttcatgcacctgggctcacctgcgtggccggagtgcccctgaggcacgtgttaaaaatgcagagtcctggccttcaccccagacctgctgactgtgagtctctggggcttggggcctccgaacacctctgcaacggcaggagctgggcgagttctgtcactgggaggtggtgctgctgacttggtctcaaccggagcgtactggtcccgtcttcctcctcctttctccactttgtggaccttcctcctgccatcctgtggtgggaggtttccattagtcttgggtctctgtgtcatgattctgggaagtagagaaagaggaggaagagatcggtctgactctggctttgctgttctgtcgcccagaaaagggcctcagtggctgggctgcctgcaggacaggtgccggccaggtgcctaccgtcaggtttcctgtctgaggtgacgtggccggcagccaagtgtgcacacgtctcctccgagccactctctgctgggggtggggaacgcccaggagtctggtgatgtcggcgtctcccagcctcgggttgggccctgagtgtacggcatacacacttctgctgccgcctcggcacagaccctctgtgcagccccaggggcggtagatcctagtgtccgtgcgtagccggcctgccctgggctcccctgagcctcttcgggcccagtgcgtggtctgtctgttgctgccgggggactgatgatggggtttctggcagtgacgggtttggacacactgtcctgcggcgggagggggaggtgagtgggagatgtagattcggcgtcctcgcaaactgccgccgcttctcccccagctgactttgtcctgcagtggatggatgttggcttgtcctcggaattccttctggtgctggtgaacttggtcaaattcaatagctgttacctcgacgagtacatcgcaaggatggttcagtaagaaaagaattgagatcctgttctgataatggtcctaagttcagctccgcagtgaataaagttgaaaccaccaaaaaaatagaggttgggctgggcacaatggctcacgcctgtaatctcagcactttgggaggccgaggcaggcggatcacgaggtcaggagttcgagaccagcctggccaacatggtgaaaccctgtctctactaaaaatacaaaaattagccgggcatggtggtgggagcctgtaatcccagctactcaggaggctgaggcaggagaattgcttgaaaccggaaggcagaggttgcagtgagcggagatcgtgccactgcactccagcctgggtgaaagagcaaaactccatctcaaaaaaaaaaaaaaaaaaagagaagtacgtagctatcttctgtttagctctcatctgatgtcttggttatctttttgttgtttgtttagaatgttgcatgagctctgtctcactcatgctgaacacccagcaccgagagcagtggctggcgcacagcaggcacctgagtgcttgttgggtgggtgggacccccagggaggatgagccatgcgtgttattgacgtcatagagtgactagaccacagcccgtggtggctcggccatccaggcagtgctgccgggactgagctcggtgctccctgcaggatgatctgtctgctgtgcgtccggaccgcgtcctctgtggacatagaggtcagtgcctcccctccccagggccggcccatttcaccctggtttctgggaggctggggcttgggggttgagccctgtgtgccacctgctggctgtgtagccctgggcaagctgctcggtctctctgagcctcaggagtcccccatgtaagtcaggatagccgggcgcctccatgtggagatgtagctcagggtggatgacagcatcaatgacccacagtgacagggacgtcaggtgcttcccacatgcccgcttgccctgtggcttggagagagggtgccatggcagcggggagaggtggcagcgcaggctgaaggaggtgggaaggaagcctgggtgtcctctcctgtggggaggagctggggtaggacgggcgtgagccgtctccctctccaccaggtctccctgcaggtgctggacgccgtggtctgctacaactgcctgccggctgagagcctcccgctgttcatcgttaccctctgtcgcaccatcaacgtcaaggagctctgcgagccttgctggaaggtggggtttctgaaactgctctggaaggttcctgagagcacatggatgggacaagggccatcctgtctcccatgaatggttgtctgattcttggggtggccagacaatggcctgttgagggacggccagtgtcattttcccaggcagttgagctgaggtcagggttttggtggcattttgagaaccctgctgcctctgtctttgggaggagatggtggcgagctggccggaccttgggtggctatagggcagcagccaggcggggccagcagcgggactggggctgggggcagggcttatgcctgccagcccctgacacgcattgtgtctcgcagctgatgcggaacctccttggcacccacctgggccacagcgccatctacaacatgtgccacctcatggaggacaggtgagtgtggtgggtggggcgcagggcagtggaggccagcacagccctcggggcagctccagtgtcccttgccaagcacacactggcttagagagtccttgtcctctcgggcagctgttccagaggctgccactagagcgaggcccatgacttctaggatccagcccctgtcctctccttcctctgtcagttcaacagaatatccacacccagctcagtgcctgccccatgctcggacgtcctccagcggtgctccccaactacttagcctgttacaaggcgaggctcggggtcttggcttgacgttgcccttgccctcacccccacagccaggctgtggccacttttgttgctttagccattagagatggctcagctctgcccacaccctggcctcccacccatgctgccagctccccctcctgctctcctgtatccatccgcgcctcctgaagcccactccatgcagcacccgggtggcctttttctgacacagatatgtcggtgtcaccctttgctggaagccaggtggttcccagcgcccttgggatgtaggcttctcctatggaaccaggccctggggccagccctgcctcagccctgcatctctcccagccctgcctcggcccctgcatctctcccagccctgcctcggcccctgcatctctcccagccctgcctcggcccctgcatctctcccagccctgcctcggcccctgcatctctcccagccctgcctcggcccctgcatctctcccagccctgcctcggcccctgcatctctcccagccctgcctcggcccctgcatctctcccagccctgcctcggcccctgcatctctcccagccctgcctcggccctgcatctttccttccctccatccttggaaccaggccctggggcccagccctgcctcagccctgcatctctcctagccctgcctcagcccctgcatctctccctccctcctcccgtagaaccaggccctgggggccagccctgcctcagcctgcatctctcccagccctgccccaccccctgcatctctcctttcctccatcttgccttctcccctccaccaagggcttgtgcatgccctgattcctcttgccagcaggttcttccacctttgccgagttactctgtttactgaggtcttagcgtggtcactgactcccccacctccctgagtagtttttgctgtggctttccttcttggctgtgattggaggaagagattttgcgtttacctgggagattatgtggctggcgcctgtctcccccagactgcgaggctgtgggccatccctcttgcctgcttcctgtccctggcatgacctgtagctcacagcgtggtcagcagtgatgggctgccgcctgtgcgcaggagtgaacaagagtgttactgctggcctctgttccctgcccttccccagcggtgctcctgccccccccaagcacagggacctctggggctgctgcaggagcctcggcaacctcacacatccatggcggaccctgggacagggccctgctcacattccgtctctctggggaacacttttagagcctacatggaggacgcgcccctgctgagaggagccgtgttttttgtgggcatggctctctggggagcccaccggctctattctctcaggaactcgccgacatctgtgttgccatcattttaccaggtaaggcggtttctgtgtgcagtgagctggcaggaacgggagagctcccctcacgcctgcccacccatcccactgggggtcctgctgcgggggctgcggtggcatttctaggcctttccaggcagttgctttgcagctgggggtgaggtttggggccctttgtaggctttagtcttttttttttttttgagaaggagttctgctctttctgcttggctgactgcaatctccgcctcccggattcaagtgattctattgcctcagactcctgagtagctgggattacaggtgcctggtaccatgcctggctaattttgtgtttttagtagagacggggtttcgccatgttggccaggctggtctcgaattcctgacctgaagtgatccacccatctcagactcccaaagtgctaggattacaggcgtgagccaccatgcctggccaaaggcttttttctctctctctttttttttttttttttttttgagacagagttttactcttgttgcccagggtggagtgcaatggtgcgatctcggctcactgcaacctctgcctccccagttcaagccattctgcctcagcctcctgagtagctgggattacaggtgcctgccacagtgcctggctaatggttttttttttttttttttttttttaatgggacagagtttcgctcttattgcccaggctggagtgcaatggcgcgatcttggctcagcgcaacctccgcctcccaggttcaagccattctcctgcctcagcctcctgagtagctgggattataggcatgggccactacacacagctaattttttatttttagtagagactgggtttctccacattggtcaggctggtctcaaactcccgacctcaggtgatccgccagcctcagcctcccaaagtgctggaattataggtatgagtcaccgtgcccggccaaggctaatgttttgtatttttattagagatggggtttcaccatgttggtcaggctggtcttgaactcctgacctcaggtgatccacccgccttggtctcccaaagtgctgagattataggcatgagccactgcgcgcagcccaaaggctttattctcaagcaaaccttacatcttgcgagtttcaccttctggagttggcagtggaggggtgaacgctgcctcgggggtagccgttctcttgctgttggcggctctgttttgtcaagtgctggtcttgtcctgtctctgcaatgacgccgtggcacagacgctggtggtacagcttcagtttccgcagtgccccgtgatgacagcgctttttgtgtccgtcctcgttctgtgctcacagctccctggagggtggggcgatcacgtcgtcctggttttatagtgatgagctgcggtgtgggtcacagggctctcctgatcctctgctcttcctgctacccccctccccgtaggggcggtggggggatgttgtctttgtgcacagcttgcagccgaactcagggcagctttcagttgctgctgggctggcccaccgggtgcccaggattcagttgctggtctgtccgagtcagggactttgcaggcaggcatgggggtggggcccgtctgggtcctgactgtgctggagcatgtagaaacccctcctgggcgccccacctgctgtttctgcggcccctgataaacgtgtggtgggcactgcgcgctcaggcgtgctactctcggtcccaagggtgactgggagggcgtcccacagcaagcaagcagctctgaccctgtgtgctggccgggctcgtgttccaggccatggcatgtccgaacgaggtggtgtcctatgagatcgtcctgtccatcaccaggctcatcaagaagtataggaaggagctccaggtggtggcgtgggacattctgctgaacatcatcgaacggctccttcagcagctccaggtggggtgggggcaggagctccggggagcaccgggaacccagacaggcaggctcggcccactcagaagatggtaccttgggccccatctctgggggtcccgcagagactgccagaaccgtgttctctggtgattcgcagtggcgctcatccaccttccaccggagacaggtctgatttttccagacgtggtgcatcgtttaggccccagacaggaatatgcagtaggtgagccggggctgggccagtgctgtccacagtccgcagagtgacctgcaggccgccttcgtggcctgagtgggccccggcacagttcccagagggatgccagtgtggcttccgcatgactttggaggaccgcattagtcgagtctgttaaccacagctttaaggaggactccacggccacacgggctcatcagcataggggccctggggaggcgaggctagtatccagcagcctcagggctgtgccttttcctggagcctggggcgggtgatgtacaggaggccaggcagcagaagggaggccgggacttcgccgggacttagcagggactgaagtcctctcagagcctgtcgctgggccagagcattgcccccgaccgctggtggcagtggcagaggtcatagcctggggcttctaaaagaggctggacctgggagaggcaagaaaggcttgtagttgtggctactcttggccctcctgcccgagcttccttcttggcccagctgcatgggcacagccaagattccttggggggtggggtacgggcaggaacagcagctgccatcacagccactgtggccccttgagaggatctggggggtgtcctgggccacgtgggtcagggtggcccctggagaggatctgggggtgtctcaacccatgaggcccggagcggcctcagagggctgggggcgtctgtccccatgcggcccagagcggcctgagagggctgagggtgtctccatgcggtgggtgtgtagcgaggcctctggtgccaagtccatgtggggagtggaagtcagcctgtgtcatcgtgcctggtactgcagaccttggacagcccggagctcaggaccatcgtccatgacctgttgaccacggtggaggagctgtgtgaccagaacgagttccacgggtctcaggagagatactttgaactggtggagagatgtgcggaccagaggcctgtgagaccccctcctgggtggggcctttgggctttggctggtggggaggggccgggtgctgggtgaagtgcagctttctgagcctcagaagccaagggccaggtgggcgcctgctttccaggtttctgcactcggcagggaaggctggcaggcacagcacgtgtttggtaacaagctcggggctagcccacccatcagtttcctcccacctgtgtggagcaagcttccatccggctctgtagagtcctgtggctcccaggcggccgcagtcattttgccaggaacactcagcttagggcccaggcttttccatgggtttggacacaagtcttccccgctgccaggagtgcctttgtgtctgggctgtgggctgcaggctgtgaggcggctgggctctgacagcaaaccagcctctcgaccagcagcccagtgtggagaaggagagcgccggaggggcagaggggcaacaccggctcttcttttgacaggagtcctccctcctgaacctgatctcctatagagcgcagtccatccacccggccaaggacggctggattcagaacctgcaggcgctgatggagagattcttcaggtagggggtcctctgtagccttgcctggcacctggagcctggccctgtctctgtctggggcccacccgggctgggtctcaggatgcccgatgagcagggccctcccctctgcctctggagagccctggctctgggtgagcaggtgctagcttgctttccagtccagcaggacaggtcctctcatgacgccactgggctccctcttttcgggggtcgtctggagagatgctccctgggaagcagagctctgtgccctgtgtgcctggccgcgggaggacccagagtcgggctggcctgcgccaggcagacgggctggtgtggggctgtggccgggcactccccacccgccccagcaggctgccgtcccgcaggagcgagtcccgaggcgccgtgcgcatcaaggtgctggacgtgctgtcctttgtgctgctcatcaacaggcagttctatgaggtgcgtgtccaggcggccgcagctgggggctcagggctatttctccgtgggcgggctgtctctgttgtgcacgtgctcccgcagagccgggctctgcctgggacttcggtcctgccggaccctctgcagcccccagcgtggtctgtttacccctgttcattcactggcttgctcgtcctgggtgcctctgccaggccttgacacgtggccaagtagcaaggaaggcacagtgcctgccctcagggagctccggccggttttcacccaacacaggagcctcttaaaaattctgtgtgagttcgtttcagccagtcttgcatggggacattgtcttccgtttcagtcctgacgttcaccctgtgcacctgcgtgatcgccagccctgcctggtctctcctctgcgggctctccctctccactccctcctctgggagctctgtggccccaggcccaccttccttgagagacatttgtgtgcctgccagtcatacccctttcccaggaggcgcagcttaggctctgaggctgtcccttcccaccgaactcctccctgcagcctcgcagtcctgccctcctgagagctgcccactctgctcctctccccagcgtccactgtccttgaattgccctttgctgggcattgcgatcccgcattctgtctgagggagctaagggcctcctggaagttcctctgggtcctctggcttctcccatcagggctggtcttgtcctggtctctgttcctgtggaactttttacctgcttctgtgaaaactcacgctgtcctcagcacagcacgcacacacacgcatattcacgcatgcacaggcacacacgtgcacatgcccacgcgtgcacacagccacacacaccctcacgcacacacgcacagcaccatgtgggaggggttctcggctgtgacagtgaagggcagggcctcacctcggctgctccttgtgagttgtgggccccgtgtctgtgcccggccgccctgcggtgctcaccagccttctgaacgaggagctggacaggatccctggaaggggccccggggtctctgagtcgcgctcagcgggtgcttgtgctctctgcccagctgtgctgaagtcccgagggacatgtccgctgcttgcgggtcggttcctgaggaattggaagtgtcacgagatgtggccctcgttgggctggcgctcattggcctcccttgtgcctgtgcaggaggagctgattaactcagtggtcatctcgcagctctcccacatccccgaggataaagaccaccaggtccgaaagctggccacccagttgctggtggacctggcagagggctgccacacacaccacttcaacagcctgctggacatcatcgagaaggtgagagccgttgtacccggggccgggtgctagcgtgccagagctccgtgggcagcaatggcctctgggccctctgtcctcctcttcgagtgaccggatggctgtgtccgtaggtgaggctcccctccctgcagggtgggtgtcccgaggcctgtgcagggcctgccactgctggatttgtgtcctgactgaaagtcctggacatgggtgtcctgtcacactctgggacagctgggctgggcctcctggaccgacgctggagcccagacctggggctggggctttggcctgccgtcctccctgcccagccaacagctttgctctttgattttcagatgcattttggtttctgcacagtcactcgggtataaagggcatctttgcttttgagcaataaagatgaaggccgggcacagtggctcacgcctgtaatcccagcattttgggaggctgaggcaggtggattgcttgagttcaggagttcaagaccagcctggccaacatggtgaaatcctgtctctactaaaaatataaaaattagctgcacgtggtggcgggcacctgcaatcccagctgctcaggaggctgaggcaggagaatcgcttgaacctaggaggtgaaggttgcagtgagccaagattctgccactgcactccagcctggacgacagagcaagactctgtctcaaaaagaaaaaaaaaaagggccgggcacggtggctcatgcctgtaatcccagcactttgggaggccaaggcaggcggatcatgaggtcaggagatcaagaccatcctggctaacacggtgaaaccccatctctactaaaaatacaaaaaattagctgggcgtggtggcgggcgcctgtagtcctagctactggggaggctgaggcaggagaatggcgtgaacctgggaggcggagcttgtagtgagctgagattgtgccaccgcactccagcctgggcgacagagcaagactcgatctcaaaaaaaaaaaaaaaaaaaaaaaaggtgtttgtggtagaaagtgttctcacggctgctgactcagaaccatgagcctgtgtgtaagtcctggccttctcttcaaaggtgatggcccgctccctctccccacccccggagctggaagaaagggatgtggccgcatactcggcctccttggaggatgtgaagacagccgtcctggggcttctggtcatccttcaggtgggtgttctgcacgaggcctctgctcccggggcgcgcatggctagcgtccaccagctgcatctgcgttgtgttggagtctgttccccagcgggacccacaccctccctggatttgctgagggtgcggtggtctcagcaggcagcagaaccttcctcctgctcttgtggagggatggatgcaagaggccccgttgtacgccctgaccagagcttgtctctgtgctcctgagtcagggccggaaccatgtaccatcctcagcgtggcgcttgccctcgtcacccagcacagcacctgggaagtaagggtggccctccattcctgccctgcagtccgtttaatatttgcagctgttttgttgagatttaatttacatatcatgcaatttacccattcacagtgaacagttcagtggttttcagtaaattcacagagctctgcagccaaccccacagtcagcttgagaacctcctgagcataccagtagcacacgctcccatcccccgttgctcccgtacccccgggtaccatcaagctgcttcctgtctctgtggatttacctactctcaacatttcatggaagtggaatcacacaaaattcatccataagatgttggatggtagaacagtttcctgtctgctgactggattgttccacccagcgccatgtgtccaggcccgtccaggctgtggcagctgttggtgctcccctccttttcatggctgagtagtattccatcatctggaaggagcacattttgtctgtccgttcctccattggtggacatttggcctgtgtccgccttgcagctgcggtgagtggtgctgctgtgaaccttctcctacgagggctccgccgggcctgcattttcacttttgggtctgcacctaggagtgaattgttgggccctaggtttagtctgcatttggtgtttcaaggcgataccaggctgttttccactggtgctgtgccattttccatccactcgagcagcatgtaagggttctgatttatcttttttttttttttttttttttttgatacagtctcactctgtcgcccaggctggagtggagtgcagtggcgcgatcttggctcactgcaaccttcgcctcttgggttcaggcgattctcctacctcagcctcctgagcatctcgtattacaggcacctgccaacatactcggctaattttttgtattattagtagaaactgggtttcaccatgttggccaggctggtcttgaactcctgacctcaggtgatcctcccgccttggcctcccaaagtgctgggattacaggtgtgagccaccacgcccggcctgcctctacttttcaaagcctcacagcatcacttacgtgtgactgtcagtgtcagtatcgtgtaaaatataatgtatgaatcagtttgctcaaaagctcatccttaagatgttggatggtagaacaatttcctgtcatgtttatatgtcatgggtttttatttcttgccatggaagttgaaagtggtgatgatttttttttttaattaattttttgagacaagatctcactctgtcgcccaggctggggtgcagtgctgtgaccatagctcagtgcagccttgaactcctgtgaccaagtgatcgtcctgcctcggaggcctcccaagtagctgggaccataggcacacgtcaccacacctggctaattttttcattttttgtagagatggggtctttatatgttgcccagcctggcatcaacctcctggcctcaagcagttctcccaccatagcctcccaaagtgctgggattacaggcatgagccaccacacctggccgtggtgtttgattaaaaaccaggcatcagccgggtgtggtggctcatgcccgtaatcccagcactttgggaggctgaggtgggtggatcacctgaggttgggagttcaagaccagcctgaccaacatggagaaaccccgtctctactaaaaatacaaaattagccgggcgtggtggcgcatgcctgtagtcccagctactcgggaggctgaggcaggagaatcacttgaacccatgaggcagagggtacagtaagcccagatcacgccattgcactccagcctaggcaacaagaatgaaacaacgtctcaaaaacaaaacaaagcaaaaacaggcatcacctccttggtgtctcatccacatgagcaccatgctctttactgactggttgggaaggggtgtgctgggctgtgggggcctatggcctgggagaactgagaacctttctgcttctgcagagggaaggaaagaggttctgttgcccttacttggaactccagccctggaggcctgagggtctgggctgcagaactgagatatttcctagttgaggcagagtcctggttctggctgctttcatttctttatttttttgagatagagtctcaccactatgtcacccaggctggagtgcagcggcacgatctcacctcactgcaacctccgcctcccaggttcaagcaattctcttgcctcagcctcctgagtagctgagatgacaggtgcgcaccaccacacctggctaatttttgtatttttagtagtgacatggtttcaccatgttggccaggctggtctcaatctcctgacctcaagtgatccacccaccccagacccccaaagtgttgggattacaggcgtgagccatcgtgcctggcctgttttcatttcttttgttataattgaaaagtaacacagttgactcttgaacagtatggggctgggagtgccagcccctgtgcaggtgaaaatccccatctaacttttaactccccagaaactttaccaacagccctctgttgactagaagccttgctgatagcagacagtctattaatgtacagctcgtgtgttttatgtattctgtgtttttacagtgaagtaagctagagaaaagcaaatgctgttaagatgctaggcatggtgactcacgcctgtaatcctggcagtttgggaggccgaggcgggcagatcatgaggccaggagttcgagaccagcctgaccaacatggtgaaaccccgtctctactaaaaatacaaaaattagctggatgcggtggtgcgcacctgtaatcccagctactcgggaggctgaggtaggagaatcacttgaacctgggaggtggaggttgcagtgacctgagatcgtgccatagcactccagcctgggcgacagagaaagactccgtctcaaaaaaaaaaaaaaaaaaaaatcataaggaagcgaaaatacatttcctgttccttaagtggaagtggctcatcaccaaggtcttcattgttgtcatcctcatgttgaggggactgaggaggaaggagaggagacacatggtcttgctctctcgggtgggagaggcggaagaaaattggcatgtaagtgacccatgaaggccagcctcgtgctgttcgagggtcagagagtttgcacaatggacacggtgacaagtttgattccccttttcctgcctgcctagtgggcccggcagggcggcagctgctgttggttccatgtggccttcccagaatggggggtgccaggcactgtgtgaacccccacctccacctcttttttgtccgaggaagggatgttgcttttatgtcataatattttgagatgaggagaaactgttaatcatttaatcatctttttttttgagatggagtctcgctctgtcgccccagctggagtgcagtggcgcaatcttggttcactgcaacctccgcctcctgggttcaagcgattctcctgcctcagtctcctgagtagctgggatttacaggcatgcaccaccacacctggctaatttttttttttttttgagacagtcttgctctgtcgcccaggctggagtgcagtggcacgatctcggctcactgcaagctctgcctcctgggttcacgccattctcctgcctcagcctcccaagtagctgggactacaggtgcccaccaccacgcccggctaatttttttgtgtttttagtagagacagggtttcaccatgttagccaggatggtcttgatctcctgacctcatgatccacccgcctcggcttcccaaagtgctgggattacaggcgtgagccactgtgcccggcctaattttgtatttttagtagagatgggctttctccatgtaggtcaggctggtcttgaactcctaacttcgtgatccacccacttcagcctcccaaagtgctgggattacaggcgtgagccaccacacctggcctcagtcatttctttcaatgattttttaatcatttaaaggtgttaatcatttctttaaaagaataacagtgtaaccacttacctccagagtgctgcaaagggtccctcaggccagatttcccctggctcctgctggcctcggccccagggttgctggaggcaacagatgctcttcacaccttgccacacgtgtctgggaggtgcccttgaccttttgggaggggctgcctacacctgggatcgccctgcagcacacactccccgccccattctgccctgtctgccacgcagctggagcttctccattgaatggactcttcctcacctgttgatgactgccctgatgatgagatgggcacgaggttgggttttactttttgctgctgtggagagagagtcctggtggtcctgggtttgaaggtcgtgtgttttgaagcacgcactctagagcagccgccccggcccctgctccgggacaagggtgctgtcttaggactgcgttttcacctcctgcgccgtggtgagctgcgtcctctctctgcagaccaagctgtacaccctgcctgcaagccacgccacgcgtgtgtatgagatgctggtcagccacattcagctccactacaagcacagctacaccctgccaatcgcgagcagcatccggctgcaggtatggtggctggggttgcgcagccagttcctgggggcccagccaggtatccccgtctcggcaggtgtggttcctggaagctgcagagacggccccaggatggggcctcagctgaccgtccctcctctgcacccactgtggccgcagcctccccagtcctggtgtccttccctctgcctgcagtccacacatctgtggcttgtcgctctaagccgcacggtgacatgggttggggcagagaaaaggacgcacggcgacttccggggcagtgcatggccctgacgctcctggtgctgcagaatctgtgaaggacctgcagcagagggctgggcaggtgggcggcacagggcagagctgagagggcagagctgagacggcagggcagggctggagagggcagagctgagagggcagggcagggatgggcagaacagggctggaggagtttcgctgagtttgcgctatagatgttggcaccaggctgagcagaggtgactgggatgggagccctccctcctagagcaggtgctctctggggccacccctgtggcctcagagtcctgttcagcctgtcgatggaagaagtggcagggctgggagctgagctccgctttctggcagttgggggcgtgtggtgctgccagaggagcgaggcgcccatcccttccatcccaggcgggcccagctgtggtggtggggacaccaggctctgtgagctccgaggcaagggagggaggaggctgtgggtgctgggcctccggtgtcaccaggacagagcctgtgtctgtgttgggatgtgggtgtgtgcacatcagcaggtggccttttctgagtgcctgtggtgctggacgtgggtctgagcaggtgggacgccgcctgtcctgggcctgcacgagcttggctctggctttcaccatcctcttcctgacaggcctttgacttcctgttgctgctgcgggccgactcactgcaccgcctgggcctgcccaacaaggatggagtcgtgcggttcagcccctactgcgtctgcgactacatgtacgcgggacctcgcccacggcccatgaggctcagggcgtcagaggcgctggggctgtggtggcgctgtttgcatgtctgagggatgtcccagggttgggaagagccaagtctgttccgttcctgctgcggggacttggcctcagctgcttctcttgcttctgcagggagccagagagaggctctgagaagaagaccagcggccccctttctcctcccacagggcctcctggcccggcgcctgcaggccccgccgtgcggctggggtccgtgccctactccctgctcttccgcgtcctgctgcagtgcttgaagcaggtgagtggggccgggcagggaccatccgtcccacgttgggccaggaggacagggagctgccacctgcctgctgggcctccctccctgtctggcctgtggagggcagccctccctcagagctgagccttcccccttccccgagcagctgcagggacagaggcctgcgctgggcaggctcccccggctgagaacagggctccatagcccttgacgctgtgcagccacaaagcagagcctcagatgctagcttccgcctctgtctctagggtccagaaggccctgtcctgacgcctcctctcctcgcaggagtctgactggaaggtgctgaagctggttctgggcaggctgcctgagtccctgcgctataaagtgctcatctttacttccccttgcagtgtggaccagctgtgctctgctctctgctccatggtaccatggccggcctggggttggggtgggggacccagtagggtttttccccaaaagactgcgagcctctgggcagagcgagtgagacccttcgggctcgggctccatttccctcaaactcagctgcactctggagcgcagattgtgccttgggcagggtggagggacccctgccccagctcgcagcttttgggactgacgtcagaggtccccagccaagggcatgtcactgaatgtggatgtctcccatctgtgcttttcctaagtggggctcccgtgccgttcacctcacattcctggtgtgttacttggcaggcactcccaccactccgaaagggaggcccttcctgggagggaggcaagaaggctccccagcccctttgccccctttcctgggcctgcgttcccagggcctccccagcccctctggctaccccgtgacctggccgctggggagaggtttcatgcctggatttggtcatcagctttcaggcccaaagacactggagcggctccgaggcgccccagaaggcttctccagaactgacttgcacctggccgtggttccagtgctgacagcattaatctcttaccataactacctggacaaaaccaaacaggtaggaggtcagagcaggacaggcgagcttgatggggcctgggattcgagggcctggcccaggtaggccccacatttttctcataaacgagtttctgccaggccagggatgagtgagttggctctgcttccctgggtggctgccagatgcccagagtggggacatccgattccctggtgcttctagctctctttggggcctgggagccatccagtgttccctgtccaccccggacagcatctctgctctctgtagagcgttgcctggcttgttcctgctgtcccaagggggaggtggccatgccggttggtggagctgggctggttctgaggcgcagggtgggcaggccagagagtctggcttctgcctccctccacgccccatcaggtgccggaaactgtcccttcacctgcgatctgcctcgcccccgtcccagtcgcattcttccacacctctctttgacatggccctccgggacgaggagctggtgtcctagagattctggcctccgctcagggccatgcccgccaggagatgctgactctgaggcttggcccatctgtgccccgggcctcagcttctgatggtggccctgtagggagctgttgttgggttcccatccctcaggctcagccccaccctgttgggccccttcagcccctctgagaggctcactgggtcctcatgggtcttgcctcaaagcatagccagccttgctgggctgcaggttctgaggccttactggcccacagtgtatccgaggggtgaggccggctttgggaaatggaagctgttcccgggacactgcctggcaggccatctggccccgggctctgcctgagctccgctcatcttctgctgtcctcatggaagacactgcccagggttggtgtgggatctggtggcttggccacttcaggcagcactgccccttgcaacagagccagcctgtgaagggcccagaaccaggggatgagagcccagcatgtctgggttctgttggcctgtgggatcgtgtcggaatgcaactgaccggagcagtctgctgtgcagagtctgctcgggtagctcagcactgctggctctgccccacaggcattcagggacttgctaagcctcggctgttctcccggtggagcactcgaggttggcgaggggtaggcgaggctgcctctgctgcaagcgggtggggcctgaggtgtcctgtctcctgcagcgcgagatggtctactgcctggagcagggcctcatccaccgctgtgccagccagtgcgtcgtggccttgtccatctgcagcgtggagatgcctgacatcatcatcaaggcgctgcctgttctggtggtgaagctcacgcacatctcagccacagccagcatggccgtcccactgctggagttcctgtccagtgagtccccgccctgcctgcgcatgcacccgagaggttcgggctgtgtaacctgtgcgggcttctctggtgccctctctcaggactccttggggaacctgggtgtctcgccttctgctgcctcagggcctgggcgtctctgcccggctgccatgagtgctctccttcctggctttgaggggcggctcctctcacccctctagtgtccatgtgaacgctcctccttgaagaagcctcttcccccccgagcagtggccctcccctggttttgggcctcctctctgtccaacagagcacacgccgcttcaggggggctttgttcgcttcccccagactgtgacttcaggagctcaggtgcctgtcccttcccctcaccgcctgtgcgcatctgggcaggccctcaatgttgagatggcagaagggcactgctgggcccgcacttggtgtagaggctggagagaagatcgtgtgtgctttgtgggccacatgcaggtcctgtcggtctttctgttttgttgataaccctttagaagtgtagaagcctggccaggcgcggtggctcaggcctgtcatcccagcactgtgggaggccgaggcgggtggatcacctgaggtcaggagttcgagaccagcctggccaacctggcgaaaccctgtctctactaagaatacaaaaattagccgggtgtggtggcgggtgcctgtagtcccagctactcaggaggctaaggcaggaggcaggagaatctcatgaacccaggaggtggagcttctagtgagctgagatcacgccaccgcactccagcctgggcaacagagcgagacaccgtctcaaaaaaaaaaaagagagaagtgaggccgggcacggtggctcacgcctgtaatcccagcactttcggaggccgaggcaggcggatcatgaggtcaggagatcgagaccatctggcgaacacggtgaaaccccgtctctaataaaaatacaaaaaaactagccaggcgtggtggcgggcgcctgtagtcccagctacttgggaggctgaggcaggagaatggcgtgaacccagggggtggagcttgcagtgagccgggatcgcgccactgcactccagcctgggcgacagagccagactcatctcaaaaaaaaaaaaaaaaaaaaaaaaagaggtgcggaagcctttcctcacggatcacacaaatggtaggcgacagctcgaattggcccagaagctgtggttggctggccatgggaccgagagttgaggccagggtcgggaaagccacgtccgtgtggccgtggccttctctcctctgcagcaccccatcgctgccgtgggcagagcagccgtgttggccttcagaggcgctgcacgggaccccggctcccctgaccaccctctccattaccgcagctctggccaggctgccgcacctctacaggaactttgccgcggagcagtatgccagtgtgttcgccatctccctgccgtacaccaacccctccaagtgagtggtcgccccaggccctgtgcctcccagccgtggcccccgctaggccttgcggcagaaagccccggcagcctttgtccccaaggcctgagcgcctcggttttttgcacttcatgccctggggatgtttccctgctgccaggatggagtgccagcccccttctcatctcaggtttaatcagtacatcgtgtgtctggcccatcacgtcatagccatgtggttcatcaggtgccgcctgcccttccggaaggattttgtccctttcatcactaaggtgggctcagggccggtgaaggctgtgtctctcggtaggccagggcttgctttgcccttggctgtccatggtcgggcagagtgacaggcaggtggagggcagtgggagggtgtttggggctgtgcctgtggcgctgggggctctgctgggcagcctgcagggctttgatgcgcggcaggcattgaggggtgggagctgggtgccgccgccttgcccctagcctgcagcttgtccctggccagggggcacccggcaggcctggtgagggcctccagcccccattgccacccctcactgtctgggtgtgctcactctgccagggcctgcggtccaatgtcctcttgtcttttgatgacacccccgagaaggacagcttcagggcccggagtactagtctcaacgagagacccaagaggtacggcctgcgggggtgtgcctggagtcggtgtggggtggggaaggacatggggctgtggcctgcctgacggtgcctccaagtcagtgagtggaaatgggtcctgtgtgccctggagtatgtgaggcagggcaggacctgcaagggccgctaacacccctcagcccctcagcaggttggccgtggtggcctgggtccgggctgcgtgtgccacgggcacctacttgtggaattgggggttggggtgcaagctttaggcgcctgagcccctcgaaggagccggccttgtctggggctgccccctcctctgcagcccccagcctgctgctagccggggactctgcttcatcaccgccgccttgccggaccgcaaagagctgagccagcctctgtgttcttgtttgcatttcatttgaacggctttctcctcctgtcccccaccttcctgcccgagctattttggctttccctagatgggaatacggcattttccagcgtgacctcaactcggaagctgttgtctccagcccctgggggccgggggccaagctcggccattacggccagagactactttctggggtcttggtctcttttcctagtgaccttcagggcctggccactgaggcctcagtgccgcctcggtcagagctgggcggtgcctgccttccgcgggtgggtgggattgcctggccagcacagcctggaatctgccgtgggggtgacccacacacgtttaatttgcactgacgttgtttgttttggtgtcatgcgtgaagccttacttgttctcagtcatgtttaccagacgtattatcatgcatttttgttttctgtctcttccccgctaactgccctttggcatggctctttttgctcatctcacccgcgggatctctccatcctgaccctgtggcctgggacctttcctcctcacccctccactggcttgttctccccttcccgggagctgggctctctggggcgttggggctccttcctcacccgatagtctgaggatagccagaccccccaaacaaggcttgaataactctccacccgtgaaagaattcaaggagagctctgcagccgaggccttccggtgccgcagcatcagtgtgtctgaacatgtggtccgcaggtagcgggactgtcgggtggggggcacggaccctggagcttggccccgtgagcacctgggtggcagtgcatggggctgcttgcatgacctcatcgtctgcccgtgtcctccctggccagcccagggggagccggtgacgaggggtggaaaggttgcattctgtccccaggccccgtatgagcacgggctggttgcacgcatccccaggccccctcggggtgccgctccgagagagccaggcgtgccgggcagcagcctccccaggctgtccccaagggccgcagtgtgggttgggggagacaccactcctggttttggccttttcgtattctctagaatggacgtttttcttcgggctttcttctcaacaaggtttattttttgttgtagctgaaagggaacaaggggcatttgtggagggtgctggggtggggcagcctgggagggcctgggtgggggctaggatcctgcagggcatgggcatgggcctgggccccaggccatggtcttagttctccccgcagtgtctgggtgcaggtgtgggctctcgggctctcggctgtcacctgcctgtgggtcatcgctgctggcactggcagaggggatacctgtctcctcctggaagcccgttgcaggccaaggggtcccatggccctcagtccatccacctcctcacctcaggccggcctctgctgggtgggacttggccaggggttggggtggtagaggtgctcggtgaggcttaaagccattttctagcacattctgtatcatgagcaaaatattgcctaggggctatgaaatttgtatcagaatgaactcccataagcctcttccctgtcactgggtgtggagctcaggcagccgctcgcctgcctgagggtgacggtggaaggccacatggggatcccagacctctgtgtgcttgccggaggcagcctgcgggcagaatgcaatctgggcctgtctgtgtggcctccgcctctctgcatgactacaccgtttcgccaggaggccgtaacctagtgctcccgtgggcttcggtgagggggatgtcggtctctagcctcctgagtctgctccgaccagtaggcctggtcttccccacccagcgtctccccgttctctgggacaatgtggtccacgtgattctcaagctgaggctcgctgggccgcccacgccctgttggggtctttccgagcgaggtcctcagccgtgcatgcgttgagctttggcccttggtgataggtggctcggcccgccctacctggcaccctgaccctggtcacggcctctccctccagcaggatacagacgtccctcaccagtgccagcttggggtctgcagatgagaactccgtggcccaggctgacgatagcctgaaaaacctccacctggagctcacggaaacctgtctggacatgatggctcgatacgtcttctccaacttcacggctgtcccgaagaggtccaggcggcactacagggctgggcgggcctgcgggagctccacgggcaagctgggtttcacgctccctgtcttctaggtctcctgtgggcgagttcctcctagcgggtggcaggaccaaaacctggctggttgggaacaagcttgtcactgtgacgacaagcgtgggaaccgggacccggtcgttactaggcctggactcgggggagctgcagtccggcccggagtcgaggtgactgcaccttcctttcctccgcgcctgccagcctcgacaccggctgtcccgagcccaggcccacgtggcaccctcgtaccagcctggggactaagtccaccctgtgcgtgggattctcttctcagctccagccccggggtgcatgtgagacagaccaaggaggcgccggccaagctggagtcccaggctgggcagcaggtgtcccgtggggcccgggatcgggtccgttccatgtcgggtgagccttggccccagccacctccacacaggcaccggggctccctcagttgctgctggtcccagtgttcaggaaggccccgagcccaggggccggggtggctggcttcaggcccggcccacgtcctgactctggggtgagccttccacagctcaccccagagccgtggagtggtggagtgtggcccgcttgctgcagaggggcctgctctgggtgctggtgtttcctgcgggttttcagctcggctcagtcctggagcccttctctgctccagcgagccgtggtctgactgcaggacaggttctgggtccctccctgtggccctgggttcactgaggccagcactgtggtgggccgtgccccaagggcagagctgccaccgtctctggctgcctgtggcactagcttgccaggctcggggggagcattcagcttgaggctggtggttttgcatcaggtaagtggtggtcaccagtcctctgccctcttcttcagggggccatggtcttcgagttggcgccctggacgtgccggcctcccagttcctgggcagtgccacttctccaggaccacggactgcaccagccgcgaaacctgagaaggcctcagctggcacccgggttcctgtgcaggagaagacgaacctggcggcctatgtgcccctgctgacccagggctgggcggagatcctggtccggaggcccacaggtactgggcggggctggcctgagcgccatctttctgccagtcacccacagagctgtggacactcaggggcgattgcagacttggccctcttgggatatttgggggtaacttttgttttttttttgagacagagtcttgctctgtggcccacgctggaacgcagtggcgcaatctcggctcactgcaagctccacctcccgggttcacgccattctcctgcctcagcctcccgagtagctgggaccacaggcgcccgccaccacgcctggccaatttttttgtatttctagtagagatggggtttcactgtgttagccaggatggtctcaatctcctgacctcgtgatccgcccgccttggcctcccaaagtgctgggattacaggcgtgagccaccgcgcccagccatttgggggtaacttgtaagtctccagaggtgagctgtgaggggcgatccaggtggctgaggtggggcaggggcctgtggcgaaccaagtgacttccatggcagagagttgccctccccgcctggaggctgcaagtccgagaccaaggtgctcctcggcaggaggtgctcctcagaggcctcaatccttggcatgcagttggttttttccctgtgtcctcacaggctctttcctggatgtctgcgtgttaatctcctcttgggaggaaaccggtcatggcttagggtccgctctggtcccttgctagccgtaattagctttctgaaacccagtctccagagacagtcccgttctgagttcctggggttgggactaaagcataccaacatgggggcacagctcagcctgttcccaggggcagagggagcccccgcagaggcccagagcccagggacagagggaggcctttgcagaggcccagagcccaggggcgcctgggtgtgccgtggctgaggggtgcaaagagtaggggttccagccctcgtggaggccttgggtccggactgtgaggctgtgggctggaggccgctgctctgaggtgcctggcggagcctggcctcgaggcaggggctgagcggggcagcagggtgggtggccgtcagagcagcgctggctccgacatcgtggtcctgaggattgtgggagggagcatgagggcaaaaccagggcccaggccaggaggcccctggggggccagagatgggtaaggggaggtactggcctcaggccaaaggtgctgccgcctccgcagggaacaccagctggctgatgagcctggagaacccgctcagccctttctcctcggacatcaacaacatgcccctgcaggagctgtctaacgccctcatggcggctgagcgcttcaaggagcaccgggacacagccctgtacaagtcactgtcggtgccggcagccagcacggccaaaccccctcctctgcctcgctccaacacaggtgagtggcatggcgggccttggcacgggctctgctcccactggcctggtgctcccggtgacggcaatgtggctcctctctgctgagggcgcccacacggctgggagtggtccctggcctgcctcagcaccattgttctccggtgtttgggaggaggctgacccgtgggaggtgtctgccctgctcaggaagctggggctggcagcttcagaagcagtaggggccctgtggagcctctgcccagcatcctccgtggggagtccagcactgcgggctccaggaggctctgcggcagcctccctccctgcctgggcccaggtttggacacctgagcccgcctgcgcactctgggcccccaccccactcggcaccgtgcttctcgccaggccctctggctcttccctgtggctgcagatggcacttagcggcctaggacgtctattcacgggaggagggaggcactgccctcctcaggtctgcccaagcagcttgtagctagcactgggccccgtgcgcgcccctgccggccgctggccctgccctctctcctctgcaggcacggggcctgtgctctctgctcgacctgtgtgtagcccctcctcctgctgacgtggccgcacacggccttcccttgcagtggcctctttctcctccctgtaccagtccagctgccaaggacagctgcacaggagcgtttcctgggcaggtatcgcctctcagagggaagcggttggctgcagagcgccactctgcctcataggtgctgtgctcgtcgcctcatccgcccacccccatggtccgtctgcctccattgccctggggagcaggtcccgactcgcatgaggacgtctgtgcagaatgtctttggcttggccagcgggatccccttgacttggtccctttgtggctgagccctgttcccacgctgtgcgagcactcccggcccagcttcaggcctgaggggtgggggtggcctgagtctccatggtgacatcagctgagctgcagactctgatgggtggcagctgtttagggggaagcccacccctgggcctgcaccgagcgggccttgccctggcctttggtggctcccctggcctctggaacccacagatggggctgcctcaagtcccaggttgaccaggggccctgcagaccgacctctgcctgttgcccccaagccctggtggggagtgctgtgacctgcatggtgctcccctgccaggtctccacgtgcagacgagctggtttggaagggctgcgtgggacgggccctggggtggctgactgcgcgtgtgcagggctgtggggcgcccgggggctgtgatggtcccctctgttgctgcttctacttcctctccccctgtcctgacgctggcacaggaaatgctgctttgggacctcccaccctctctccttagcgtccccagctgtgggtctggcttggagttggagggtgagcctctgctcttgggagcagtctgtttgcaaacagggacttcccccacgtcacggagtctccgcagctctcctcggttacgagggctggtttcaggctcccgctcttttagagctgaggcccgtcgggcggagagcgtcttgcccctgcctacctggaggcacaggggtggctgctggtggacactagggtgggcagagccgattgcctgcccaacccccgggcactcatgcaggagaggcctgtgtcggggtcacgtgcaggccttcccagcgtcctccctgcccgctcggtggatggcagcagtaagcagagccctggggaggctcgcagggctgctgtccctctggtcaggagaaggctggttctcggaggccacgtcagggccagggcctggcccagccccacatccagcagccccgtctgtgtcctcccagactccgccgtggtcatggaggagggaagtccgggcgaggttcctgtgctggtggagcccccagggttggaggacgttgaggcagcgctaggcatggacaggcgcacggatgcctacagcagggtgagtgtggctcagagcctggaccctgctgacctcggggggctccttaggggaggcagggctctgcgtgggtgtgcctgcaccctgggaactggctctgaacttgggggagatgttcttccacatccctcgtgcacagacggtctgcactttgcagccatccacctgggccggccctggctgctgggcagcctgtggtctcaggggatgctgatacctctgctcacgcagtgtggggcacagctggtggcagtgctgctgcgtcaacgggcgggggccgtagcctggtgctcgggctggtctgtggccctgggatggaggacagatagggcctcaccacctccaggtcaaccccaggtgggctcgagggtgcctgctgacaggggttctctttgggatggtcctttctagtcgtcctcagtctccagccaggaggagaagtcgctccacgcggaggagctggttggcaggggcatccccatcgagcgagtcgtctcctcggagggtggccggccctctgtggacctctccttccagccctcgcagcccctgagcaagtccagctcctctcccgagctgcagactctgcaggacatcctcggggaccctggggacaaggccgacgtgggccggctgagccctgaggttaaggcccggtcacagtcagggaccctggacggggaaagtgctgcctggtcggcctcgggcgaagacagtcggggccagcccgagggtcccttgccttccagctccccccgctcgcccagtggcctccggccccgaggttacaccatctccgactcggccccatcacgcaggggcaagagagtagagagggacgccttaaagagcagagccacagcctccaatgcagagaaagtgccaggcatcaaccccaggtgggcctcttgcttccgggcggggctcctgacacctctcctgcgggaacctggtgcctcacttgccccaggccgagcgggctggggtggggtcctcgcctgtgccctagggctggctggaacccctgggagggcggtggagtgggagatggccaggctctgtgttcctccctgtgggctgtggctgccctggccaggccctcacctgggtgcccaccatcccctccctgtgcagtttcgtgttcctgcagctctaccattcccccttctttggcgacgagtcaaacaagccaatcctgctgcccaatgaggtaggcgtggcctccctctcctgcatccgctggagctgtgtggctcgggtgaatggtggggggcccagctctgctgctgggagctcaggcttgcagagggctctggcctaagctccctgtggcagcctgccgtgaccggcctgggtggggcggcctcctgtggacgggcgtctggggctcaggcagggctctgtgtgccacagtcacagtcctttgagcggtcggtgcagctcctcgaccagatcccatcatacgacacccacaagatcgccgtcctgtatgttggagaaggccaggtgaggctgcggggccggcctaggtgcctggacagggccagctgggcctcagcctgcagtgggtagggagtctgggcccccaacgccccacagagctcaacactgccgggtcccctacagcatgaagtgctcattgagctctgtgccaggtgctgctctgagtgctggggaccccggtgcgagtgacaggttagcgtgggagcacccggcacaccaaggagtgggaaggactgggcgggtggcaccggtcgcagggctggggagggcgctgttggtcagtgagctgacagctgagtggtgagggagcgggcagggggagcctgcataaggggtgggggcatcccacacaccagcagcgggggccgggcgcaccctgcccagcttgagcactggtgctgggcgagcacgggagccgacaggatgggcagcctcagcgccctataggctgcaccttcatcccaagggaaagggcagggcctgggctgcttctgagcagagggcacatggcctgactccgcccagtctcagtgagtccctcctgctgtgtggctcgaggaggtgggtggtgatggttcccgtgggagtggggtaggcccctgggggcaggctgctgaggggccagggccccgggtgtgctttgagtgtggagctccctgattttgccggccaggcacacacggggctgagggaagagagggagtcaaggatgacacccgatgtctggcctgggtggctgctggaatggatggtcttgtctgcctcagggatcagagtggggctcccggcagagcctgctgggcacccccaccctctgcggggcagggcccggcccgggagtgatgccaccctgcctctcccctctccccacagagcaacagcgagctcgccatcctgtccaatgagcatggctcctacaggtacacggagttcctgacgggcctgggccggctcatcgagctgaaggactgccagccggacaaggtgtacctgggaggcctggacgtgtgtggtgaggacggccagttcacctactgctggcacgatgacatcatgcaaggtacggcctggcgcctacccgctcctgctgccccaggcctcagggcacggctcccatccagtcctgctaccccacgccctggggcatggccctggcacccccacctgctccagctccccacgcctcaggttccgagcctaacagcgtgggcatggaggcagtgatggggctggtggctttgcgtcccaaagccctgcccctggggagagccgaggaccactggccaggcaccagaggacgtggtccccgcaggcccccagagcccctggagtaatcaggaggtgccccagtgcaaggcacagagggcctcagcactggccccacaaacccatccggccctgctcaccctcagccgtcttccacatcgccaccctgatgcccaccaaggacgtggacaagcaccgctgcgacaagaagcgccacctgggcaacgactttgtgtccattgtctacaatgactccggtgaggacttcaagcttggcaccatcaaggtgagtgaggggccgtcagtgaggctgggccccaggcaggtgcccactgctgtgtcccgggttggtggcaggtcctcctccctgagcttcggtcacgaggagcaggaggagaggccgcagtgctcagggccccgtgggcacgagcttcaccccgagcctgcgttgtgtcctctgtgccctgaagcctgtggcgcctgctgctgagtgtctgtcaggagtaactggcaagtgcagactgggtgtgctgggtgggcacagtgtagttggtgcttcctgtctgtccggcgcggcccttgggcccccaccatctccccagtggcagctgtcaggctgctcagttggttatcgccacgcaccactaggcagcaaccagcgtcaccctcttcctggaggtgggctgggtcggccagtgtcacagcacggtccgggtgagccccagcatggcggggagagctggcatggcccaggcagggcagataggctggaggcctcactccaagggccccaggatgctgaggcagccactgaaccaaaaccccggggctggtagtcagagtccaggaggggcaggagcatagggaggtgggctctgctagatgccaagacaaccagttgggggggggggggcacctgggcggctgaggagggtgtggtggtgccgagatggggtgcacggctcacttcatggctgggcagacggattcggacgtgtggctgcagacaccctgggggccccagtgagtggaggtgccccagcaattagaggtgtcttgcctgtggctgcagcatatgtgggtgctgcgcccagatgtggagggggcttggcctgggggaggccagacaaacacagccccgctgccagaggggaaagttcaggggcagatgctgcccatggagctgacaggtgtctagcagtgcaaccaggcagtagccgagatcagccttcagcacacgctgtgtgcggggatgaccctttctcttgtccgggcagggccagttcaactttgtccacgtgatcgtcaccccgctggactacgagtgcaacctggtgtccctgcagtgcaggaaaggtagggccgggtggggccctgcagtgcaggaaaggtagggccgggtggggccctgcagtgtggcgccaagagccctgggcctggcgtgaccaccaagtctccccagacatggagggccttgtggacaccagcgtggccaagatcgtgtctgaccgcaacctgcccttcgtggcccgccagatggccctgcacgcaaatgtgagtgggggtgggtccaggcgtgagctggtgggacaggcccaggtgccacctgatagtgagctcaccccctgcctacgtccccagatggcctcacaggtgcatcatagccgctccaaccccaccgatatctacccctccaagtggattgcccggctccgccacatcaagcggctccgccagcgggtagggaatatggggctccctcagcggggtgtgctggctgcccaagctgtggggcgggtgtgtgggcagagcggttgccacgcctcccagacttactgcccaagccgcctctgccttcagatctgcgaggaagccgcctactccaaccccagcctacctctggtgcaccctccgtcccatagcaaagcccctgcacagactccagccgagcccacacctggctatgaggtgggccagcggaagcgcctcatctcctcggtggaggacttcaccgagtttgtgtgaggccggggccctccctcctgcactggccttggacggtattgcctgtcagtgaaataaataaagtcctgaccccagtgcacagacatagaggcacagattgcagtcagaca

SEQ ID NO: 8 - DNA, 40800 bp, Homo sapiens
  source 1..40800: mol_type = genomic DNA
ggggggagggtggccactccgacctggatttaccgttcttggcccccctaagcccccccgtgcggggggcggctgtgatcgctctggcggttggaggtcggggagcggcccgggctctggccatgttctcggatgaggatttctggatcgccctgtgaagaggtgagtgaagtccgcccggccagggcccagaaagggttggactgggggcacagccagatggactatcttagccggagctggcctttaggttggagaagggggtgccagagctggggagcgttcctttggcagggtctgtcaagggaacctgagccagtcaccagggcagaactgaggcctggtgtcttggggtgtgcctctttaaagactgggggttcagggaaccacgggagtttgggaacctggccagatagcctctctgcctgtttatttttgtgttgggggagctcgactaaactaggacccgggccctgatgccagcaccaatcccaggctgctgcttctcccctcagggttccttgtgggccttgggacagagcaacttgggatggtgggggagggtgtcactgccaggtcagacttatgccagttggactttaaggttgttcctaccgagttgggcacccaaagcagtccctggaaaactcaaggaaccccagatccttcaccaggccttctttcactgggcaaagggagagtgtgtggaaactgactagttgtgatgaagggggtagctggggcaagaaggaggcggggctggggcagttctggccctgctgttcaactttaaactgcccctgcctggcaaagtgaccccagtgaggccgagtgctgtcttagcctgctttgcctcccctcctcttgggatggatctaatctccagaggattatagaggaggccgttgagatttgctccctgcgaatgtaggctgcaaaaaatggcttttgtcttttgccttctcccggcctggtatggagagctggctgcccatgagtccctggccagtcctgcaagcccctcccagacctctccaacccttttttgaccagggattgttaactggttttctgatcctgtaccaactgtgcagaatggggtggcctgtgtctctctggaggagaaattgcttgatcagagctcttttctcctggaaaccagtgattccacccctggcagaaggtattggggagaaagggtgtgtatgtgcctgcagcttgagcctcaatcctgtgggccttgcttgggctgggactgcccctctcacacctgtcatgctacccagcagggatttggctggtgcattttgctccctcactcttatctgctccaacatacatatactagatttctttgagtctggttttggaaaggagaaaataggggttttgccttttaaagatttctgaaaggtgagaggtggcacaggggtagtggagtgaggtgagctgtcaatcctgctctccactccggcattctatggagagtccctcccgtttgtcccgaaacaacttccttatgtaggactgcaccctgttagctgtgcctgctctcaggatgagccagggacacagttcagagggtctgcagggccagtgttccatttggatccatctcggaggggtgacccaaaatgggggtgggaagaggtgtggtttgagtccaggctgggaaccaggaagtcctgagtcctcctgaagagctgttcactcaagggcctgcttcagccttacacttctccaagcgtccatttcccccttgtctgggaaaatggagtgaaagctgttggtctgggagggaggcaggaaggagagtgggttgagataaatccctgtccttttctttgctgttttggacctcttaggtataggactgagggggtgccagcacagttttactccctagatctgtacctactgtctgggatctctagttctgtggagaaagcctggtgagacactaccccagtttagatccagggaaaaaatccttggtgtgtatgtgtgtcagtttactggctgtgaatgatgggactggggaacctggggtctttgtttagatatgttcaggggcctattaactgggaatcagcattgggatccctgtgctggactgcagggatggggaaatagggactgagggctcaggctttttggaggtgccccctagattatttttggtacaagttgtatgacattcttctctttgcttcttaatctctcatcttccatggccccatgaatgggctctggctttggaggatgttagtactctctcaaggccagatgaaggtggtttctgtaccttcttgagcagtaccagccttaccagcctgagagggctgagctcgggggagggctgaggaatttgcccctctggccttgtgtgaggcagccctcctcctacccactgtattatcattgttgccttttacttcttgatgtttgtgactcttttggcctcaactttgagaccagagcgggtagaggatctttaggggtatgtagtggtaagatatagtaagatgcaaagaattagaaaactttaagggccccttggaccttccgggtgtggccaggccttgaatgactgaatggaagaggggcctggctgctgccctcatctccacctcccacttcccatggtagcttctaaggactccttgaagttctggagcagcttttgtacgagccggccagatgacccaccctgctttcctttcgaatgtggttgtgtggcaggtttgggaaagatggcttgggaatggagatgatgtgtatcaggtgatgctttactttatccagtgagttctgagagtgttaggggaaaaaggaagtttctttcctgtgacatgtctccagaggggcatagccactatctggaaataaagggtgagttcagggcaggaagagtgatattgtagttcttagggaattgatttactgatttggggcacctttgagggttccccctgtctcatctgtcccagtcattcaaccgtaagtggctgactggggtatttgccttccagtttgggaggacgggctgtccttgctaagggtggtgtggtcactctggttagtcaagaagagtggaaaaggcgagagatgaatttctcaaacttttattgtttgagttctgttttagggatttcccccacctcaccaccactttctctaggaacactgtataccttctctgattaagagaaagggtctacatttcccactacaagctgctaacacttaccactttctccctccttctatagaatccctttcctattcttcgtgtctgtaattattgttcttttttttttcccactgtgcttaattccctctgagatctaggaaaataatgcccaaaggtgtaagtctcaacttttttaggtataactttagtgtgtttcatttggctctgatacaggcacgcatttcttagaagaagggacaagggaccgttattccccacccccatgtatgtgtgtggaaaccctgcttgagggaagaggaaggaagctactccgctgtgctgtgctatgtcctgccctgtttagaactcctctgagtggctctatgcttcctgagactacaactcccagcatgcttagcctcaggcctggctacacatgctcagtaactctcaaggtccacttctgttaactactagggatatctgaagaggaagggcagttggtgttgctaagggcaatgacctgagaccttcaggctgggtgagaccctgagctcagttagggcatgggccgggggttggtctgagctggatttgggttggaagtgggtggaaattagggagtttcttcttttgtaatggtgatgtcctcgtagaaacaagtggcggtgggggagatccatccatagctaggctgtagttccagtagtgtgttacatctcttgcagtgcctcagactctgcctctgggagagggatttttgctggactcaggcttcctgggtcatgactacccctgggttggcacagactggcctctagaatgggagcttacttgagacttgagggaaaggtgtgggaatagggctcaccaaaagccaaaaacccagaggcaagccaaagagcagtattagatacaaatggatatgcttctagttggatgctatggccccaggaactcttacagaggagcctggaagtgggaaagtcaaatggatcccctgagaatctctccagagtgtgagaagagcgtatgtgtttatctggggaggaagtgaccctacaggttagggagaatgactttcttgtcagtataggagtttgtagtatggctttgctctgatgtctggagggtctggatgccttcttcccaggattctgggaaaaatgcttcttgggaagacttagtaggcatatagatctctttcttggcaccaacaggtctccccgagagggccctgcccagtcggagagagggatggacagccagaagctggctggtgaggataaagattcagaaccggcaggtgagtaggacaaattgtttgtttgcttttagatttcattggcaaccttacatttctggtcctggcacaaggacatgagctaagtctatgtagcagataagtaatggaacaactttgttctttgggacaacagttgaaatatcatcactctgatccactcaggttttggataatctcatgcgtctggtgagtggactttgtgttaaatagggatgatggctgacacatgctgtttgtctgtttattcagctgatggacctgcagcttctgaggacccaagtgccactgagtcagacctgcccaacccacatgtgggagaggtctctgtccttagttctgggagtcccaggcttcaggagactcctcaggactgcaggtagcttgtttgagggcacatgaggatttgagagtctagggctttcaaggaagagaatttaggaaaatgagtgttggggaagcatgggcatgccagatcatggggttgctgggggcctggcgtggtactgatgcttgtgtgtccacagtgggggtccggtgcggcgttgtgctctctgtaactgcggggagcccagtctacacgggcagcgggagctacggcgctttgagttgccatttgattggccccggtgtccagtggtgtcccctggggggagcccagggcccaatgaggcagtgctgcccagtgaggacctatcacagattggtttccctgagggccttacacctgcccacctaggagaacctggaggtgagtgaggagaatggggcaggaaatgggataagggctgggtagtcctgagccagcaatcctctttttgttaattctttcctttctctttacctcttcccacctgtaaagggtcctgctgggctcaccattggtgtgctgcatggtcggcaggcgtatgggggcaggagggcccagaactatgtggtgtggacaaggccatcttctcagggatctcacaggtggggctgggccaggggattgcataggtgaagggcagggctggtgggcttctgagagtcaggttggaatgagaaggaccatgggtatactggggcagagctagtgcctgaactgtttgtctggggagagctggctgacactgaggctcttttttcaccctggcagcgctgctcccactgcaccaggctcggtgcctccatcccttgccgctcacctggatgtccacggctttaccacttcccctgcgcgactgccagcggttccttcctatccatgaaaacactgcagctgctatgcccagagcacagtgagggggctgcatatctgggtgagaagtcctgatctttggtcatagggcaaatgagagaccaaatgtgccttggatttttgtactctacagagcactgatcaaagtatagcattatttactgttggtctgccccactaaaataggtgtgaactttgtgagcaccagggttttgcctgtctcatttatcattttgtctccagtgcctagaacagtagctggcagacgttgggcaggcactcagtaactttgttgtttgttcattctgtgcccatggagtgcctgttttgtgtacagcaatgtgctgaggcttacaaggaatccatagctgacctgtggtgtctctaccccctgcagaggaggctcgctgtgcagtgtgtgaggggccaggggagttgtgtgacctgttcttctgtaccagctgtgggcatcactatcacggggcctgcctggacactgctctgactgcccgcaaacgtgctggctggcagtgccctgaatgcaaagtgtgccaagcctgcaggtaggaatggaagggcaggaggaaagtcttaggcacaacacaggttagggttgaaaatgagggcagtcggagaaggcctgttaacatgaaaacaacaaaaaagaaaggaaatgagggcagagaggacactgtaatgttccatgtgcacctgcaggaaacctgggaatgactctaagatgttggtttgtgagacgtgtgacaaaggataccatactttctgcctaaaaccacccatggaggaactgcctgctcactcttggaagtgcaaggtgagtgtaccctgattctgccctattgtccctaactgtgtctgctacagcattctctgtcttgacaagttgtgtactttcgtttagtctttgctgtctgaccaatgcctgttttgcccactcccttcccttaggcgtgccgggtgtgccgggcctgtggggcgggctcagcagaactgaatcccaactcggagtggtttgagaactactctctctgtcaccgctgtcacaaagcccagggaggtcagactatccgctccgttgctgagcagcataccccggtgtgtagcaggtaagtggtggggactgactgagattgggctggcaggttggaagaactgacattggcaggggccttgttaaattgagtggactttgagaggagagccctaaggtgggcagtgccatccacagcattcgtgcctccccccagtgtgctctctaggatttgttagctggtgagagccacagtgcctgctcccctgtaccctctgcagattttcacccccagagcctggcgatacccccactgacgagcccgatgctctgtacgttgcatgccaagggcagccaaagggtgggcacgtgacctctatgcaacccaaggaaccagggcccctgcaatgtgaagccaaaccactaggtgagtagggtttgagggtccctgaaattcatccccttttattctatggcaagagacagtttgtgcattgccccagaccccacactttctgtggagtagatctgagctagataggagcatcgtgttgttgtgtctgcagggaaagcaggggtccaacttgagccccagttggaggcccccctaaacgaggagatgccactgctgcccccacctgaggagtcacccctgtccccaccacctgaggaatcacccacgtccccaccacctgaggcatcacgcctgtcaccaccacctgaggaattgcccgcatccccacttcctgaggcattgcacctgtcccggccgctggaggaatcgcccctctctccgccgcctgaggagtctcctctgtctcccccacctgaatcatcacctttttctccactggaggagtcgcccttgtctccaccggaagagtcacccccatctcctgcacttgagacgcctctatccccaccacctgaagcatcgcccctgtccccaccatttgaagaatctcctttgtccccgccacctgaggaattgcccacttccccgccacctgaagcatctcgcctgtctccaccacctgaggagtcacccatgtcccctccacctgaagagtcacccatgtctccaccaccggaggcatctcgtctgttcccaccatttgaagagtctcctctgtcccctccacctgaggagtctcccctttccccaccacctgaggcatcacgcctgtccccaccacctgaggactcgcctatgtccccaccacctgaagaatcacctatgtcccccccacctgaggtatcgcgcctatcccccctgcctgtggtgtcacgcctgtctccaccgcctgaggaatctcccttgtccccaccgcctgaggagtctcccacgtcccctccacctgaggcttcacgcctctccccaccacctgaggactcccccacatccccaccacctgaggactcacctgcttccccaccaccggaggactcgctcatgtccctgccgctggaggagtcacccctgttgccactacctgaggagccgcaactctgcccccggtccgaggggccgcacctgtcaccccggcctgaggagccgcacctgtccccccggcctgaggagccacacctatctccgcaggctgaggagccacacctgtccccccagcctgaggagccatgcctatgcgctgtgcctgaggagccacacttgtccccccaggctgagggaccacatctgtcccctcagcctgaggaattgcacctgtccccccagactgaggagccgcacctgtctcctgtgcctgaggagccatgcttgtccccccaacctgaggaatcacacctgtccccccagtctgaggagccatgcctgtccccccggcctgaggaatcgcatctgtcccctgagcttgagaagccacccctgtcccctcggcctgaaaagccccctgaggagccaggccaatgccctgcacctgaggagctgcccttgttccctccccctggggaaccatccttatctcccttgcttggagagccagccctgtctgagcctggggaaccacctctgtcccctctgcccgaggagctgccgttgtccccatctggggagccatccttgtcgcctcagctgatgccaccaggtaaggggatgttagtactctgttattctggaacagctgtaactcttcatggcacatctaatctaagagcccttcttttttctctttccttccagatccccttcctcctccactctcacccatcatcacagctgcggccccaccggccctgtctcctttgggggagttagagtacccctttggtgccaaaggggacagtgaccctgagtcaccgttggctgcccccatcctggagacacccatcagccctccaccagaagctaactgcactgaccctgagcctgtcccccctatgatccttcccccatctccaggctccccagtggggccggcttctcccatcctgatggagccccttcctcctcagtgttcgccactccttcagcattccctggttccccaaaactcccctccttcccagtgctctcctcctgccctaccactgtccgttccctccccgttgagtcccatagggaaggtagtgggggtctcagatgaggctgagctgcacgagatggagactgagaaagtttcagaacctgaatgcccagccttggaacccagtgccaccagtcctctcccttccccaatgggggacctttcctgccccgcccccagccctgccccagccctggatgacttctctggcctaggggaagacacagcccctctggatgggattgatgctccgggttcacagccagagcctggacagacccctggcagtttggctagtgaacttaaaggctcccctgtgctcctggaccccgaggagctggcccctgtgacccctatggaggtctaccccgaatgcaagcagacagcagggcagggctcaccatgtgaagaacaggaagagccacgtgcaccggtggcccccacaccacccactctcatcaaatccgacatcgttaacgagatctctaatctgagccagggtgatgccagtgccagttttcctggctcagagcccctcctgggctctccagacccggaggggggtggctccctgtccatggagttgggggtctctacggatgttagtccagcccgagatgagggctccctacggctctgtactgactcactgccagagactgatgactcactattgtgcgatgctgggacagctatcagcggaggcaaagctgagggggagaaggggcggcggcgcagctccccagcccgttcccgcatcaaacaggtgaggggctatctagctgcgggatgtgattagagttagcccactgtcagaggtacagtcctgtgtcactgatactttcccaccttgctttgtgaatcctagacttggagatcctttattccagttattaaggagaaaatactaatacgtagaagggacaagtaacttgcccagattcatggttactcagtaatagaattgggaccagaaacttggttctttcaagccattgttttttctccttgcccatctcaaccactcttgggaggggaagaatgggtttgggctagagctatgcgcttgttgatatctgggagtttggccttttcccttgccctgagtgggactcctgggcttattacctgtcttactctgtccgtttgtcacttcttctgttcaagtgtgtaaacccaacacactagcccttgacatgctcctgtcattgtccccttctttcactcagggtcgcagcagcagtttcccaggaagacgccggcctcgtggaggagcccatggaggacgtggtagaggacgggcccggctaaagtcaactgcttcttccattgagactctggtagtaaggagatgcctcctattcctcccatcccccaaccatgctttagcaccctctgagtcctgccagtcccttgcatgcttgcctacctgcctgctcgtctagggcctgtctggctatgtctgaattcctgtccacttggcccgcaggtttttctgaaatctctgctatcagactgaggctcaatttgggagctggggtgttctgtctgttattcctggcttttggccttcatcttaaccaagggttcacactttcttcccccaacaccaaagaggaaagtagcttggtgggggcagatttatctgcctcactttccataactctctgcccatcaggttgctgacattgatagctctcccagtaaggaggaggaggaagaagatgatgacaccatgcagaataccgtggttctcttctccaacacagacaaatttgtcctaatgcaggtaccatacagtgagacctggcacactgaacattgtgtatgtgtgtgtttggtgagaggatagatgggaaaactggacctactttggggatacccagctaatgagaaaacagaccatgaattctaatcatgttattcattggtttgtccatccatcacatttctcttgagtatctcttctgagcttggcactaagctaggagctagagaaatagcagtgaaaaagtctttgccttattgaactttatagcttagggaacttacatgtgtcctcacttgaataatcttgaagctgatagaattttgtcacatatgtgattctcacctgaccagtctttactccatcttatcttcctttaatttcttcttaacttcacccatgtcaggctttataaattcaagtgacctgattaggtgagtaaggcatcctaggaaggagcagggtcccttggtagcttacagcatcctaacgctgtgggatggggttcctgactctggtcgcaaatcagtgttgtagcgtcatagtagactggatctgagtgggatggggagatctagttggacatttgggtttctctgtgtttccccaggacatgtgtgtggtatgtggcagctttggccggggggcagagggccacctccttgcctgttcgcagtgctctcagtgctatcacccttactgtgtcaacagcaaggtgagttcagggcccaagaggtgtaggctggggaatagggtcagttatttcttaccctagttccttgtcctggccataccacctcttaaagcggccatcggtcatggttgttcattagtcaccagtggttatcaaacttttcttggggaaaagtactttggaactcaacggtggacttgatagtttctttgtggtaggccctgacttgctggtataattcagtccatcgtaaaaaataacaacatggctgggcatggtggctcccacctgtaatcccagcactttgggaggcctaggtgggtggatcacctgagattaggagttcaggaccatcgtggtcaacatggtgaaaccccgtctcttctaaaaaataacaaaaattagctgagtgtggtagcgcgtgcctgtaatctcagcaactcgggaggctgaggcaggagaattgcttgaacccaggaggcggaggttgcagtgagccgagatcacgccactgtactccactccagcctgggcaacagagtgagatccgtctcaaaaaaaaaaaaaaaaaaaaaaaaaggaaaaactgggggacctaattcggtccacagtctctttttaggggcttggctagtggaaagattgctattctattcacaatgaggcagtggctagtgcagctcttctctgatcagcagagatcattgggagcctaagtttagagtcactgttttggggacaagggtgctctgcctaagtctctgtgtgctcaaatggaggcctagtctctgcattgggctgcctccagcctcacccttagaagttccacctcctaggctgggcacggtggcgcacacctgtaatcccagcactttacttcgggagggtgaggcgggtggatcacctaaggtcaggagttggtgaccagcctgactaacatggtgaaactctgactctactaaatacaaaaaaattagccaggtgtggtggcaggtgcctgtaatctcagctacttgggaggctgagacaagagaatcacttgtacctgagaggcagaggttgcagtgagccgagatcgcgccattgcactccagcctggggaacaagagcaaaactccatctccaaaaaaaaataaaaagaagttctacctcttttccacctcacaccctgagaagttcccatcttctgccccagatcaccaaggtgatgctgctcaagggctggcgttgtgtggagtgtattgtgtgtgaggtgtgtggccaggcctccgacccctcacgcctgctgctctgtgatgactgtgatattagctaccacacatactgcctggaccccccactgctcaccgtccccaagggcggctggaagtgcaagtggtaaggagactgggatcttcagtggagccctggggccttgagatgttaaagtggatatgatgttgagtatgtgacagaggctgggtttaggaggccaggctggtggcttgggtttccggtgaggggacttctgggtacttcgggtaggttgggtgctaaagctctgttttcctgctcctatcaggtgtgtgtcctgtatgcagtgtggggctgcttcccctggcttccactgtgaatggcagaatagttacacacactgtgggccctgtgccagcctggtgacctgccctatctgtcatgctccttacgtagaagaggacctactaatccagtgccgccactgtgaacggtgagaacatccctttctcctcactttggccctgttgccagcctcgcattgcctgagcttatttcctccagtctctgttctccaggtggatgcatgcaggctgtgagagcctcttcacagaggacgatgtggagcaggcagccgatgaaggctttgactgtgtctcctgccagccctacgtggtaaagcctgtgggtgagtaccagctgctgggtagggggaggagtcagagcaggggtaccttgctttgggacaggacctcagccacctccgtttgtccttctctccatagcgcctgttgcacctccagagctggtgcccatgaaggtgaaagagccaggtgagtcacagaaattttgaatgccaaagccagaccagacgtcggacatcatctagtctagctccaaccccctagcttcatctccttattttaagaggaggaaactcagacccagagaagttaagtggcctgcccaaggtcacctagtaagttagtggcaaagttatgcctagaaccaaggtctccagcttcccgggcaatgttcctttcatcaggcaccatggtctcttcactgctaggatttcgtcttcagatctcttttttttttttttttttgagatggagtcttgctctgttgcccaggctggagtgcagtggcacaagcttggcacattgcaagctttgcctcccgggttcacgccattctcctgcctcagcctcctgagtagctgggactacaggtgcccgccaccacgcccggctaattttttgtattttttagtagagatggggtttcaccgtgttagccaggatggtctcgatctccggacctcgtgatctgccagcctcggcctcccaaagggctgggattacaagcatgagcaccgcgcccggctgagaacataactctttttcctaagtgaaaggggccagggacatctccatcgtgatatggcactgctgctggcatctaggacactgtgtgctggcattcagcaagtaggggccctcatagccccagacagcaagagaatctatttagtgaacctagggttaatcatgagcaaaggcaggcttctgagttacagttcctctctgaatctccctgggtcactgacagagaactcgggcctcagccagtgccccttggtggcctgttctcctcagcatttagaccctaagctggacttttgtcactgcctttgtctcagctaaggacataggttgaaacttgcagttctggtttccctggggcttccatccagggatcacatactctttcctcttatgcagagccccagtactttcgcttcgaaggtgtgtggctgacagaaactggcatggccttgctgcgtaacctgaccatgtcaccactgcacaagcggcgccaacggcgaggacggcttggcctcccaggcgaggcaggattggagggttctgagccctcagatgcccttggccctgatgacaagaaggatggggacctggacaccgatgagctgctcaagggtgaaggttagcttggggaatcttagggagcggcagagtagggggagcgtgactctgggagtgggatgttgggtgggggctacattgccactcagttacccttaagcactgctgtctcgtctaagtggctctgaggcaaggtattcagctctctcagtggcaggatgacaaggttaaaagggcctatagttctgatttgcctccatctcttctgtcaccatacgcaggtggtgtggagcacatggagtgcgaaattaaactggagggccccgtcagccctgatgtggagcctggcaaagaggagaccgaggaaagcaaaaaacgcaagcgtaaaccatatcggcctggtgaggtcctgggatggggttgtggggtggtggggtggtgcggggcagctcaataggtcccccagcggcttctcatccacaactctgcctcctcataggcattggtggtttcatggtgcgacagcggaaatcccacacacgcacgaaaaaggggcctgctgcacaggcggaggtgttgagtggggatgggcagcccgacgagggtgagacgggtgagggcaccagtggggcctgggagaaggtggggcaatgctagagagacccagggggtggactcattgaaagggccaagagggtggtagacccagctggtgttgtgggagagagtaggcacaaagtgtcaccctgcaagttgggagcagcatgctctcaacccgagtctgacacttccgttctgtccacagtgatacctgctgacctgcctgcagagggcgccgtggagcagagcttagctgaaggggatgagaagaagaagcaacagcggcgagggcgcaagaagagcaaactggaggacatgttccctgcttacttgcaggtgggtctcaggctccaagcagtgagggaggtgtctgtgccctgcagggcatgaagaaaactgtttctccttgactgccccacaggaagccttctttgggaaggagctgctggacctgagccgtaaggccctttttgcagttggggtgggccggccaagctttggactagggaccccaaaagccaagggagatggaggctcagaaaggaaggaactccccacatcgcagaaaggttagttatgtgggagtgagtggtgtgagagaatccaactttcttctggcttaggagctggcaagttatttgatgggaaatggactggcctccaggagtcaagggtggggtcaagggtcctggcctgtagggctgtgggactggagacctgttctgggcatcagatgtaggacatctctgattggaggggggactcttgctcataggagatgatggtccagatattgcagatgaagaatcccgtggcctcgagggcaaagccgatacaccaggtgagggctgccggggttactgtgtcctgtcttggccttgcttgcctctgtccctctgctgtgcccctgagcattgtcagtgttggaggctggaaactgtcccatggccctctgtggttcagagtggccatgacccatcctggccttgacccatgggtttctcctggcatttacaggacctgaggatgggggcgtgaaggcatccccagtgcccagtgaccctgagaagccaggcaccccaggtgaagggatgcttagctctgacttagacaggatttccacagaaggtgaggctgtgacccgtacctctttgtgtataagggttttctatgggagaaggaggaggtcctatctttgggactgtgatctgtacagcttctctggtggggagtcctggactgttcctggccatgatcatttgtagacctgtggtgtcacctgaacttcccagtcttcctcaacagtgtccttcattcccccacagaactgcccaagatggaatccaaggacctgcagcagctcttcaaggatgttctgggctctgaacgagaacagcatctgggttgtggaacccctggcctagaaggcagccgtacgccactgcagaggccctttcttcaaggtaatacaggtgggagtggtctgaagactgacataaccaagcttgcctccaggatgggccagttgctcttttctctgatcctgtccgtcttgtaggtggactccctttgggcaatctgccctccagcagcccaatggactcctacccaggcctctgccagtccccgttcctggattctaggttggtgtctctgcgtaacctttgtgggcagtcctcgttgtcctttccctccatctgagttcatgctttgcctccctcggactcctgcagcacttcccctgctcctccccattcccttgttagtgaccctcctcttttggggcagggcagtggcctggggctctaggcagtttgtctggggtgggacttggcatccctgcgccctgtgactctctgcccctgcgccccagggagcgcgggggcttctttagcccggaacccggtgagcccgacagcccctggacgggctcaggtggcaccacgccctccacccccacaacccccaccacggagggtgagggcgacggactctcctataaccagcggagtcttcagcgctgggagaaggatgaggagttgggccagctgtccaccatctcacctgtgctctatgccaacattaattttcctaatctcaagcaagactacccaggtacctgtgggatgagggcaagggagacagcctggcaacatggcaggtggaggagtcgcctgccaagtcttctctgactcactctctctgccctccagactggtcaagccgttgcaaacaaatcatgaagctctggagaaaggttccagcagctgacaaagccccctacctggtgaggcagaaaggagcatggattagcgtgggaactgagagggagggagggatctttgggtaatttacctcagttctttccgctccccactcctaaagcagctgggccagaagggatctgcttctgggtagggagtgtgaaaacactacagtatgggggcggggcatgagaccaagcactaggccctaaggctgtgtcccatatccctcagcaaaaggccaaagataaccgggcagctcaccgcatcaacaaggtgcagaaggtgagtggggctgggctggggtgtagcagtcctctagtgggtggcctctcttgagggtggagggccatggggcctgcctgcagcagcctgactgccctatgcctggtctccccctgtagcaggctgagagccagatcaacaagcagaccaaggtgggcgacatagcccgtaagactgaccgaccggccctacatctccgcattcccccgcagccaggggcactgggcagcccgccccccgctgctgcccccaccattttcattggcagccccactacccccgccggcttgtctacctctgcggacgggttcctgaagccgccggcgggctcggtgcctggccctgactcgcctggtgagctcttcctcaagctcccaccccaggtgcccgcccaagtgccttcgcaggacccctttggactggcccctgcctatcccctggagccccgcttccccacggcaccgcccacctatcccccctatcctagtcctacgggggcccctgcgcagcccccgatgctgggcgcctcatctcgtcctggggctggccagccaggggaattccacactaccccacctggcacccccagacaccagccctccacacctgacccattcctcaaaccccgctgcccctcgctggataacttggctgtgcctgagagccctggggtagggggaggcaaagcttccgagcccctgctctcgcccccaccttttggggagtcccggaaggccctagaggtgaagaaggaagagcttggggcatcctctcctagctatgggcccccaaacctgggctttgttgactcaccctcctcaggcacccacctgggtggcctggagttaaagacacctgatgtcttcaaagcccccctgacccctcgggcatctcaggtagagccccagagcccgggcttgggcctaaggccccaggagccaccccctgcccaggctttggcaccttctcctccaagtcacccagacatctttcgccctggctcctacactgacccatatgctcagcccccattgactcctcggccccaacctccgccccctgagagctgctgtgctctgccccctcgctcactgccctccgaccctttctcccgagtgcctgccagtcctcagtcccagtccagctcccagtctccactgacaccccggcctctgtctgctgaagctttttgcccatcacccgttacccctcgcttccagtcccctgacccttattctcgcccaccctcacgccctcagtcccgtgacccatttgccccattgcataagccaccccgaccccagccccctgaagttgcctttaaggctgggtctctagcccacacttcgctgggggctggggggttcccagcagccctgcccgcggggccagcaggtgagctccatgccaaggtcccaagtgggcagccccccaattttgtccggtcccctgggacgggtgcatttgtgggcaccccctctcccatgcgtttcactttccctcaggcagtaggggagccttccctaaagccccctgtccctcagcctggtctcccgccaccccatgggatcaacagccattttgggcccggccccaccttgggcaagcctcaaagcacaaactacacagtagccacagggaacttccacccatcgggcagccccctggggcccagcagcgggtccacaggggagagctatgggctgtccccactacgccctccgtcggttctgccaccacctgcacccgacggatccctcccctacctgtcccatggagcctcacagcgatcaggcatcacctctcctgtcgaaaagcgagaagacccagggactggaatgggtagctctttggcgacagctgaactcccaggtacccaggacccaggcatgtccggccttagccaaacagagctggagaagcaacggcaggtaagttgacaccctggagctaagccccctatatcgctcctgtctctggggcagccctatgattggagtagaatgggcttattcctcttctcttttttttgcatagcgccagcgactacgagagctgctgattcggcagcagatccagcgcaacaccctgcggcaggagaaggaaacagctgcagcagctgcaggagcagtggggcctccaggcagctggggtgctgagcccagcagccctgcctttgagcagctgagtcgaggccagaccccctttgctgggacacaggtaggtagagtggcaagggatagtggggccaggatattgaaggttgctccaccttcatctaccttgtctcttctaggacaagagcagccttgtggggttgcccccaagcaagctgagtggccccatcctggggccagggtccttccctagcgatgaccgactctcccggccacctccaccagccacgccttcctctatggatgtgaacagccggtgaggctccaggaggttccctgggggtaaaccaagggggatggattttatcactgttggaagctcttgtgattttcctgtatcactaatccttttccagtatcactttctcttcttcctcattccttttctccctcactgcattaattctatccttcctcactgccctaagcccatgttcttgctccttttcatctgatttcatcctactgactactgtatattcttccaggcaactggtaggaggctcccaagctttctatcagcgagcaccctatcctgggtccctgcccttacagcagcaacagcaacaactgtggcagcaacaacaggcaacagcagcaacctccatgcgatttgccatgtcagctcgctttccatcaactcctggacctgaacttggccgccaagccctaggttccccgttggcgggaatttccacccgtctgccaggccctggtgagccagtgcctggtccagctggtcctgcccagttcattgagctgcggcacaatgtacagaaaggactgggacctgggggcactccgtttcctggtcagggcccacctcagagaccccgtttttaccctgtaagtgaggacccccaccgactggctcctgaagggcttcggggcctggcggtatcaggtcttcccccacagaaaccctcagccccaccggcccctgaattgaacaacagtcttcatccaacaccccacaccaagggtcctaccctgccaactggtttggagctggtcaaccggcccccgtcgagcactgagcttggccgccccaatcctctggccctggaagctgggaagttgccctgtgaggatcccgagctggatgacgattttgatgcccacaaggccctagaggatgatgaagagcttgctcacctgggtctgggtgtggatgtggccaagggtgatgatgaacttggcaccttagaaaacctggagaccaatgacccccacttggatgacctgctcaatggagacgagtttgacctgctggcatatactgatcctgagctggacactggggacaagaaggatatcttcaatgagcacctgaggctggtagaatcggctaatgagaaggctgaacgggaggccctgctgcggggggtggagccaggacccttgggccctgaggagcgccctccccctgctgctgatgcctctgaaccccgcctggcatctgtgctccctgaggtgaagcccaaggtggaggagggtggacgccacccttctccttgccaattcaccattgctacccccaaggtagagcccgcacctgctgccaattcccttggcctggggctaaagccaggacagagcatgatgggcagccgggatacccggatgggcacagggccattttctagcagtgggcacacagctgagaaggcctcctttggggccacgggaggaccaccagctcacctgctgacccccagcccactgagtggcccaggaggatcctccctgctggaaaagtttgagctcgagagtggggctttgaccttgcctggtggacctgcagcatctggggatgagctagacaagatggagagctcactggtagccagcgagttacccctgctcattgaggacctgttggagcatgagaagaaggagctgcagaagaagcagcagctttcagcacagttgcagcctgcccagcagcagcagcaacagcagcagcagcattccctactgtctgcaccaggccctgcccaggccatgtctttgccacatgagggctcttctcccagtttggctgggtcccaacagcagctttccctgggtcttgcaggtgcccgacagccaggtttgccccagccactgatgcccacccagccaccagctcatgccctccagcaacgcctggctccatccatggctatggtgtccaatcaagggcatatgctaagtgggcagcatggagggcaggcaggcttggtaccccagcagagctcacagccagtgctatcacagaagcccatgggcaccatgccaccttccatgtgcatgaagccgcagcaattggcaatgcagcagcagctggcaaacagcttcttcccagatacaggtaacctcagctggtaacatagccaagttactcagggtgattattgttatccctaaatgggcactgaggctagagacctcagataatccctacttaagatgggacacaaagaactttggctaaatatcatactagtggtagaggcagaaacactgtagcttttaagaagagagagaacagttcctggcatatagtaggcatgtagcagatgtttgaataaatggaatgaatgtatgaatgaagcctaattagcagagcctttgtagctgtagtgaagttgaaagcttaagacttgaagagaagtggtgcaaaaaaaagcagttgaggccaggcacaatggctcatgcctgtaatcccagcactttgggagaccaaggcaggtggatcacttaagatcaggagttcaagaccagcctggccaagatgatgaaaccccatctctactaaacatacaaaaattagctgggtgtgagccgggcgcggtggtgcatccctgtaatcccagctactcgggaggctgaggcaggagagttgattgaacccatgaggcagaggttgtggtgagccgagatcgcctcattgcactccagcctgggcaacaagagcgaaactccatctcaaaaaaaaaaaaaaaaaaaaaaaaaaattagctgggtgtggtggtgcacgcctgtagttccagctactcgagaggctgaggcaggagaattgcttgaacccaggaggtggaggttgcagttagctgagatcacgccattgcacttcaggctgggcaacagagcgagactctgtcttaaaaaaaaaaaaaaaagcgattgggataggtgaaaaagttcattgaggctgcaatggtgggaaaacctatgggatgtttcaagaacagtgagtgaattggttaggctggagtaaactgtttcgagtgaagtaagtgacataattttggtgagataagatgggggccagattgaaaaagacctcaaattataatagcatttattgagtaattactatttgccaaggagtttactgagcactttatactttttgtccaatttaatcattatagcagactcattaaataggtattgttattatctttgattacagaagaggaaacagaagtggaggttaagtaacttgtccaagattacacagcagctagcagagctagatctgaagtctggtcggtactcctcttaactgtttactgcctcaggattccaggagagggagtttgggttagtccttaagaaagtgggagctctggccaggtgctgtggctcacgcctttaatcccagcactttgggaggctgaggcgggtggatcacctgaggtcaggagttccagaccagcctggccaacatggtgaaacctcgtttctactaaaaatacaaaaattagctgggcttggtggtgggcacctgtaatcacagctactcggcaggctgaggcaggagaatcgcttgaacccaggaagcagaggttgcagtgagcctaaattgcaccattgcactccagcctgggtgacaagagcaagactctgtctttaaaaaagaaaagaaaagaaaaaaagaaagtggatgctcagttaagttttctgagcagtggagaaatatacaaagtgtgggattttaggatgatgtaagtttttggtggttggttgtttcttcttttttgcccagcattctagacagacaggagagtggactacaggtgatgcccaaaacagctctggaatctagggctttgcaacagtgccagcatcttgggtgcttgggctgtgctagttggactaagaacattacctttgaagaatgctttccgagtcataaagtgtacttatattcttgtcacatttgatcctcttaacacctctgtgaggtagacggagtagggatcatcatctgtatcaaataaaagggtaaactgaggtgaaataacacaggttgactcaacaaatatttacggagcccctttttgtagcacggtgcaagtaaaaacaggcccacatgtcctgtgaatagagctgattcacccaggccgactggctcctaattcagtggtctttctgccttgccgtgccattgttctgcctggcgtggttgaagtcaggatgttgaagggaatcgcagatattcactggagcattggccccatagcccagctcacttggttctcccctctccagacctggacaaatttgctgcagaagatatcattgatcccattgcaaaggccaagatggtggctttgaaaggcatcaagaaagtgatggctcagggcagcattggggtggcacctggtatgaacaggtaagactcagggctggaatggggttggcccttttctttcccagtcacaccccttcttggctcccctccctacttgtcccacgtctctttgctttccaactttcttattgccaacacttatcttctgtgctttggtggactccagacagcaagtgtctctgctagcccagaggctctcggggggacctagcagtgatctgcagaaccatgtggcagctgggagtggccaggtaagtggtcaggtgggagtaggaacttgtgtcttatgccactgggccacccttcttagggcctagcagggaacaatgaccctttagcagcctctctcattgcaggagcggagtgctggtgatccctcccagcctcgtcccaacccgcccacttttgctcagggagtgatcagtgagtatggggcgtgggaggaaggtgcaggggagtggtttgggtcatatggaggaagagggattgggattacccttttgcaggtcctgacacccagcttcttttcccagatgaagctgaccagcggcagtatgaggagtggctgttccatacccagcagctcctacagatgcagctgaaggtgctagaggagcagattggtgtacaccgcaagtcccggaaggctctgtgtgccaagcagcgcactgccaaaaaagctggccgtgagttcccagaagctgatgctgagaagctcaagctggttacagagcagcagagcaagatccagaaacaactggatcaggtgggggaaagcaaacttcagcctagcacccagaaggcagggaagagggttggcatggggggagcatgccccagcctgacctctccgaccctcccatgttaggtccggaaacagcagaaggagcacactaatctcatggcagaatatcggaacaagcagcagcaacaacagcagcagcagcagcaacaacagcaacagcactcagctgtgctggctctcagcccttcccagagtccccggctgctcaccaagctccctggtcagctgctccctggccatgggctgcagccaccacaggggcctccgggtgggcaagccggaggtcttcgcctgacccctgggggtatggcactacctggacagcctggtggccccttccttaatacagctctggcccaacagcagcaacagcaacattctggtggggctggatccctggctggcccttcagggggcttcttccctggcaaccttgctcttcgaagcctcggacctgattcaaggcttttacaggaaaggcagctgcagctgcagcagcaacgtatgcagctggcccagaaactgcagcagcagcagcagcagcaacagcagcagcagcaccttctaggacaggtggcaatccagcagcaacagcagcagggtcctggagtacagacaaaccaagctctgggtcccaagccccagggccttatgcctcccagcagccaccaaggcctcctggtccagcagctgtcccctcaaccaccccaggggccccagggcatgctgggccctgcccaggtggctgtgttgcagcagcagcaccctggagctttgggcccccagggccctcacagacaggtgcttatgacccagtcccgggtgctcagttccccccagctggcacagcagggtcagggccttatgggacacaggctggtcacagcccagcagcagcagcagcaacaacagcaccaacagcaagggtccatggcagggctgtcccatcttcagcagagtctgatgtcacacagtgggcagcccaaactgagcgctcagcccatgggctctttacagcagcttcagcagcagcagcagctgcaacagcaacagcaacttcagcagcagcagcagcagcagctacaacagcaacagcaacttcagcagcaacagcttcaacagcagcaacagcagcagcagcttcaacaacagcagcagcaacagcttcaacagcagcaacagcagctacaacagcaacagcaacaacaacagcagcagtttcaacagcagcagcaacagcagcagatgggccttttaaaccagagtcgaactttactgtctcctcagcaacaacagcagcagcaagtggcacttggccctggcatgccagcaaagcctcttcaacacttttctagccctggagccctgggtccaaccctcctcctgacgggcaaggaacaaaacaccgtagacccagccgtttcttcagaggccactgaggggccctctacacatcagggagggccgttagcaataggaactacccctgagtcaatggccactgaaccaggagaggtaaagccctcactctctggggactcacaactcctgcttgtccaaccccagccccagcctcagcccagctctctgcagctgcagccacctctgaggcttccaggacaacagcagcagcaagttagcctgctccacacagcaggtggaggaagccatgggcagctaggcagtggatcatcttctgaggcctcatctgtgccccacctgctggctcagccctctgtttccttaggggatcagcctgggtccatgacccagaaccttctgggcccccaacagcccatgctagagcggcccatgcaaaataatacagggccacaacctcccaaaccaggacctgtcctccagtctgggcagggtctgcctggggttggaatcatgcctacggtgggtcagcttcgagcacagctccaaggagtcctggccaaaaacccacagctgcggcacttaagtcctcagcagcagcagcagctacaggcactcctcatgcagcggcagctgcagcagagtcaggcagtacgccagaccccaccctaccaggagcctgggacccagacctctcccctccagggcctcctgggctgccaacctcaacttgggggcttccctggaccacagacaggccccctccaggagctaggggcagggcctcgacctcagggcccaccccggctccctgccccaccaggagccttatctacaggaccagtccttggccctgtccatcccacacctccaccatccagccctcaagagccaaagagaccttcacaattaccttcccccagctcccagcttcccactgaggcccagctccctcccacccatccagggacccccaaacctcaggggccaaccttggagccgcctcctgggagggtctcacctgctgctgcccagcttgcagataccttgtttagcaagggtctgggaccttgggatcccccagacaacctagcagaaacccagaagccagagcagagcagcctggtacctgggcatctggaccaggtgaatggacaggtggtgcctgaggcatcccaactcagcatcaagcaggaacctcgggaagagccatgtgccctgggagcccagtcagtgaagagggaggccaatggggagccaataggggcaccaggaaccagcaaccacctcctgctggcaggccctcgctcagaagctgggcatctgctcttgcagaagctactccgggcaaagaatgtgcaactcagcactgggcgggggtccgaggggctgcgagctgagatcaacgggcacattgacagcaagctggctgggctggagcagaaactacagggtacccccagcaacaaggaggtgagtactctgagtagagtggagcaggtagagtgggtcctagagccagcggggggcagaatgagtgagcctgggtcagacagaagagatgagggctctgaggaggagggtagcagccttcaatgggcttatttggcttaggatgcagcagcaaggaagcctttgacaccgaagcccaagcgggtacagaaggcaagcgacaggttggtgagctcccgaaagaagctgcggaaggaggacggggtcagggccagcgaggccttgctgaaacagctgaaacaggtgaccccccaggagacagtccccctggtcccatcccaggatagggggcaccctgtcccccagctgtgcaagacagcgatgcaaacgctgcaggttttgaactttgtcatcttgccccttgtaggagctgtccctgctgcccctaacggagcctgctatcaccgccaattttagcctctttgccccctttggcagtggctgcccagtcaatgggcagagccagctgaggggggcctttggaagtggggcgctgcccactggccctgactactattcccagctgcttaccaaggtcagaaaaatggcaatattttttgggaatagtgaagttcttgggaaggtgagggtgggaatagaaaacttgagggaattgctgacgtagagtggggccaggagattatatcagtctccctatgccatcttgcacacaacaccccaccccccacccctcagaataacctgagtaacccgccgacaccaccctcgtcgctgccccccaccccacccccatcggtgcagcagaagatggtgaatggcgtcaccccatctgaagagctgggggagcaccccaaggatgctgcctctgcccgggatagtgaaagggcactgaggggtaagtcaagagcagatgccacccctggtggagtttggtagctggagtccaaaccagttagtatgctgtacagtttagaaattagtgggttgcctgctgtcctgtgtgtttacataacagggcacctgaggtaggaagggccctttcaggactgatttcttgggggccagaatggacatttggagtctagagcaaatgcaataggagaggtgggtggcagggagcatctttatgaagctttgtatagaaggaacagtccagctttagtgagtgtggagctagactctgatctggatttgaattctggttcctgcattcattcaactgtgttactgtatccaagtaacttgattgacttgtgtgagcctcagtttcctcactgtaaaatggctattgtagtactcacttaatggagttattaaatgactaaacaaactccaaagagtatatctaaagccagctgccaccaggcctggtagcttatgcctgtaatcccaacattttgggaggccaagatggaaggattgcttgaggccaggagttcgagaccagcttgggcaatataacaagaccccatctctacgggaaaaaaaaaaaaaaaacaaaaaaaacaaaaaacaacagtgcctggcatgcaggacagactcaataaatataccttgtttgccccaaactggtaggtgggaggacagctaatcatgatagctgagatctcatgctaattaggcctaaaatattgggagaaggtaccatcagccctggccaccctcacctgacttttcttctccctacccacccctcagatacttcagaggtgaagagtctagacctgctggctgccttgcctacaccccctcacaatcagactgaggatgtcaggtaggggcggggccagaaatggggatgaggaacaagggtggggtacaggttgcctcatatttcctttggccaatggagatttcaagtaagacatctattcatctctagatttgggaggggagtctgcagggctgtagcaacaaatgtctacttttggtccccaggatggagagtgatgaggatagcgattctcctgacagcattgtgccagcttcatcccctgagagcatcttgggggaggaggcccctcgtttccctcatctgggctcaggccggtgggagcaagaggaccgggccctctcccctgtcatccccctcattcctcgggccagcatcccaggtatgtgctactctggatgtgggccaggcccagttcacctgggttgtccgaagctgggggagaggcggccaagtgttacacaaattcctctttctcattcagtcttcccagataccaaaccttatggggcccttggcctggaggtccctggaaagctgcctgtcacaacttgggaaaagggcaaaggaagtgaggtgtcagtcatgctcacagtctctgctgctgcagccaaggtgtgtcctaggggtacctcgaggctgaggggaacctgatcagagggcagtccctggaatttgtctggataaggaaaaatgtagtcgttcaagcacatgtactgagtacctattgtatgtgaaagcctgggctagaggctgtgagattcgggtaaatgaatcatggttcctgccctcacggggctcgtagtcccatggtaaagacagacaagtcaacaactaaggagcacctgtgtgtgtaatgacacaggtactacatgacagcattgccccagtcatgtttggtgggactctgtcagctgttttgaaaatattaacgggcttttgtggtcaaagaaagttggaaaacacagttaaaatgacaatatgggtttctttactacaagagtcctcaggtccttttaatttgctaacgtgtatcatgagcctccaagtcatggatagagcatgcatcatttcctaaacgtagttgatgtagttcccttttcgtggagctcccgtcagtgcccacagcagtttgggaaaggctgctgtgagggaagtgtatgaaaagagctgggtgacataggatagaactaccctggggagtgggttctaggtgtccttgtccccacccagctggtagtagagctcacctcagacacttggctgatatgtttcttccatcccttccctggccctggcagaacctgaatggcgtgatggtggcagtggcggagctgctgagcatgaagatccccaactcctatgaggtgctgttcccagagagccccgcccgggcaggcactgagccaaagaagggggaagctgagggtcctggtgagtgtggcagggaagccctttgggacttgaggggagtgattctggtgggaggctctgatccactcctttctgcaggtgggaaggaaaagggtctggaaggcaagagcccagacactggccctgattggctgaagcagtttgatgcagtgttgcctggctataccctgaagagccaactagacatcttgagcctcctgaaacaggtaggtctgggggagaaaaaggggtgggtgttagaaaaaaggggctgccggccaggcgcggtggctcacatctgtaatcccagtgctttgggaggcaaggcgagtgaatcactttaggccaggagtttgagaccagcctggccaacatggcgaaaccccgtctctactaaaaacaaaaacaaaacagtagccaggcgtgatggtgcgtgcctgtaatcccagctactcgaaaggctgaggcatgagaatcccttgaacccaggaggcagaggttgcagtgagccaagattgtgccactggatccagcctgggcaacagagcaagactgtgtctcaaaaaaaaaagaaaagaaaagaaaaaagaggctgtctagggcaaagaatgtggaggccttttgggagggtggcatatgggtgaggggaaggagggagctagttagatgaggagctggcactaatgatacagggcaccctcctacaggagagccccgccccagagccacccactcagcacagctatacctacaatgtctccaatctggatgtgcgacagctctcggccccacctcctgaagaaccctccccgcccccttcccccttggcaccttctcctgccagtccccctactgagcccttggttgaacttcccaccgaacccttggctgagccacccgtcccctcacctctgccactggcctcatcccctgaatcagcccgacccaagccccgtgcccggccccctgaagaaggtgaagattcccgtcctcctcgcctcaagaaatggaaaggagtgcgctggaagcggcttcggctgctgctgaccatccagaagggcagtgggcggcaggaggatgagcgggaagtggcagagtttatggagcagcttggcacagccttgcgacctgacaaggtaccgcgagacatgcgtcgctgctgtttctgtcatgaggagggtgacggggccactgatgggcctgcccgtctgctgaacctggacctggacctgtgggtgcacctcaactgtgccctttggtccacggaggtgtatgagacccagggcggggcactgatgaatgtggaggttgccctgcaccgaggactgctaaccaagtgctccctgtgccagcgaactggtgccaccagcagctgcaatcgcatgcgttgccccaatgtctaccattttgcttgtgccatccgtgccaagtgcatgttcttcaaggacaagaccatgctgtgtccaatgcataagatcaaggggccctgtgagcaagagctgagctcttttgctgtcttccggcgggtctacattgagcgggacgaggtgaagcaaatcgctagcatcattcagcggggagaacggctgcacatgttccgtgtggggggccttgtgttccacgccatcggacagctgctgcctcaccagatggctgactttcatagtgccactgccctctatcccgtgggctacgaggccacgcgcatctattggagcctccgcaccaacaatcgtcgctgctgctatcgctgttctattggtgagaacaacgggcggccggagtttgtaatcaaagtcatcgagcagggcctggaggacctggtcttcactgacgcctctccccagggtgagcagtgggcccttgaaatggataatatggaatgggaaaagtttctcccagggtcactgttacaatgtctataagaggacctgtagcttctatgtgaatgatcctccttcccccacctcaggcaggcagggggtctcttgaaaactcccagtgaaagtgtttgagcctctcttgtcaccctaaattcccttgtagttgaaaatattttgctggtctaatctcacatattctagttctgttgctatccccagtggaacaaaaggaaacagttctgagactatcatctgcctcacccaacctaatcctaaccaagttccttggggttgtttttccctggacgaaatcagaattattttgattttagttttagtgttaatgataaaataacagtaagagcaggtacctttttttgagtgtgtactgtgagccacaaactaagctaagtgatttgtgtagtttattttgttcatacaaccctatgaggtaagtattatactacgattatgcccagtttgttcataaagaaactgagtctcagatttcagtacagtcgtgcattgctaaatgacagggatacattctgagaaatgcattgttaggtgattttgtcattgtgtgaacttcatagagtgtactacacaaacctagatggcatagcatactacacacctaggctctgcggtataccccattgctcctaggctacaaatctgtacagcatgtaactgtactgaatactgtaggcagttgtaacatacggtaagtatgtgcatctagacatagaaaagatacagtaaaaatacagtacagtattataatcttaccagaccactgttgtatatatgattcctcattgaatgaaatgttgttaagctgcacgtgactgtatttggctcaaggtctcatgaccagtactagaacctgaacccaagtctttccaactccaaagcatgcctgctctttcactagggaccttccatggcctatgctgggtctcctgggccctgggtttgtatctcaaggctctgtgatgaccccttggggttggaaacctcctgcttcttaagagagagtgagactaggaggccaagagaggatctggaagaccaacacaacttcatgatagggaggcttgaaggcctcagaaaactgcagttctggattggggttagggactggaggtcagtgagcagaagttgcctctgaggactgctctcttccctgcttcttagccgtgtggaatcgcatcattgagcctgtggctgccatgagaaaagaggctgacatgctgcgactcttccctgagtatctgaagggcgaggagctctttgggctgacggtgcatgccgtgcttcgcatagctgaatcagtaaggaaggggctgggagctggggggcttggcgggcactgagaactttggcctaaccccaaaaaaactcaggctaaggtgagtatgaactgtgcccacagctgcccggggtggagagctgtcaaaactatttattccgctatgggcgccacccccttatggagctgccactcatgatcaaccccactggctgtgcccgatcagagcctaaaatcctcacacactacaaacggtgagcttgtgatgctggagccaagggatgtgggtgtgggtgttgacagggatcctctggtcccattatgaggatttaggatacagatcagagttcccgtggagaaaatggggaatcactcttagacttcctaattagagggcatgcaggtattagtagggtatccttttcctcctctcccaacctgctcagatgcacttgggatataggacagaattatcttgggcaccctggggaggtaatgggtaaactggtgaaattttatgaaatatataagggacttggtcacctctttcttctcctgttttacttctgggggagggcctgtgattctcccaaacctcagataccccatgggtgctagggtcaccttcccttccccatgagtgttggtgtcaaaaataaatagttagagatataatagaaaaataataaaaccttacatttgtatagcactttatactttttttttcaaagcgttttcacatccattatctcatttgatcctcacaacaaccttatgaggtaggtagggcaggtggtatgacccccattttacagctgagaaaactgagacccagaaagattaaatgactaggcaaaggtcacacagctgggaccagacccttacttcttcactgcaggtccttgttctttctgtgtaccagggaccttagtccctgggtagagggaggcagaatctgtggtagcagggctttctcgaaggtctttggtggctcctaggctgttgtagaatgtcagagactctccatccctagccagccttgtccttgatgccctgcaatggtggttttcaaactgtgagtgcctgtgttccaaaaagtcctggatcacttaaactgatgggttgaacttttccttcccatgcatatctcttccttccccaaattggattaaaccagaagagctccattgtcatctagtttatgtattggagttccagtcaacattttgttaaagaaaaaagcaaagatttctgctaaataaaaaaagaaccagaaacgtttgaaaaccactgctctgggatggcaagaatttggctggtgccctaaggtggtaaaaggcatcctgccaggcagccgtcattcccctgcactgagccatctgcacagagcccaatgttatgtcagagaaggggacagtccgaagaaaggataccacctttaggctgtgagttcacagccagttttaattcaaatctagcccagcgtggtaggcacagtccccattttcagggcttccagtatgtgcaggaggtaggattcagacattcaagcaaaccatcagcttaaattctaggcctgggctgcttgcggaaaacttcccagaggagcatggccttgagaatggtttggcaggagagtggtaggaagtgggagatgggagaacaggctcagtgtaggggaattggtgccccccatctccctccacaccccacccctcaccctgggctctctgtgccacccagggtgtcagaagggtccctgtagctagttgcttcctcaccagagctgagacccagttgcctctactcctttcccaaggctgcacttccagtgcttgccagcagcacacgcccctaactggtgtgttgcacatcccaggaggtggcagaggaggtgggtggtatgtacttggtctgagggagagctgtcttgtcatggattatatcacctcccaggccccataccctgaacagcaccagcatgtctaaggcatatcagagcaccttcacaggcgagaccaacaccccctacagcaagcagtttgtgcactccaagtcatctcagtaccggcggctgcgcaccgaatggaagaacaacgtgtacctggctcgctcccgtatccagggcctggggctctatgcagccaaggacctagaaaagcacacaatggttatcgagtacattggcaccatcattcggaacgaggtggccaaccggcgggagaaaatctacgaagagcaggtatgagctggcagaggggccattgtggtgcatagtctgcactcaaccaaggagcaagggcaggattggtcacaggagagcaggaggaaagctgtggtggggagaagggaaaggcaggagaaatgaagtacatgcaacaaaagcccccactgcctgagtctcctacctgatcccacagccaccactgccactctctgatactcttgtcccttcttctgcaacctctgcctttctagaatcgaggcatctacatgttccgaataaacaatgaacatgtgattgatgctacgttgaccggcggccctgccaggtgagagatgacgaggaaggagggatttagtggtccctgagagtggcactctgggggatagacgaacaaggaatcaaaattgtcccaagttagttgcctgacatccctgactctgtcccactgcccaggtacattaaccattcctgtgcccctaactgtgtggccgaagtcgtgacatttgacaaagaggacaaaatcatcatcatctccagccggcgaatccccaaaggagaggaggtgagaggaagtatcctgactgagtgacaaagcagctcctcctcctttcaccccttctctgccattccctaaatgtggattcctaggctgggcacctcagatcatatcttctctggcctcccctcttcctgtgggggactagcattgattctgccctcttctcttttcagctaacctatgactatcagtttgattttgaggacgatcagcacaagatcccctgccactgtggagcctggaattgtcggaaatggatgaactaagaagctttgaggctaccaggcaggggagtccccctacccacaacctcttccctgaaagggatgagggggaagagaggtagcagccagagccaggacccagggttggggctgccggctgacccggagcccctggagcaggaggctggggcagagggccctaggccaagcccaccctgggcaccagggacaatcctcttccccaccaccggccctcaggctggcatctctgcccccagctccaggaggggccagacagaagcagccattgggcatctcaggtttgagggggatatgggccgggaactacccagaagcatctgggaggcagcagggtgggggaagaggatgtgtggccgggcctcacagccctgctgctcccactgacctctccggcccaactcacggctgcaaagagacttgactaagcttgacaatcccaaaggccgggtcccacacctggccctgcctgccgggtcctgcccccaccctcacccccatccccctccctcttgatctgtctctgtttccctcttttcctctgtgtttctgtctctctatgggttgtgtttccttgttttccactctgacaaatgcaacatgaacgggaaagaggcgcccagctgcctaggagggcaagctgggcaagccgggcaaggagaccccgcacccacacctacctcatttaagtgttggattttttgctgttttgaaatgtgagaccctctccaagccccctactgccccaaccctctcccccacctcactgccctcttctgagtgggtggaaggggggtaggaggaggaagaaaaacaacaacaaaaaatccatctttgtttttaattatgggcatgggatggtggttgaggcaaatgatgatgaagattggggatgactggcccctagttgctctaggacttccttctccatctggacatgggggcaggagggagctaaacctaggaccaggatatctccctcctgttttcccaacctcatcatgagcctgtttgccctccagcccctggacgggttgggtggggggtagggtgagggctatccctgagtggcatgcccatacctagtgaggcagggtgtggcccggagctcccactttccctcagtcaccaaactgctgctggtctggtgggaaggggtggtgatgtgggggtgggggagcttagtgtcagcgcggggagggtggggggtatttatctatttatacatgggattgtacatagtcttgtggggcatgggggagccggctggaggtgagaaccctcccctctccccccaccccccggggagagcaaatgtaaaactactaatttttgtgctttatatattctatataaatatatctattttctttttacaaaaccagtttataaatggtaggggggtgtggggcggacacatggagctccccttgtgggggggccccctccattacccgacctaccgcccttttcctcaccccccaccccactccccaccccctggctgtgactgctgtaagatgggggtatagaggctgggcaattcccaccccctgttgtatagttggactatgttataacgcacaaaagagagctgaccccagggggagccagagggtgatgggttccttgcctccctttccttcccctttctgcccaagcttgtgctgcagttgaacctcttcctgggggtgggagtaggtaaggggtgggtgaggccccaaacccctctctggtagggaaccgtggggatgaagatgaagcttatatgcagttctcttctaggggctgtgggcaaagggcattttgtaattaatattttcaagaatcagatgtctggagtgtaggggtgggcttggtggtggtggacgggcgggcctgctggagggggagcttggtcgctgttgtgattttaggtttgtttttgttttgttttgaatttggggggttgtggattgttgggggtagggagattttttttttttaaagctgcttcctcaactgtttcaagctgcaaatgtttaagagaataacagcccccactcccacaggaaccgctgtaattaaatcagacagtaggaagactgggctgctgccctcaaagccacagcccttggatgttccttttccgagagcagaaggtctaggctacagggagggggagattggctcccgtgagtcaggctgtgtttggggcttgggccctgggattgggaaaaggggatggggcagactttgtaagcatatgctaggtatccgatagtcctgtagaatttagtgaagaaaccttatacagtttttaatttttatataaactataactcagacccaagctacaaggttggaattttggttggttttttttttaagtaccctgcctgtataattgcatcagaatcccccaccccaccccccgcccccgtgtttgtattttgggttggtttacactcgcacatactcagttttcagttttcccctttacagtcttctcccctcacctccaggaccctccccctttttaaaaaataaatcgctgacaagtgtgaatcccgtgaagactttattttgtgttgtgtgtatcctgtacagcaaggttggtccttcgtaacaacggatgaaatggttcccttttttaaagcgccctctctccctccaccctcagcgcccctgtccttggcatgttttgtatcagcgatcattctgaactgtacatatttatgttgcgagaggcaaagggcaagttttggattttgcttcttccaagtttgtttttaaacgacaaataaaaaaagaacattttaaatacaa

SEQ ID NO: 9 - DNA, 195474 bp, Homo sapiens
  source 1..195474: mol_type = genomic DNA
gggcggaagattccccgcccccacttctaggcttggttgaaccgtgcaggtaggtccggggctgggggagctgcctttggcactggtgcccctgggggtgggggcacgagtgggccagggtgatggtgaggtagaggaggtgtccctgacccgacgagctcgagggagcggcccggctgggaggcggggggccgcggggcccggggagcgggcgccgccgagggccctggaagcggcggggctgggggagaggggacgcgtgtgtggggcacggggacccccgcccagcgcccactcgtaggcctgggacgccggctgccggccgactggcctgagggcctggctgcccggggggcgggccggggccgcggccgggggcgcggagcggacctcggggcgccaggccgagccgaggtgggacggaccgacgcggagaggaagggaagccgcatcccgcggggcgcccctcctgaagcgagccgggcaacggccgcgggcgcccctgccctgagcccaccccgcgctctgccctccctaacaatgggaatggggcagaaggaggcgccccactgcggggaggtgaggggtgggtttgggactggggtccgcggtggggggaggtgcgatctcgggctctcgcctctccgctccctctggctctggagttgggggcccctgtggggctctgaagtccgcctgagacttgggtcaagagtcaaactgtcgccccccgctcctcccccaaaatccggtgagcggtaaggaaagtgatgccaagtcttcgaagcctcagtgacaaacgcatagcaagaacacatccactccagaggtgtttattttttatttttatttaaaaaggggtacttttcgacatttatttttaagaagtgggtgctgttatttttgtccctacgcaggcaagcctccattttaagcgaagcagtaactggttaagctggaattgtatacaggcccaggacttgaacgaggatcctaccagaggtcatttagtccatcctcctgcctccaggcaaatttaccttcctcccaccctcaaaattaagttgctcggtctgcttttaacgatctctggggaagaagggtcttttatttgtttctagtacttcagtcaagaataggttttacttttcatgtggaattgactctgaaacttaagcataatcttgggacagtcgggatgattagagaagttttactttactaaatataattaaatgtggcaagggtctttctttagacggttagttaacaaatcacgtttagtgtttatgaagtaccctggaaaattactttattctctctgggattttggctaattgtttgataagcaattttacattatctaaaatacgtgttacatatttatttctctttttatgtaaagtatgtttctacacacatatatatggagacacacatttgcccttttctaaaggggactgtattttctatacttttttagtgcgatgaggcaaatagtacttcaaaatccctgcccaggtagcttaaactatttgcattgtcttgattattttttagtctaaatgaaaatcctctctttcagataccttctcgaaacaaaagattttcctacctgcttatacttggtaaccgagggaattactaagacttcttgctcatttctgagtattgtctttatatcctgacactatgaatgctacttggatgcctcttaaggtaagatgtgttattttttcattaccagcctcattttattcatttttctttagaattgggaatattgtagtttttgaatttgctattcttcacttcctttacctgccatttctcttgcctcttgtgtttgcttcctaggattgattggctatattttactttgtatctctactgttctttgattatcggtgtgaatgttttaatgaagttctcaaattaacttccattataatgaaaggcagtgatctttttaactttaaattatggcaacttacatagttgtaaaattatgttccggtcttaggatgggttggcaattcaaacatctaggtccacttttcaaacaggtactttagagtcataggtactagggtgtgtcccactcttgcaaatcagtagctgattcatgtgttacaaaagatgtgtcattaaccatttgtttactctgaaacttcatatagtatattagggcattctaagacctgctggtttacacgtatgactctttcagagtcctcctgctgcaccccagtcctttgtgtgacatttcatactatttttctcagcaggtagcacttacaccaagttttatttcacagggtaaacctcatttggacagtgtggacagatgacctttagatgaaaaagctcccattgatgtggttctccagtctctttggctcctctaatctcttgtacatagatggccaaagaactctccattaggactaagcaaagggcagagcttaagacttaagtaggtggcttctttgattttcttgtgactaaaaatacattaaaaaaaaaattaaataaaaacaaacagaaaagacgtaaggaggggatgggaggaaggacagagaaggataaggagtcttggaaaccctccaccagcttcgcctttcttcagagtaggatactagcttagttaagattgttgggtgctaatctgctctgtggacttccagattgatgcagaggagaaatcagacaatagtgcagtgtgtgtaacctaaatatctggacttgtgggaaatcttaggtcatgtaggctgagttctcatcttcatttatgtttcagctgctattgctggataagagtgcttatattaatatacaggaagccaaagtgacacagtttttccagcattctccctgtagagttggaggggttgcatggggaatgcaaccagaagttctgaacccgttaagaatcagaggacctgtgtaagagtgtttcgacttagcaagtgttgagcaccagtgttggtggcctctgtcctctttaggaagcaggcaaggggattgagatcaatacattggatttcattttatagtttcctaggttttaacgaatgtatttggtacacaaagccctacttttaaagatatttccagtgtttaaggttttacctctaaatctctctgaacctgggttgtaatacagtaacctcagaagttctactagaggtctctggcatggcaggaatagagaaaggaaatcagctccatatcgtgagttaccacctgttactacttaagaatgcagttaggtggttgccttaatattatgttccttaccaatcctttgctcagtgggaaacatcttctaagtgtaaaccaattttggggggtaatgttttcttcctatttttattacttagaaaccttaaaaattacagtgttcgtctggtcagaaaaaaaggtcctttttgcggggaggatagcattgagtttgtgggctggaaaataaaagtggggagagggaactttattctctttttcattggtgaatatccttaaaacatttctaagatgtagtttcagattggagctacttaatttaagtaaaaagaaatgataggttaattaaagtgcatattttggagcccaaatgtttattttatatagatcttatattttgtttccaattatcttattgtagaatgaactctgtcgttctgtcaggcattgcgtaaatgttagactgagtatgtgcttgtttccatgcgtatagaaaatagcgtcacactcactcagtcttcacaaatgaaaatgccagaggaggcaagtaacaaggaagaataactccaagccaaaactcctcaatttaaggcactctcgttaattagaagttctcatggaaattattatttatccctttttctctgtgttaggggtctgtacctttttaaagcctgaatatttctagccacgactaagcaatgtcagtgatgttactagggtctagttgtcagggttagggctaaggagtgggtgagatgggagaggaatagggaaaggaaggagaattgagtgagtcggagaaaagagtgaaatgaagatgaggaggagagaaaagatacagggtctttagtgtgtagcatggagccatcatcagttgtttcaggtagttcttagggctgctggatgccttgtgtgctagactgaactatggtgaaatgaagtaaaaactgttcttgacaagcaaaacgagagaattaaaacataatttaatatgatatagaaagatctgcaaggcagacagttaagtgatgaaagcaagatgcagaacagtatgtatgatttgataccctttgtgttttttggaaaaaaaaaaacaggagaaaaagataatttgcattggtgtatgtatgcaaaaaaaaaaaaaaaagatctttagggctgggcatggtggctcacacgtgtaatcccagcactttgggagtccaaggtgggtggattacctgaggtcaggagtctgagaccagcctggccaatatggtgaaaccccgtctctactgaaaatataaaaactagctggggcatggtggcacacacctgtaatcccagctacttgggaggctgaggcaggagaattgcttgagcccgggagacggagcttgcagtgagctgagatcacgccgctgtcctccagcctggctgaccaagcgagactctgtctcaaacaacagcaacaacacaaacctttagaagaataaataagaaaatggtggcactggttacctgttaggtctaggaattgttcaggtagaggacagagtaggaaggagacttctcattgcattatatctttttacactttctgatgtttgtatcagattttaaaaattaaatagaaaattgaaaattttagctgggcgcagtggctcacgcctgtaatcccagcactttgggaggccgaggcgggcggatcatgaggtcaggagatcgagaccatcctggctaacacggtgaaaccccgtctctactaaaaatacaaaaaaatagctgggcgtggtggcaggcgcctgtagttgcagctacttgggaggctgaggcaggagaatggcgtgaacccgggaggcggagtttacagtgagccgagatcgtgccactgcactccagtctgggcgacagagggagactccgtctcaaaaaaaaaaaaaaattttaaagaacagcatctcaatccttccttttcttctctttctgtgtctggaagtcagagaaatggcaagggttctaactgagagaatagtttttttgtttttgtttttgtttttttgagacggagcctcactctgtcacctaggctagagtgcagtggcgcaatctcggctcactgcaaactgtgcctcctgggttcatgtcattctcctgcctcagcctcccgagtagctgggaccacaggcgcccgccaccacgcccggctaattttttgtatttttagtagagacggagtttcaccgtgttagccaggatggtctcgatctcctgacctcatgatccgcccaactcggcctcccaaagtgctgggattacaggcgtgggccaccgtgcccagccgagagaatagttcttgaacagtggttgaggggatacacacgcaaaagggcccataatctaggacatgtgttctcttgggatcttcaagaattttgaatttatagatgtatatttctagtattgaactgcaaagtcaggcattaaaaaatttaacttggccagacgcgatggctcacgcctgtaatcctagcactttaggaggctgaacaggcagatcgctggagcacacgagtttgagaacagcctgggcaacatggcaaaaccccatctctactaaaaatacaaaagaaaattagccaggcatggtggtgtgcacctgtagttgcagctacttgagaggcctaggtgggaggatggctcgagcctgggaggtggaggttgcagtgaactgtgattgcgcccctgcagtccagcctgggtgatagagccagaccttgtctcttgtctcattaaagaaaaaaaaaaaattaacttgttcttaaagttttagtaaaaacaggttttcattgtatatccccttaagttagcaattagatataatctcagcattcttcttcctttttttttttttatgagacaagagtctcgctttgttgtccaggtgatcttggctcactgcaacctccacttcctgggttcaagtgattctcctgcctcagcctcccaagtagctgggattacaggcacctgtcaccatggccagctaattttttttttatttttagtagagatggggtttcaccagcttggccaggctggtcttaaactcctgacctcaggtgatccacccgcctcggcctcccaaagtgctgggattacaggcatgagccaccgtgcccggcctaatctcagcactcttaaccgtgtgactttgggcgattttcttaatctctctgagattcaggttcctccttcatactggaaataataacacttacttcagaggacttttgtattatatctgtaaaggacatagggcagtgtttggttcagtggactactactgttcttattgtaattactaattttttttttttttgagatggagtcttgctgtgtcgcccaggctggagttcagtggcacgatctcggctcactgcaacctgtgtctcctgagttcaagcaattctcctgcctcagcctctcaagtagctgggattacaggcgcatgccagcatgcccggcttatttttctatttttagtagagacggggtttcactatgttggccaggctggtctcaaactcctggcctcaagtgatccacccgccttggcctcccaaagtgctgggattacaggcgtgagccaccacgccagctcttattgtaattactgttaataatagctcctcatacactagtggtgagagagagggctctggctatgtgatactgggtaagctcattaacctcttagaaccttggtgtccacactgtaaaaagggtataatgatagtacctagatcctagagtggactttataaggattaaatgagtttattcacgcagagtgtttagaacagcacctggtaggtacttagtaaacctgagctgcgaattttcttatgacatctgtttgctaaggctgctgccacagagtgacatatgctgagtggcttaaataacagaaatttattgtctccctgttctggaggctagaaatctaagggcagaggcatgctttctctgaagcaactgggacaggatctgtttcaagcctctcttctagcttctggtggcagcataactccagtccttatgtagagttctccctgtgtgtatttcttttgtttttttagacagagtcttgctctgttgcccaggctggagtgcagtggcataatatcggttcactgcaacctctgcctctcaggttcaggtgattctccttccttagcctcctaagtagctgggattacagtcacgtgtcaccatgcccaggtaattttttgtattttttgtagaaacagggtttcaccatgttgcccaggccggtcttgaactcctgacctcaggtgatctgcctgccttggcctcccaaagtgctgggattacaggcatgagccacagcacccagcctaaattttgtattttttgtagagacagggctgcaccttgttgcccaggctggtctcaaactcctgaccttaagtgatctgcccacctcagcctcccaaagtgctgggattacaggcgtgagccacggcgcccagcctccctgtgtgtatttctttgtgtccacaatttccccttttttataaggacaagtcatattgggattagagtcctctctgatgacctcattttaactttatgacctctttgaagatcctatctctttttttttttttagagtctctctttgttgcccaggctggagtacagtggggtgatctcagcttactgcaacctcctcctcctaggttcaagtgattcttctgccttagccttccaagtagctggagttacaggtgctcgccaccgtgcctagctaatttttacatttttggtagagatggggtttcaccacattggccaggctggtctcgaactcctgacctcaagtggtccacccacctcggcctcttaaagtgctgagattgcaggcgtgagccactgcacctggtctgaagatcccgtctctaagatcacattctgaggtactgaatgttaggagtactacatatctctttttttttttttttttttttgagacagggtctccctttgtcattcaggctggagtgcagtggcacttggatcactgcaacctccagccccctaacccctggactcaagtaatcctcccacctcagcttcctgagtagctgggactacaggtgcacactaccacatctggctatttttaaatatttttagtagagatggggtcttgccatgttgcccaggctgatattgaactcctgagctcaagcgatcctgtggccttggcctcccaaagtgctaggattacaggaatgcgccactgtgcccaggcccctggagtactacatatctcttttggggaacacaattcagcccagaacaggtgtatatcatttatcatgggtactagaccctcgacacctacacataggaaatgaaaattttggtgcaaattgatagcatgacttaaagaagtagattatttatttagcttctcatgtatttatctttaacaagatttttgttttatctttgaaacttttttttttttttttttgagacggagtcttgctcttttgcccaggctggagtgcagtggcgtgatctcggctcactgcaacctccgtctcctgggttcaagcaattctcctgcctcagtttccccagtagctgggattacaggtgcccgccaccacatctggctaatttttgtagttttagtagagatgggtttcaccatgttggccaggctggtctcgaactcctgatctcaggtgatccacctgcctcggcctcccaaagtgtgtgagtcaccaagtctggcccatactcttggttttctttgcagacttttttcctcttttgctcctaaaaacattagtatttgccttcccttgacccttcttcctctcaccctgtgcagtttatgaggaatgccttagataaacttgtgcctcacttgccgtctatatgccgatgatttgcaaatgtgtgtttttccagctctgactagttttctgatctccaatcccatatacacagttgcttcctggacatctctacttggatgtcctatgggcattttattttatttttttattattattattactattgagacggagtctcgctctatcccccaggctggagtgcagtggcacggtctcggctcacggcagcctctgcctcccaggttccagcgactctcttgcctcagcctccgggtagctgggattacaggtgtgcgccaccacgtccggccagtttttgtatttttagtagagatggggtttcaccatgttggccaggctgggcttgaactcctgacctcaggtgatccacctgcctcagcctcccaaagtgctgggattacaggcgtgagccactgcatctggccatcttatgggcattttaaaatgatcttatccacttccccagtccaacctcttcctatcttcgtatcttagtgagcggtagtgtcacccagccagtcactcaaatcagggatttgagaggcctctgggttccttcttgtgccattctagtcaccacattcttgagatcctagctcataatattttcctagtcatcctacttctcctttttgagtccagaccttcatcgcccttttggctgcgtgaccttctgttgtcttgtaatcattctccttgactgctttctctcttccaagtcgctgccaacatgatccttgtaaaatgcatgttcaagcgtatgatcatatccctccctcttccaccatggctcaactagctttgaaggtagagttgaaatgttttgccagatcatctctccacttcttcctgagcatcctgtacgcagtagtacagatagcttgtgcccagttccttctgtgaaccctgttgttctttgcctctgggtcttcacacaagcagttacctctgcttaagatggactctaccctgttctggaaacttactccccctagtctttaataacagtagtggctggtccaagtatattggtgtttactattaattgatcacagccagttacagatttctttgttccttctccactcccactgcttcacttgattagccttaaaacaaaataacagtagtgataatagtaataacagtagctgacactgagtgcttcctctggacccaggtattatcactttatgatcagagttcataaagaaatacaaatgaccaagaagcatatgagaaacatttttattctgataaataatcaaaggaatgcagattaaatgacatactattttttacctatcagatttgcagttgactgtgctgtcaaaggtggtaaggggacaatctctgaaactgttagtgtgtgtgcatgtgagtgtgcatatgcagacctagcacttctattgtactgattgctagtttgctccactttgaacccagctagtgtctaggttctttgagagtgaggacttgctcttgtcttttatcctcactgcttgctgtttttgtttcttttttttttgagacggaatttcgctctttgttgcccaggctggagcgcaacggcgcgatctcggctcactgcaacctctgcctcccaggttgaagtgattctcctgcctcagcctcccaaatagctgggattacaggtgcctgccaccacgcccagctaatttttgtatttttagtagagacagggtgtcaccatgttggtcaggctggttgcgaactcctgacctcaggtgatccacccccctcagcctcccaaagtgctggcattacaggcgtgagccaccatacccggccatcactgcttgctcttgatggcacttagtaaatgagtgttaaagactgtattgctggacttgggacatgcatctttaggagggtatcagtggaaaagctgagagtcacatgcatttgccagtcttggccttactctttggatctattggtcccagtctgataagtgcaagcaactttggaataaggattgccaagaattaagatttttaatactctttctttgaatgctaaagggcaaaagtgtttttgttgtttttgcttttggaaaaagagaactagtttgctgaccacccagtgtcatttggtaatttagagtgttttcacatagttaaagtatagggaaatgaatatttaggtctgtgatgtttatatgtgccaggtagtatatttggcagggaattgatttttagaattgtttgtgacattagttcttgcatattagtttttttttttttaaatggagtctcactctgttgcccaggctggagtgcagtggcgcagtctcggctcactgcaacctccacctcctgggttcaagcaatcctcgttcctcagcctcctgagtatctcggactacaggcacgtgccaccacacccggctgattgttatatttttagtagagacagggtttcaccatgttggccaggctggtcttgaactcctgacctcaggtgatccacccacctcggcctccacaaagtactgggattacaggtgtgagccactgcaccccgcctagttcctgcacattagaaaacgtttgggccgggcacggtggctcacgcctgtaatcccagcactttgggaggccgaggcgggcccatcatgaggtcaggagatcaagaccatcctggctaacatggtgaaaccccgtctctactaaaaaaaaaaaaaaaaaaaaaattagccgggcgtggtgttgggtgcctgtagtcccagctactcgggaggctgtggcaggagaatggtgtgaacccagcaggcggagcttgcagtgagctgagatcacgccactactctccagcctgggccacagagcgagactccgtctcaaaaaacaacaacaacaacaacaacaacaaaaaacaaataaaacgcttgtcccccttgccttctccatcacagctctgttaagtatgagtttagatacacagtattttcttttttattaccgtgtataatttgtatttgtagcagcagcccagaagacaggcaagcgtatggttctagctcacttttttttactgggcacttgatggtggtggtaatttatctgtcagcagggggagctgcagttgctgatatttaaatgattccatctcagctggttttccacagaaagtttgtcggccaagagaaagaaaagttttgctggcaaagaacatgatcagagttcataaggaagaaatacaaatgaccaagaagcatatgagaaacatttttatcctgataagtaatcaaaggaatgcagattaaatgacatactctttttttaacctatcagatttacagttgactgtgctgtcgaaggtggtgaggggacaatctctgaaactgctagtggagtgtgcattgggcctagtttttttgaaagatattttggcaacatatattggcaaaattaaaaacgttctttaattcagtaattgcacatctaggaatttatcctaaaggggaaaaattaagatacatagaaagatttgtgaacaaagatgttcattgtaacattattcatattagtgagaattgagaataaacctaaatgagcagcaagatttataggaaaataaatcatggtatatttaaggatggacatttacaaccatggaatagtatttgaaagaatttttctggccgggtgcggtggctcatgcccgtaattccagcacttcaggaggccgaggtgggcggattatgaggtcaggagatcgagaccatcctggccaacatggtgaaaccccatctctactaaaaatacaaaaattagctgggcgtggtggcacgtgcctgaaatcccagctactcaggaggctgaggcaggagaattgcttggaccagggagttggaggttgcagtgagctgagatggtgccactgcactccagcctgttgacagagcaagtctctgtctaaaaaaaaaaaaagaatttttaatgtcttaggatgttgagtaaatgataaatgaaaaattcagggtgcagagctatataaggagcattctaagtgtataaagataaggaatgtatatatgttctagtataatatgtatgtatatattacacacacatacatactgaggtaaaagaatggaaggaagtctataccaaccagcctccttgagtctgtctgtccggggtctgtccaaccaattgttctgtctaaattggcaccaagtgatgttttcaggtgaaacattgttatctgttaagatgttaacctcagaaatttagggcctcacgtctgatagcacttctatcctgtaggacctgaatggacctaatatacctacatttatccgagcacttgaatctatttttaacttgtagattgtggtaacacaatccacaagtttcttttatctgttatataaagaaatacttttcaagcataaaaggtgaataaattagtatttaccatattgatacgttttctgattttgatcacattgcccctttgctttcatgtttctcaactgaagatgcttgactttttaatttaatctccagtgaaacctccttccaggatctttgtcagcattgctttccctttctggatttatgataactactcagaactgcattttagttataactacactgtgatttggtagaaggataagaaaatatgttctatttacagcaagcttgtccgacccatggcccacaggctgcatgcggcccaggacagctttgaatgtggcccaacacaaatctgtaaactttcttaaaacattatgagattttttttaagattttcttttttagctcatcagctattgttactttagtgtattttatgtgtggcccaagacagctcttcttccagtgtggctcagggaagccaaacgattgggtacccttgatttacagttttttcctaataggatttggtcctccctccctccctttttttttttttttttttgcatagaacatcacattgtctttagggaatattctataattattcaaaaattccttttttgacttgaaggcatgagtcttttaagtatagcttagattttttttcctgtaaatgccttacttttcatttgtccatgctgtaacatacctgccatttcctcgcatgtaattttttaacactcatatctcagtgggctcttagaggtaatccaaggtaagaaccacctttttagttaggtctgatggttagaaagcttgagttgaagcgtgcccttctggaattgccactttgggcccaattttgtctacacgggaactgcttagagcaagtctggtttgtcttctgctagataacccttcacatatttagacagcttttatacttgccaaagcattctctaagctgaatataaatcttagtttttgcaaatgtttctcatttaatatatttagaaaccctttccatcactccgttcccttatttttccaactcgtgtggtatttcattattaggaatctcatcatcccatctgcaaaatggggaattctctgtatattttttgtacaatatattaaaatgttaaatatagcatttctaaaaaaattttcaatcttctgtttttacttcttcatttggggaagtacctcagcatctacctataattttctgtgtctcagttatgtccagtctacagtaaatgttctcatcctgtggccactcaggtcttttttttttttttttttttttttttttttgagacagagtctcactctgttgcccaggctggagtgcagtggtgcgatctcggctcactacaacctccgcctcccgggttcaagcgtttctcctgcctcagcctcccgagtagctatgactacaggtgctcaccaccacacccagctaatttttgtatttttagtagagttggggtttcaccatgttggctaggatggtctcgatctcctgacctcatgatccacccgcctcagcctcccaaagtgctgggattacaggcatgagccaccgtcacccagccacacatatttattttctcagagaatttgggtgaactggtgtggtgtgatgtccacttttagaatccatgttgtcttttcctcagaaggttattcatgctgatatgtcttctgagcccatctttattagagatttgctagtttgggcagtttgaagttgcagcctacttgagtagatggaagttactttgatgacagcatttttttgttcgttttggttcagcacatacttattgagtacctaatatgtcagaagttgagcaaggaaaatattgataaaggaaaagtggattctatcctcctggcatttagagaaggtcactcatatgaccgtcagctaatatgttctgtcctgcagtttaataatttatacttaaatgcctttaaaacacagagaaggggctggtcgtggtggctcacacctgaaatcccagcactttgggaggccgagttgggtgaatcacttgaggtcaggagtttgagaacagcctgggtaacatagtgaaaccctgtctctactaaaaatacaaaaatcagccaaatgtggtggcacatgcctgtaatcccagctacttgggaggctgaggtgggagaatggcttgaacccgggagacagaggttgcagtgagtcgagatggtgccactgcactccagcctgggcaacagagtgagactctgtctcaaaaaaacaacaacaaaaaacccatggagactattttgggtcttcatgactacctgacatctgacatatcagtttgaggaatttagtatatttaatgatgcatttgattcactattagagatttgtatgcttattaagagtaatttagatagcttttcccctctaccttccccagtaaatatcgaagcaaataagaattatataatatcagctgtcttgctttttatcaatcccacttatcaagtgacccatccagttttatttggcatcgagctttttatgtatttaaactgtctcttaggtgactttgcattttcttttttttttgagatggagttttgctcttgtcactcaggctggagtgcaatcggcgcaatcttggctcactgcaacctccgactcccgggttcaagcaattctcctgcctcagcctcccaagcagctgagactgcaggcatgcgccatcacgcctggctaatttctgtagtttttggtttttttttagttgagataggatttcaccatgttggccaggctggtctcgaactcctgacctcaaatgatccgccccactcggcctcccaaagtgctgggattacaggcgtgagccactgcgcccgggctgcatcattttgttgtaaggttttttttttttttttgagacggagtcttgctgtgtcgcccaggctggagtgcagttgcaggatctcggcttcctgcaacctccgcctccaggttcctgcaccctctgtctccggtgggctgagctgaggtgggacagactgacgcggagaggaagggaagccacctggcctgaagatcctgtctctaagatcaggttctgaggtgctgaatgttaggagtactacatatctttttttttttttttttttttgagacagggtctccctctgtcatccaggctagagtgcagtggcacttggatcactgcaacctccagccccctaaaccccaggctcaagcaatcctcccatctcagcttcccgggtagctgggactacaggtgtgcactgccacacctggctatttttttatatttttagtagagccggggtcttgccatgttgcccaggctgatattgaattcctgagctcaagcgatgctgtggccttgaccttccaaagtgctgggattacaggcatgtgccactgtgcccagccccttggagtactatatatctcttttggggaacaaaagtcagcccagaacaggtgtatgtcatttatcatgggtacaagaccctcaacacctacacataggaaatgaaaattttggtgcaaattgatagcatgacttgaagaagtagattatttctttagcatctcgtgtatttatctttaacaagatttttgttttatctttgaaactttttttttttttgagacggatttttgcctttcacccaggttggagtgcagtggtgtgatcttggctcactgtaacctccgcctcctaggttcaagtgattctcctgcctcagcttccccagtagctggtattacaggcgcctaccatcacacctggctaatttttgtctttttagtagagacggggtttcaccatgttggccaggctggtctcaaactcttgacatcaggtgatccacccgcctcagcctcccaaagtgctgggattaaaggcatgagccactgtacctggcctttttgtattttttgtagagatggggttttaccatgttgcccaggctggtctcaaactcctgagctcaagcagtccccgcaccttggcctcccaaagtgttgggattacaggcctgatcccctgtgctcaacctgatgagatcttttcatgtgcttattggccattcatatatcttctttggagaaatgtctatttaaattctctgcacattttaattttatttttatacactattgttttttaggctaggtcttgctctgtcactctggctagagtgcagtggccaatcgcagttttcttttctttttttttttttttggagatggagtcttgctctgtcacccaggctggagttcagtggcactatcttggctcactgcaatctctgcctcctgggttcaagtgattctctgcctcagcctcccaagtagctgggattagaggcacccaccaccacgcccagctaatttttgtatttttagtagagatggggtttcaccatcttggccaggttggtcttgaactcctgacctcatgatccacccgccttggactcccaaagtgctaggattacaggcgtgagccaccgcacccggcccaatcatagtttctggaacttcaaactcctggactcaagggttccttctgcctcaagctcctgagtagctaggactacaggtgtgtgccaccatgcctggctaattgtttttttttattattattaatttattttgtagagacagggtcttgctatattgctctggcaggtctcagaatccttgcctcaagggatcctctccttctggtgtgagccaccatgctcagcctttgcccattttaaaattggattctctttttattgttgagttgtaagagttctttaaatatactagatacaaatcccttgtgagatacatgatttgcaaatattttctcccatctatgggttgtgttttcaatttcttgatggtgtcctttaatgtacaaaatgttataattctgatgaagccaaatttacttgttttttcctttgttgcatgtggttttgatgtcaggccaccaaatgaaatgaagattagctttgttttcttctaggaattttattgttttagctgttacatttaggtctataatccgtgtttaaatttaattagaattaatttttgtgtatggtgtgagatatagtggtccagcttcattctactgcatgtgaatattcagttgtcccagcatggtttgttgaaaagaccattgtttgtttcttgtagagatgggggtcttgctttgttgccctggctagtctcaaactcctggcctcaagcaatcctcctgtctcagcctccccaaatgctgggattataggtgtcagctacagcacttggcttaaaaagaccattctttcctccactgaattgtcttggcatttttgtcataaaatcaattgactgtcagtgtaaaggtttatttctgaacccacacttatattccattgatctgtatgtttatccttatgccactaccacactgtcttgatttccatagctttgaattatgttttcaaatcaggaagtgtgagtcccccaactttgtttttcctattcaaatttcttttgggtatgctgggatcacattgattctgtagatcaatttagggaatattgccattttaacagagttgtatcttctgatccattctcatccatgaacatgggatatctttccttttttttttttttttttttttgggggacacagtcttgttctgtcatccaggctgcagtgaagtacagtaatgcaatcatggctcactgcagctgtaacctactaggctcaagtgatcttccctcctcagccccccaagcagctaggattacaggtgcatgccaccacatctagctcatttttgtatttttgtagagatgagttcttgccatgttgcctagtctgatcctgaacttctgcgctcaagcagcccacccacttcagtctaccaaagtgctgggattacaggtgtgagccatcacacctggcctttccatttagttaggatttctgtaacttcttttgtaatttttatatatctcagagtataagattgtcactgcttttgttaaatttatttctaagtcttttttttttttttttttgagacagtgtctcattctgtcacctaggctaaagtacagtggtgtgatctcggctcattgcaacctccgcctcctgggttcaagtgattccactgcctcagcctcctgagtagctgggattacaggcacctgccaccacacccaactaatttttatattttagtagagacggggtttcaccacgttggctaggctagtcttgaactcctgacctcaagtgatccgcctgcctcggcctcccaaagtgctgggattacaggtgtgagccatcgtgcttggctttctaagtcttttttttttggcggggggatgctattgtaagtggaatttttaaaaacttttcatgttcagattgcttattgcttgtgtatagaaatacgattactacttgtatattgagcttgtatcctgtaactgtgttggatgtgtttattggctctaatagtttatttgtgggattttcttaggattttctatatacaagattatatcatctgcaaataaaggtagttttccttcttttttttaagcctgagtgatttttatttctttttcttgcctatttgccctggccataaccttcagtgcagtgttaaacagagtggtaagagtggatatccttgttttgttcttgacctgagggagaaagcattcaggctttctccattaagtatgattttagctatggggtttttgtaggtattctttttttcccccataggtattttttattagattgaagatgttttcttcaatttctactttgttgagtgtttttatcatgaaagcatgttggattttgttaagtgctttttctgcatctattcaaatgatcatgtggtttgtatcctttattaatatggtgtattacattaattgattttcagaagttaagccaaccttgaatccctgggattaagtcatacttagcaatggtgtataagccttttaatatgttgctggattcattttgctttgttgaggacttttacatctgtattcataagatatattggtctgtagttgtcttgtgatatctatgtctggttttggcatcagagtaataatggctttattgaatgagttgagatgtgttcttggcttcatcttggactaattttggttgaactttgaacattcatttagcaattgtaaattctaattgcctaattactgaatgaagataataattaaagatataactgtttgtttttttgagatagagtcttgctctgttacccaggctggagtgcagtggtgtgatctccgctcactgcaacctccacttcccaggttcaaatgattcttatgcctcagcctcccaagtagctaggattacaggcccctgccaccacactcagctaatttttgtttttagtagagactaaagatacaaaaattttatcatgttggccaggctggtctcgaactcctgacctcaagtgatcctcccaactcagcctcctcaagtgctgggattacaggtgtgagccaccacacccggcctttttgtttatgtttgttttagagatagggtcttcctatgttgcctaggctggagtacagtggcctatggtttcaagcactcctcctgtctcagcctcccaagtagctgggactagaggcacatggcacacccagcttggttgccttcccctgctcccctacccgtgagacagggtcttgctatttgtccagactagtctagaactcctaggctcaagtagtctctccacctcagcctcccaagtagctaggattacaggcacatgccaccacacttggtagtcaactatttaaaaaacatctattatttaacattcagggtagaggttccaagtatagaactttagatccttactgcctgcttggttccctggattttttctcctagttttatttggggtacttactttgttatttcattttggttatgccataaataacacccaattttagcattcctgggatgatttaggcaagcttcagaaaagagtccagaagaaaatggaattggaagcataaagccactaaaattttttcattgttctctgatcattttttagctttggattttttgatcatttaacgtatcaatgagtagaaaggatttttcttgactaccacatagcttataaagtgaccgagtattctttccttagagattctacagtgtttaacatccactggtactcagtatgtttatgaatgaatatgtattaatggtagggcttttatagggtcttattttactgaaaattgaagataatcattcacatttggattacaagtgtttgtgttatgttataaacatttaatgccgtagcccaaatattaacaagcatggtcatattttggtattgccacggtaggtattctgggaagtgtgagtagttgttttttcctaccctctgtgctgaaggatttctttctttttttttgagacggagtctgctctgtcgttcaggctggagtgcagtggcgcgatctcagctcactgacactgcaacctctacctcccgctgggttcaagcaattctcctgcttcagcctcccgagtagctgggactacaggcgcatgccaccacgcctggctaattttttgtattttagtagagacgggttttcaccatgttgcccaggctggtctcgaactcctgagttctagcaaaccactggcctcggcctcccaaagtgctagtattagagatgtgagccaccacgtctggcctgaaggacttcttataccaaagaagatacagtttcatttaactattttattttattttttctgatgctggttaaagttggttcatttgggacacatttcattagataaaattgtgtttaaatgtgatagtgagaatttggaatatggtggaaaatattgaatattatattctataatttttgtcagtctaattcagaaacaaaaaagattgcagttgagaaaatcatacatgatttctttgtaaatgagttacagagataagacaggacctttagcatttcctgaattccagtcatgttctcggtaacttatggtctcttttataatattgtacccatgacaatttatacgttagatttcaggttttatcttctgcctggaaggattacattcaggggttttagccatgcatatttatctataaatggtctaaaccagtacctctttatctttccttaaagtacttttcagggtctagggctgtttggagctgtttgttacaagcaggacatatctctctgaggactccttttctatcttgaaacagtgagaattctgccttttgctctgtatacattgaatatcccttatccgaaatgcttgggaccagaagttttttggatttcagatttttcagattttgggatgtttgcatgtacataatgtactatcttggagatgggatccaaatctaaacatgaaattctatgtttcatgtacacattatgcacatagcctgaagataatttcttttttttacctttttctttaagagatgatgtctcatactgttgcccaggctggagtgcagtaatgtgatcctagctcacagcagcctagaactcctgggctcaagtcattctcctgcctcagcctcccaggtagctggtactaactggtacagatgcacggtgccaagcccagctaatttttttgtttgtttgagatggggtctgattctgttactcaggttggagtgcagtagcgccatctctgctcactgtagcctccaccttccaggctcaagtgattctcccaccttggcttcctgtgtagctgggactacaggtgcatgccaccatgcctggctaattttttgtgtttttggtagagataggttttgctacattgcccaggccggtcttgaactccagagctcaagtgattcacctgccatggctttccagtgttgggattacaggcctgagccactgtacctggacttaatttttttttttttttcagagatagggtctcactatgttgcccaggctggttttgaactccagggctcaaatgatcctcccatcttggtctcccaaagtgttaggattacaggcatgagctaccacaaccgaccagttttatacaaaatttaaaataattttgttcttgaaataaacagtgtttctgatggttcagagaaccatcagaagcaaaggtgtcacgtgtggaattttccatttgaggtgtcatgttggcactcaaaaagtttcagattttggagggttttgaattttcagattagggatggtcaacctgtaatatatttgtgtttattttaacaaaagtatatctgattttactataatccttgattaaattgatactccaaaaaagttgctcctgcatatattcagtggctttggttactccccgtttgtagctgtatgttcctgagtgtacatagaaacaagttcaagaatccaagaattagtgggttaaaaataatgttctaggctgggcgtggtggctcacgcctgtaatcccagtactttgggaggctgagatgggcggatcacctgaggtcaggattttgagaccagcctgaccaacatggcgaaactccgtctctactaaaaatacaaagattagccgggcatggtggtacgcgcctgtagtcccacctacttgggcagctgaggtaggagaatcgcttgaacccaggaggtggaggttgcggtgagcccagattttgccatgcactccagcctggcagcctgggcagcagagtgagactgtgtctcaaaaaaaaaaaaagtaattccctttccaagaatggtatgctgcttcattggaggaaacaggtctgccatcttccaaagtccctaggtttgccatgccatcagaacaagattttacaagttgcatcataacttagaatcagcaactgacgtaaaaagaaaaatatatatatatatatattttgagacagagtttcgctctgtcgcccaggctggagtgcactggcgtgatctccgctcgctgcaagctccgcctcccaggttcatgccattctgctgcctcagcctcccgagtagctgggactacgggtgccccccaccatgcccagctaattttttgtatttttagtagagacggagtttcaccacgttggccaggatggtctcgatctccggatctcgtgatctgcccaccttggcctcccaaagtgctgggattacaggcatgagctaccgcacccagcctgtaaagatattttttaaggtgtgttttgccttgtacacctgctgcctccttttctctttgaacattttcccttctgactcacttttgtcaggccctccacaacttggctgctcacagctgccttgaagttctgcatatttacctttatgtttcctttggaaaagaactcaggtagtttcttggtacattttggccaaattctgacactcagctttattatctgataaaaagtttgggtcctgcgtagattgcttaatctgcaaaatcagtatattagaatactccttctatgtttggtcattgaacgttcacacattctagttatttgagaattttaaaatattctaaagttaaaaacattagaattaactaaaattcaccaaaataatcagggtgtgtgtgtgtgtgtgtgtgtgtgtgtaaactcattgaggaactttattaaaatgttcgtataaaatcctgcttaaactgcttgcactagaaatgagtgctggtagctgctattaaatccaccactgtggagaagaccaacaatcttgggtgttagattttaacaatagctgatggcctgagagaacctgacttgtttctttcagtgatataattgtattcagctgagctttaatgttgtcttctgaattatcctaaagtaaattatttctagacttactagtacatttaggtttaacctacaacagtattgttctcattactaacacagttaaattaggaggctgcctaataattagtttttcttttgtatgaattattgggtcagttctgtggtgagatggcaaaataatatctttatgtaaatcctgcagtttgtatcagtagtatgaggaggaaaatatcttgttaggttggattgaaatgaaggaatgctatgcattcttgtaatactttgccatttatgaaatgcttttgtttaatcttactgaaagtttgtttctactggattcagtcagtacataaaaatactgtatgatattttgaatcagctaaggcctccatttaatgaaaaaaaatcttgatttctgagctttgtagtcattgtaatcagtatgaggattttcttctacttgcatttggctaaatctttatacttgtgacactgtgaaataggtagtatggtttaggtttaatgcctttagcatgtttgcacatccagttcaccaattgagtagcactggtgaattagaagtgggaaaagtgagaattgaagactgagagaccctgattccagctttgacgctttggcaatctcttaactggcttctttctgttggcctcattttcacactaataaaatgtggcggctgaacatattccttctacatcctaaattttttgacttaaatttcttaactttggtttagttgactctggctatttaatatttagctggttaaatattaatgtgagaacatgcctcagtttcagcttaaagatgtttcttttataattttaatatgggtttttacataggtttatgtgttcatttctgtgatatctagaataaattcttgagcttaataggtactcactagatttttgttgaattaaatgtatttgaagtatttaatgtggcattagatttatgattgtaaataatcattctcagaatatgtttttagggagctaaaagtatttttatatatagtgttatctaagttcatgaatgaaaacattgtttgctagagtctagacagggattttgtttttgaaacagagtcccgctctgtcactcaggttggagtgcagtggtgcgatcttggctcactgcatcctccaccttgtgggttcaagcgattctcctgcctcagcctcccaagtagctaggactataggcatgtgccacaatgccaggctaatttttgtatttttagttgagacagggtttcaccatgttgcccaggctggtctcagactccaggcctcaggtgatccacttgcttcggtctcccaaagtgctagaattacaggtgtgagtcaccacatccaggctttttttttttttttttttttttttttaattaaagtaggtccaagtcctaagtagataggtgtttgaagtttgaattaggaaagaggtgctgatttttgcttcactcagattttaacctttaaagtttagaactgtggaaaatagcttcattcactaataataatagttaaacttaagaggtaggtggtattactatctccattttacagagcagaatacgtactttgcccaaagtaacacaaagaataagtgagggaggcaggattagaatcgggctacctaggtcctgtgtgcttaagtactacactctacctttttcatttattcagtcagttcttatgatgtgtctcttttgtgccaggccctgggctaggtcctaggtaagtaaccaaaaaaatgggcccctgtgcttttgaaactaaatggcctaggctttagaacttgtcctgagttaatatataataattgctttttcttaagtgcaaaaaaagttattcattgtccttttgagattagtttggacatacgaggtactgaatttgtgagattattctgtttaggaatttctggcttgtttagaaggtctgtggcagggaaggtagagagtgcctttttggaatacgtttattatctatagatgagttacagatcttaaattagaacaaccacagttcctgcctgcaagggctttcaggctggcttgaggtggcaagactggtatatgaaaacaaactcagaggaattacagacagcatttaaccaagggtaatgtagtgccaactctgtacattattggttctttttttgagacacagtctccttctgtcgcgtaggctggagtgcagtggtgtgatcttggctcactgcaacctctgccttccgggctcaagtgattctcatgcctcagcctcccgagtagctggaactacaggcgtgcaccaccatgcttggctactttttgtatttttagtagaggcggggtttcaccatgttggccaggctggtctcgaattcctggcctcaggtgatctgcctgccttggccttccagagtgctgggattacaggcatgagccaccacgcccagcctacattattgtcaagtgaagtgagtagacgataacagtggtgtggtggaatataagaggataacatgagttgtaggtggattggagagaggaattaacaaggaatggtggtaatgagggatggtcctctttttctaggtagagagaacacagacaaagatggatggatacagagctgtgtgtaagagggaacaccttttccttttttctttctttccttcctcccttcctttctttttctttttttggagacggggtgttgctctgttgcccaggctggtttgcagtggcgtgatcatggttcactgcagccttgacctcctgggctcaagtgatcctcctgcctgagcctctgagtagcttggactacaggtgtatgccaccacccccggctaaatttttttattatttattttttgaagagatgaagttttgctgttttccctgggctgttctcaaactcctgggctcaagcaatactctcacattggcctctcaaagtgctgggattataggtgtgagccaccatgcctggccatggaatgtcttttctgaggaagaaataataagattagttatataaaatactgtaatcataaagtaagatacaaatactaaaaaacattagaactcaatcattgttttttgacttcatttattatataaggaacctaactcaaattggcttaagcaattaataaatgtttattgttacattgttgtaatgtggctggaaatccagaagtcatacaaattgtcaggattggttgatacagtggcttaatgctatcaccaaggaccaactctctattccctttgatgttggtggcatcttcaggcttgctgcaaaggtgactgtagcagtttgaggtgtcactgtctgaggaagagggactgttttttcctccatcatttttaggattgaagaaccttttctcacagttctcttttggaggctgtccagggggcttctactcacatctcatggccattcctaaccaatcattggcaaagagaatgggttaaaactaatcagaatagagtggatattggagagtcaacatgactattccaagagtgatttgaaatatgttggtgtttttatttttttatcacttttcattttgagatggtctcgctctgttgcccaggttggactacaatggcatgatcatgactcactgcagccttgacctcccaggctcaagcaatcccctcagcttctggagtagctgggactgtaagcacatgctaccacacttggctaatttaaaattttgtttgtagagatagggtctcactctgttgcccaggctggtctctaactccggagctcaagtgatcctcccacctcaccctcccaaagtgctgggattacaggagtgagctgctgcaccaggcctttttctttaaatctttttttgtttgtttgttttattttgtatgtaggtgttttcaatcagccttttggacatccactattttttggggggaaatttaagaaaatttgtttctcttcataagatttttgtgtggtggctcatgcctgtaatgccagcactcgagtccaggagttcgagaccagcctgggcaacatagggagactctgtatctaccaaaacaaaaaggagtgaaaaaaataacagctgggcatggtggcatatgcctgtagtgccagctactcaagaggctgaggtaggatcgcctgagcctgggaggctgcagtgagtttgattgcaccactgcactctagcctgggcaaccgagcaggaccctgtcaaaaaaataaaagtacaagtggatgcctaataagaaagatgtctgattttagataagaatatacaacaggttgactgatttaagtgccataaaccctgtgaactcttgactcttgcactaagcaatgagagaaaggggaaactggaatttatagttcccccaaatacatggttttaaaaatgagcattttccagttttctcctaatccattagaaaaatatatttcatataatcttgcttatttggttgcctaattaaatctgacagttcagtcttaaaaatttggagcagcagtaagattattttgttatggtgtgtctgaatttaatatttaagtatacgctgcaaagggctttgccttatttggtatttttcattctgctaatttagatttcaggagcctcagattggggctctagttcgccatctgttggtccaatacccttctactgtattttgtggaattactatttatgtgtgtatgtgtgtacaataaaaaagtcaaagtttttccccagggttgtaaattaaaaatccaagactaaagacctcttttggatgtgtatacaaatattagtttattctttgtgtaatttgaccctatgactccaaactgcctgcctttggtatttgagaactatgactatgcttgagagtgtgattttaggagtacaaatggaaattcgcagaaacctaggtgcagatgttgcaggggcaggtgagttagtgtaactttgtgggaagactaaaaccgttctgtaacgactgtgagggtgttttttgataagcagaagtgacgtataatgccggatattggttctggtaagccacaaaaaagtgtgaagcattttgcgtcttcctttttggtagtagagcatacatacccttcttatctgccgaatttgatgatttaatgatttgaacgattttttcttcagtcatttaagccagttttgatgaatcctagattagtcttttaaatctcaagatactccactcatcttttggcaactttaaagggtggtagaattacactttgtgtgacactttgtattacattatgtttatgaattctttaagtctaggaaaggttccattattttaaaggtcctattttggggacaatataaagttctgtactgataaactggtcatgagaaatgataaggtgccaccactttaaaccaactctggtaacgaggtgggaagttggctttttgttgtgagacttgtgtttctttatggagttctttgttaaacttttagcatggcagtgaacttccttttggtggcggcaggaagcataaatactcattgtgtaatgccatttgcctgttttggcggatctgccaagccatgacacccaaaacaagacgcgtgtttcttcacgaaaactacagttcccagcgggcccggcgccggcggggccatcacttcccctctggctcccggctgtcccttcccgggctggcccggcgcgggccctggctggggcctgcgcagtgactacgtgcaccctccccaccccgcccaactctggtggctgcggagcgcggtgctggggctagtgcccagccgtgctgcagtatacggaggctggctgctagggacaaagggcgggcggcggaagccgcttcactggtcagggagctttctgcagggttagccttggaatagtgtggtgccgacggccttaccctctttactacacagtgcaaacagttcctcgctcacgtcctctcgctccgcggcgccggcccgccctgcccctcaactggcgagccgcaccgccggccccagcacggagggcatgtgacggcgtcagtgcctcaggttagactcacctcggccgcagcgagggctggcttccccctgccgcagtgctgcgtgccgtcgccgcacgtccggggcagctggggccgggcgccgcggcctccgcagatggaggtacaaaaacatcggccacggcgaggagccatgactgaggcggcggcggccgcgcctcctggcggcccgcgggggcggcgcggcgggcgccccctggcggcgcgccggggtggagcggcccttcgccgccgcagccgcagccggcggaggcgctgctgtccctcctccccgtgtccccggcgctcgcccgcttgctcgctcgctccattctccctccgcttcagattaaagggggggagggaaaaggagctcggccgccattttcccagtgccgccgccaccgccgccaccgctcgccgagccggcgggagaaccgagcaccgtagcgaagccgactcgtctcgccgcggcggcgcggggggcggctgaagcgcgctccccggctggaaagaggcggccgggggtggcggcctgggtgcgggttcgggctgcagacggcggtgcttgtttgtgcggggcgggggggcggtttcactctctgcccccgcccgcccgccctcccggccgggctgcggtctccagccgtgctcgggccccgtcggtgcggagcaaggccgggaaagggcccgaaagagaagaaaaagcagccgctccccgccgccgccttcccctccccctctgcctcgcccccccgcccggaaagtcagggcggctccgggcgtcggggggaggagagcggcgggcccgggccggagccgccgtcgcgcgcccccgcccgccgctggccctcggcgcccaggccggggggctgtttgcaaactgcgcccattttgtggggctgaatccgcccgggctacgctcctccatcacgtggtaggtgctgctgctgctcctctcctcctcctcctgctgccctttctccttctcctcgctctccctgtggctcccatttctctctctctttgttagttgtaactagaaaggcagggcagggtagaaaaatcccccggaactttaaatggcctctccgggcttccctgctgcgggtccgggctgggagtcgccccaagggcgggggtgtgcgggggcccttccccaggagctgccgcctcgttcgccagcttttcctttggcgttctatttaaaaaggcggcctgaagaacatgatttattcccgtaaaagaaccccccaaacaaactctggctctcgccttgaacttctcttgactgcaaaaggcctttctctgctcgaaacacacatcttggcgcgttgcacggtttgtatcacaactctgattgtttcatttattatttttgttgcctgtaaattcaggtcacttacgttttcagatgtagtctccctcaggcggactttttttttttttaaactaaagaggaagagggatttatttgcttttaagtgagttggaatcttaactgcctttttgggggcctgttttccggctgacggtcttttgattcttagcaaatagtttgttttccatacgataaacagcgctactcccgtgtcttacttaaaaatcctcgttttccaatgttggaatcccaatgtggatttatagagaaacgtgctacttaactattgcttactgattgctttaggggagaaggggtgacatgatggcgccactttaaattgctctctttccttttcctcggtcccccccacccccctttatcctggaggtcactggagcattttctgtgacttattaataaaactgtacttgagggtgttagaagcacaactcgtaggggctggagtttagtgctcctagggtcggcagaccgactgccgcggtccccaaagttccgagaaatctctcttcctccagcctcgcctccctcccctccattcacaatcctggtgttgccatctcctttgtcacgtggctagcaatcattgtgtttttttgtttgttttggggtgtgtgtttatatttttaaattgcagctcagaggaacctttccttttcgctttggagagatcaaaacgttttacttgttttagttttagagtcggagaacattttaaaataaacgataaaattacataatctttgccttgcataatcatgatatagttatagattgctactgaacttcattttgaaagtcctttcaagtatggaaactagtacgttagaatatgttttccatttgtcaggatggtctgtaatttctgttttctctgctttttgggtcagttaaaggaccactatttacaaaggcttaagtgggtgtgttttccctttcccctttcctataggctctacttggttccttttctagcatgctgtctgaccaatttagaaaatttcaattgtctacaggcgttgtcagttaaaactatttttttaacctatcaacagtgaatacttttgagtagtaattgttttgtgcctaatgctaagtgtatttattagcatttcggtgttgatctagaaaatttttacttttaatcctgtagttttagaagtatgttattcctttatctgtttctttatatcagtttttcccataattgggtaaactcctattttataaaatacgaagtacatttctggttttttctacataggttactagacattttttcaatttgaaaaaacattttgaattaagaaactttttttttaaagtaaatacgaaatgtggttcttgagtatgcattgatcctgatttaccatgtacattgtcaatggtttggaccattttctttgctaacagttacatcatgtcatgtgatatgtgcagtgtgatgtgtagttctaaaaataaggcaaggtaaaaatgctcatcccttgggaatttaaaaaatgtattataaatgtggaataactaccttcagtcatgaaattctgaattggatttccactaggtttatgcaacaaagtgtgccgttccttcgacctttagcatatttggtgtatttgttagtacctcataatttgaggtgattgactttttattttttgaactacttggagggaaacattaaatgttacaaaggttcttaatgtctatattatggtgaagatggttgtcactgatggccacctcatttgagtatataccagtgtctgtgattgtgaccagttaaaagaatgatcagttaagaattattagagcctttatggtagggtgggattttcggtctttccatctatatgagtccactgaagtgaagtattttagaagttttcttgcatcttttctgaaagccacgttcagaacattcgtatttgactttggtgctttaccaacgtgagatgttaaatttttgtctgattttctttcttcctgcctacacatgttatttctctggttaaacctgcagagcactctttgttacgtgagtgtttcctgttgaggaaaattctggaagttagaaaatgagtaggccttagttcacttgtgaactcatatcaaggtgagaagaaagtgaagtaactatactaaacttttttcttcactgtcactaaggctactcttccatctctagtaatgctacattgtaaccagtgtctctgcgtcttctgtagaggattgagttgaccacaggttttaattgcattttaaagtgaataagaagttttaggtttgttctgttcgttatgacctgatttgtgtactctgtaaacataggggtgttgtggttgtttgagaaggtattttagtattgagaggttctgattaggcccctttgcgagtaaagcttagttaccttgttatatcaggcaagcaattttttttttttttttttttgaggcagggtctcgttctgtcgcccatgctggagtgcagtggtgctatctcagctcattgcagtctccgcctcccaggttcaagcgattctcgtgcctcagccgcctgggtagcagggactacaggcatgtgccattgggactacaggcgtgtgccaccatgcccagctaagttttgtatttttagtagagacgggggtttcaccatgttggccaggctggtctcgaactcctgacctcaagtgatccacctgcctcggcctcccagaagtgccggaattacaggcatgaaccactacgcttagcctagacaagcaatttttaaaatgtgctataaaacaccaaactaatccacactggattttctaaacatagtaaacgccatgtttaaagagtaatgcgtattccttttatgttttttcagcttgtggggagatgggtaggggctatttttttcttcttggtgagtccattaagacacagaaataagcgactttcttgctagatagatgtatatagttttattgtccctctccaccccccaacaaaggacctctccgttccattccttgagtttagaggggagggactagggtaaactgaataagtggttgtctgttgattgccccagagtaaatcttattgagtggtttagagattttgtttctttttcattttagagacgaggtctcggggtctcgctgtgattcccaggttggcgtgcacagatgtaatcattgtgcgctacagtttagagtgcctgaactccggggctcaagtgatcttcctgccttagcctcctgagtaggttgagcaacgggagcatataaccttgcttgtctttttttttttttttttttttttttttttttttttgagacaatctttgctctgttgcccaggctggagtgcagtggcgcgatcttggctcactgcaacctccacccctagggttctagcgattctcctacctcagcctcctgcgtagctggcattacaggtgcccaccaccacgcctggctaatttttttctatttttagtatagatggggttttgccatgttggccaggctggtgttgaactccggacctcaggtgatccacccacctcagcctcccaaagtgctaggattataagcgtgagccaccgggcctggccccttgcttgtcttatttagagttttaaagcagctttcgttgtactctttcttcattttaaatgttcctgccttgagtgatttgattagtctatgtcttgggaagcgtattttaccttagtgcctctttacttacttaccttaagaaaggagtacagggcaggttcttaagtaaaatggccccagacacctggcttgcctactgtgtcagtgcaaagaacacttggatcatgtctttttcctaaaattggacttcataactgtttcttggaagtctgttttaagacttttttagttctcatgttgcttctgaagatgtatgtttaaattacagtttctatgctgataagttgcgtatatacctctgggcatactaaaagttgtgcagaacaatagtttatatgacaagataagtttccctcatcagtacttcccattccctgaaatgtgagatcaaaactcagttgaaccacactatggctgtagaagacagtatgaattagaaaagacaaatatccactgtactagagttcaccagcgtttgaaggctatcagaagatataggaggtaagtgatatccttgggtgtcacttgcagattgaggggaggattgtgggtcataggagatgactagtatggcagggggtaactattattatttgtttcttttttaagccatgtgccttttaggatgtagaacaaaatacataggagaaaataagccaaaaggtgtgatttaccaaaatacttggactccaaaaagagctgcaatatatatttttttttattaagcattttcttgtctttggtagaataaaggtaaagctaaaatagagtgcggaaactgacttgaccaaagtagaaaacacagctcatgtttatgaatcaaaaacaaatgagtttgggcagtctgaaagaaaaaaatcaaacattttatatgaagattttaaacctttatgcaaagagtccctttaaggtggaagagaccttttaaatagagtagaccttccccatttagtagcacaatgcggcaaaatagttgtttaataaatgttactttctgcaagccttgcttttccaagattttaagctgcttccacagtgttaacatttgaaagccctctaccaggaaattatttagctgtgtattttattgttgctgactgtgaacttacccttttttttcctggctgtaatttttttagaattaaagtttctttccaagattttgagggtcaggaaatgcaaagtggaggtagattgagtgcagttttatctaaatgttattttaaaaactctggttcttgtaacctgaaccaggaatccaaaatgagatcttactctgaattttaattacagcagattctgctcttatttggaaaaagttgcttgagtgacatcaaacttaatggagtccctcaccttttaattcctttttaaaaaggggagagcttaaggttagacttggttaaattcagttggaaggtaagtattagggaataaaaaagaggaataacaattttgttgttaggatgttaaaccaaaaattgctaagaactcatatctagactttcctcttgctgcttgttatttggcctttgtgactgtttgttagcacctccaccagagggtgtgaagggaaagaggctcaaagctaagtactgtagctagtttctggtttctagtataggagagacacttcatagaaataccagcctgggctgggtgtggtggctcatgcctgtaatcccagcaccttgggaggccgaggcggatcacctgaggtcaggagtttgagaccagcctggcttaacatggtgaaaccctgtctctactaaaaaaaaaaacagcaaaaattagctggacatggtggcgcatgcctgtagtcccagctactcaagaggctgaggcaggagaattgcttgaacctggaggcggaggttgtagtgagccgagatcgcaccactgcactccagcctgggcgacagagagagacttcgtctcaaaaaaaagaaaaaagaaataccagtctgataagttgaactgtcaggaaagtttcattaaactctccatatgttaccatggagaactgaagctctttgaagaccttaagcatgtctccaaaaaattggactgtatttttttgcacttagtgatttactccttaccccttgcctcccaagagaatgaaaaatggatattagtattgacttaacattttattggcattggaaaaatgtacttttaaaagtcattaattgacttttctctaaaggtataaggtaggtttcagtgggaactcaggaatttggccatggaccctcccagaataacctgtttcctttagaattctttttttttttttttgagacacagtctcgctctgtgccccaggctggaggtgcagtggcgggatctcagctcactgcaagctctgcctcctgggttcatgccattctcctgcctcagcctcccgagtagctggaactacaggtgcccgccatcatgctcagctaatttttttttttttttgcattttagtagagacggggtttcactgtgttagccaggatggtctcgatctcctgaccttgtgatccacccgtctcggcctcccaaagtgctggtattacaggcatgagccaccgcgcccggcctcctttagaattcttaaaatcttccagaagtcgctgattttaggattgttcaggagcacttacaccaaccattagggcttgttggaaagagatatgataaaaagtatgatttttttttcctctgtcttttgtcagctaaagagtggtaggaaatttgaattcagtgctagcatagaagtaggattaacaccattaatagtttgatatatagacatccttcagaaaaaaaagttttcttgagatggtatcttgctatgttgtctaggctggtcttgaattcctgggctcaagcagtcctcccaccttgacttctagagtagctggtattacaggcatgagccatggggcctagcctatccgtgtgtgtgtgtgtgtgtgtgtgtgtgtgtgtgtgtgtgtgtatatatgtgtgtgtatatatatgtgtatatatatatgtttaatgggatcatacttgttatatggcttgatctttttaattagggttttttttttgtattccagttcttcagtgaaagcattgtgtatacatctttgagtacctatgagaatatttctgttgaatagatttctagaagtgcagttgctgggtaaaagtttgagcaattacatttgtgattttgatggctattacctttataatgctgtgtaaccacatttaataatagcttaaaaagtgtagttaaaaagtttcctagtctgggtacaggtgcttggtcaagtaaataactggaacttgtagtgggtgaagcctatcctaggttcagttgatgcctcttcttgttaggtggttgatcacttcagacatccccattaacgtcctaatggatcttcatctgatgggtttagcatagaatgctcaggttgcttaacgtgtgttggtctgctgtctgccaggcattgtgctgcttgtaggggacagagataaaacaagctataaccctccttttttaagaagtacatagttggccaggcgtggcggctcatgcctgtaatctcagcactttgggaggccgaggctggcgaatcacgaggtcaggccaggccaacatggtggaaccctgtctctactaaaaaagacaaaaaattagctagatgtggtggcgggtgcctgtaatcccagctactcaggaggctgaggcaggagaaacgcttgaactcaggaggtggaggttgcagtgagccaatattgtgccgctgcactccagcccgggtgacaatgagaggctctgtttcaaaaaaaaaaaaaaaaaaaagtacatactctggggaagaaagagacaagacaaaattgtgagtttatattgtaccatgagcaatagccagggtgtcatgggggtgcaggtaagagcctagagggagggaccccacctcaacctgggagtaatggggaatacttgaaagagcatgtaaccttgagctgaaccgtgaaagagtagcatgagtaaaggtgcaggggcatagaagagccaggaaacatatgtttcaggtggctgcagtgaggacaggctggagatgaggtctaatgtaaaaaggggacagataatggtgtgtggggaatttggactcatccttactctagagtcagtgaaagattttaaatggttagatttaggtttaccccctcctttccttttttcttccctttctaataatcattttggtagtggacgctagattagaggcttgctgagacaggaagaaggaagaatagttgggagattattactgcctgaattactatagtacataatgaggttctgcactagggcattggcaccaaggatggaatgaatgtgcctgtcattctgtgtgttgccaaccctcaccctctgtgcaccacctcacctttcaaaattcagtcagtatgtcatcttttctagaagccttccttgaccccttcaggtgaaatacagtactttatcaagctaggctaccttcacacctaatttatattttactatcttgtatctggcatttagtagatgtttaaattaaatatttatggtaaaaagtaagttggtgatttgaggtcatgattaactcaaatagacaatgttgaggagcaggaggaagttttggatttggtgttggggcagggaatgggttttgaatatgggatgcttgaagtagttgtataggcaatgctgaattctactcatttctttctttttgtttttttggagacagtctcattctgtcgcctacgctggagtgcagtggtgccatctcagctcactgcagccgctgcctcccagattcaggtgattcttgtacctcagccttctgaatagctgggattacaggcaaagacggggtttcgctgtgttggccaggctggtctcaaactcctgacctcaagtgatcttcctgccttggcctcccaaagtgctggaattacaggcgtgagccacctctcccggccctactccttcccttccttccctccctccttccttctttccctccttttcttctctcacctcctctcccctctcccctgtctcctctctcctctctcctctctcctcccctctcctcttttccttcttttgagacagaatcttgctctgtaacccaggctggagtgcagtggcgtgataacagctcactgcgacctccacccgccaggctcaagtgaccctcccactatgcccagctaattattatttttttagagactgggtctcagtgtgttgtctaggctagtctcaaactcctcctgggctcaggcgatcctcctgccttggcctcccaaggtgctgggcttataagtgtgagctaccatggtaggccatcatttaaaaaaaaaaaattagtgtttttgtttgggtggcttttttagatgggggctatgttgcctaggctggccttgaactccttgcctgaagccatcctcctgcctcctgagtaactggaaatacaggcgcctgccactgcacccagctcctactcattctttaggtttcagcctggatgttcttttttctgaaaagcattttctgactccgcctacttctcagcctgtatgaggattgcctccatcccccaaatcacacagtagtgtctctctttactgctgcttgtcatccttgtatgtacttactgtggtgctttgaatactctaggcattttaatatttattggagatactcagtaggtagttggtgttctttgactgactttcctctaaagactaaaattcagaatttactgtcaggcagttaagaccgtttcagtttaagccttaaactatctagtgtagtagttaaaagcatcggctttagcattatggatcctgcccctgcaacttcatagttgtgtgatcatgggcaaattacttaacttctttgagcatctataaaatgaggacagtagtacttaccttacattgttattgtgaagattaagagaatatatgtaagatacttagcatagtgattgacatagtaaaacgctaattaatgttagtgaacaacatttgtaataacctatcctgcactcaggaatgattcctttagtaatataaagctttttcagttaagaagccctgttggccaaggaaattgataatggtcttgtgggtgacacacattatctctttgttttatagtaaaaattttgtctctccttccccattgtattccacaacaaatctacttttgttcatatgtaaaataaatactttgcagtgcattccataatgtagcttgcagtacttcatcacaaatcactgttcttttcctctctttctcttgagaagctgtacatataccacctgattcatgcaagttgttttgtggatcatgccccacgtctttcccattattttgattgtgtcaattttttgattcgtgtttcctcctttttctcttcttagtaaaatcttacacttgagggcaacccccacgaggcctttttgacttctctagtccagtcatttagggcttacagcacttactatgtaccaagctctcgataaagttagcacgctaaagaagggtgctgttaaggaattttgcttgtcttggaaatagaattagttaacaattagggaaaattcagataatttgaactgaatgacagtgactttaagtgcattatacaattcaagcaggaagaaagtgatatgaattggaagagtctaagaagtttttgtggagatgctatgtattgaaaaattagtaagtttggggacaaaaaaaaaaagtagaagaaggaccttccaggtagaggtagcaacataggcaaagatacggagttgggaatctgtggggagttctgggtccgtatcaattgatgtgcttgccctgacgttaagtttcatcttgaagaatttgaactcattaaaaaggtgtgaggggctgggtgtggtggctcatgcctgtaattccagcactttgggaggccgaggcgggtcgatcacctgaggtcaggagttcgaaaccagcctggccaacgtggtgaaaccccatctctactaaaattacaaaaaaattagctggctgtggtggcaggcaccggtaatcccagctgctcgggaggttgtggtaggagaatcgtttgaacctgggaggcggaggttgcagtgagcggagatcgcgccatcgcactccagcctgggggacaagagcgagactttgtctcaaaaaaaaaaaaagtgtgaggaacttgttcagagtaggaaagtgagatgataaaaaggtaaaggatagtttggggcactgaggcactagtcaggaagctgttgtgataatctagacaggagctgatgaggacctgggctagactgatagtgttagaagtatagagaggacataccaaacctgaaaagcttcgtgagaaaagaaggatttcgtcacaaaggagatgaaattatgaaggaaaagagagctttctttccattctttataagccatcatgtttttgtttgtcatatatttggcctttttgttagactggccccttcacatttctggatttaagctttggtagagactttgactattattttctggttgaagttctcattgcatcctatctggattattgtggtagcttttttattggtctttgccatctatagatgcctttttacttactttcaatccatcctacccaactgatctctctaaagcacagtctgatgtttcactcccatttaaaaagtgtttaatgatactctgctgtcattattttatatatacatatacatatatatgtgtgtgtatatatatatgtatatactttttatttttcagagactcgatctcgctatgttgaccaggctggtctcaaactcctggcctcaagcaatccttttgccttggcctcccagagtgctgggattacatgtctgagccgctgcacctggcctctgctgtctttgtttgtttgtttttgtttttgagacagagcctctctttgtcgccctggctgaaatgcagtggctcaatcttagctcattgcagcctctgcctcctgggttcaagtgattctcatgcctcagcctccctagtagctgggactacaggcacctgccatcatgcccggctaaattttttatttttatttttattatttatttctttttttgagatggagtctcacttttgtcacccaggctggagtgcaatggtgcgatctcggctcactgcaacctctgccgctcaggtttcagcgattctcctaccacagcttcccgagcagctgggattacaggtgcccgccaccacacccagctgatttttttgtatttttattagaggcgggttttcaccacgttggccaggctggtttcaaactcctgacctcaggtgatccacccgcctcagcctcccaaagtgcggggattgcaggcgtgagccactgtgcctggcccctctactgtctttaagtctgaattaaggctattaaaggctgtccgttaaggatctggcttcaaactgcctttccaccttcattctactatttcctctattaaaatatgctttgtgttttaagcaaattgttaatttttttttttttttaagatggagtctcgctcttgttacccaagctggagtgcagtggcccgatctcagctcactgcaacctctgcctcctgggttcaagcaattatcctgtctcagtcttccaagtagctgggagtacaggtgcgcgcctccacacccggctaatttttggtaattttagtagagatggggtttcgccatgttggccaggctggtctcctgatctcaggtgatctacccgcctcagcctcccaaagtcctgggattataggcatgagtcactgcgcccggcccaaattgttcatttcttttaaccttcagaatgtcgccttttcccacacagcgttgccttttcttatgccatttcctctcactagaatgccacattaccattctcttgtcctagccttttgcataatgacattttagctaattttcaagtctcagctaaaattgcggcaacttcatggacacttccctaatcatccttcctgctgtttctttccgtcctttgtgtagagaaatgaggtaatggtgaaggaagaggttagtagaagccacattatgggcaaacttttcttccccatctgatttttgcttttgctttcagtgcaagtgtggttgtaatacttgttggccacctggatgacctattccttcccctttgttctctgcagctaaatatttttgcaaggtggatgcttccaggttattcttgtgtatctggagtcttgtcttggaaattgactgggaataaatgaggttttcatttgtgggtgtggagttagttctgacttacagtatttgaagcagctggatacgttttgcttttgaaagagtatatatatgtgtgtgtataatctttaggatatggttctctgttgggaggtgtgatgttgaaccccccagctcccatatttgacatgtctggagacatttttgattgtcataattttcagaagggcactactagcatctagtgggtggaaaacagagatgttgctaaacatgctactgccaggatagccccctgtgatagattactcatcgtgagatgtcagttagtggttaggttgagaaactctatcctagaagtatatttttgcttcccaagtgccacttgtgttaggtagaagtttgtccttggaccgatggtgcaatttagaataatagaattaacataggaagggaccctagaggtcacatatttgaactttatcccaacttgtatttctcacaatgatgtttctgcttgatattaatagatgtaatggaaaaaggtgcttgttaaaaaagtttggtaaaggtaaacatttgcatattcagtatgatgcaatacgttgtgagtctccatctgggaagtttttccgaaatgtatttgcttgctgagtgcatttaacatcttccagaccctaaaatacttctttgaaactgagagagaaactattgattatctagcccaaccttttatagctaaatgaccttgaataggtagccttttcttttatctgtacaagcttactgcagaatctcaatttgtgtgagtgacagcaggtgtagcagctccatctgtatttgtcagattatagtttactaactgaatgaactaaaaattgggatatttggggcttgaatttttattctgaatgtacagtctgactttatccccaccggtaaattagaaattataatctcagccctaattctactgcccaggttgttatgaggattaatcagttaattatagcttttaaggctttgtattctttggagaaagatgatttatcagataggctgttgtgctgtttgtgtagaactgcttcctttttttgtttttcgtttttttttcctttagccctgagcttctctaagaactgcttaaatttgacagtctttccctgctttacattgtcaaagattgaagctttttgaattttgtaggggtcaagtgggataggaatcattgttttgctctgtatattaaatttaagaatgttactatgggccgggcgtggtggctcatgcctgtaatcccagcactttgggaggccaaggtgggcagatcacgaggtcaggagatggagaccatcctggctaacatggtgaaaccctgtctctactaaaaatacaaaaaactagctgggcgtggtggcggacgcctgtagttccagctactggggaggctgaggcaggagaatggcgtgaacccgggaggtggagcttgcagtgagcttagatcacgccactgctctccagcctgggtgacagagcgagactccatctcttaaaaaaaaaaaaagaatgttactgtgattttgttttacttagttattggctctttaagaatttccattgttttctttttgtttctctccattttattatagaagtaatacatgtttatggtggagactttacataagccaagaaacaaaagacaaaagaatcttaaccaatgactttttaaagcaaaattgagatgatactgtgttttgttttgtaactttttttcatttaataatgaagcaagcacttttctatgttagtaaatatagctctgccacacttagggttgcacagtattccattgtatggatatttaataatttaaccgagtttttggcattcagttttctttttattataaacaacatcatgaaatattaaaagtaagtctagacataacagggaaaagattaaagtactaaacttaggtggtggtttatggcaattgtagctaattgcaaactaggtgcattaaaaagccatggaaattcattccttctatgtttcctttttgtttccagtgtaataaaagtgcaaataatactgggtggttgctccaggtacgtggccaagtaattgaaagtatcttatttcatcatcatagcatccttgtcgggaaggctctgttacttgtagatgaggagacttaaagaacagaatagttaagtaacctacaggaggtggagccaggatgggaactgagatttgctcacttgagtcagtgctcctcttacttatgaatatctttgggagtaatgttgaatcttagcatagtatttcgagtcaataaaggtatgtcaagtcaataaatggtatttctttggtatagaaatctcaagatttaggaattaggaatgggaattttttcggaaaaagtggtcactttttcctgttctctgcactctctctcctcccccacccccttacttagatgattgttttagtaactacactatgctgtgtatcctatggggatattgagaccaaggataaagtgcaaatcaaataaactattgtctttgaagtgtatatgttaatgtcaagttcatagacatcatttcagagaagtcttggagtagatgggatttttttttttttttttaagatggagtcttgctcttgttgccccggctggagtgcagtggtgcaatcttggctaattgcaacctctgctgcctgggttcaggtgattctcatgtctcagcctcccaggtagctgggattacaggcgctcgccgccacactcagctgatttttgtatttttagtagagacagggtttcaccatgttgaccaggctggtcttgaactcctgacctcaggtgatacgcctgcctcggcctcccaaaatgctgggattacaggcgtgagccactgtgcccagctggagtagatgggatttaagccggcattttttcttaaagttgtaagctttaaagaattgaataatctcagaataactttgagaagtttactacttaagcaccttctgtgatgtgatgttaattatgaccctctttttcatttgtgctggagtgagcctgggttttcctaagttttatgtaagtcataaagcatatttgtgcccttgcttgggtcctcagagggaagctgtttcctgcccttgctaagtcttactgtagtgctgtcaggcagtagggtacaattactcttcacatgttgtattaatcatctggcactgataatatgcctccttgcattgctcatatcaactacatattgacattcaaaaggggaggagattgaattgatgggaattatctggtagtgattttcgtttgtccatgggaaaaaccctttgcatattataaaagtgactcaaaatatttttaacaactatattggtccagctgtcaactggtctataacacaatgtttaataacaggaattagtactgtcaactggtctgtaacacaatgtttaataatatattagtaattagtattatatttaaagttagaaatgggaaaagacaacatagaataatttgtgccacacagaatgccatatgccagaaagcccacaggagaaaactacataagccctgaaaatctagttcataaagagtgttggttaaaatacaaccctggaacaagaaacttttggtgttaataattatatgaggccaggcacagtggatcacacctgtaatcctagcactttgggatgctgaggcaagcggatcacctgaggtcaggagtttgagaccagcttggccaacgtggtgaaactccatctccattaaaaatacaaaaattatctgggcatggtgacacatgcctgaagtcccagctactcgggaggctgaagcaggagaatcactccaacacaggaggcggaggttgcagtgagccgagatcacgccactgcactccagcctgggcgacagagcgagactacatctcagaaacacacacacacacacacacacacacacacacacacacacacacacacacacagcaataagacagattcgacccatatgtatattggtgcttttatgaataatgttttctcagtcatttatttgagtatttttatgttaatgattcaaattgtcatactataaagaagcttactgtggtcctgtagggcctaccatcctgtgttggtattgctccaaagataagcatttttgattaaattggagattgccctcatttggggcagggaggggggtgcttagtccagtgatttcacaagcattttggtctcaggacccttttttaactcttaaaatttgttgagaacagcaaataaattgtttttcttataaactttgagaaatttaaaaaatatttaataagtaattcaggctgggcatggcggcttatgcctataatcccaggagtttggaaggctgaagctgggagtttgatagcagcctgggcaacaaaatgaaattccatctctacaaaaattcaaaaaattagccgggcatggtggcacacacctatagtcccagctactaggaggctgatgcaggaggatcacttgagcccaggaggttgaggcttcagtgagccatgattgtgccgctgcactctagcttgggtgacagagctagaccctgtttcaaaataacagcaacaaataaatgatttgtcttgcacttaaactttttacccatgcatgatttcctgacattcactggacattttatcgttcactgggttatgcagatcttccaaatgttacacattacattatatgcaatcaaaaattcacgttcattaatatcgtcacaagtctgttaaatcagaaatggcttttaaaatattcagaaagtccgaatgtggcagcttaggcctgtaatcccagcactttggaaggccgaggtgggcggatcatgaggtcaggagattgtgaccatcctggccaacatggtgaaaccctgtctctactaaaaatacaaaaattagccaggcgtggtggcacgtgcctgtagtcccagctacacgggaggctgaggcaggagaatcacttgaacccaggaggcagaggttacagtgagctgagatcataccactgcactccagcgtggcgacagagcaagactctgttaaacacacacacacacatccacacccaccaaataaaatattgggaaaatgtttaagttcatgattgttgatacaagttttcaaaaacactaatctttgcctaaaaaattcagattttattattggcagcaaatatcgtcagtggtcttccttgaagtgacaggttcactttgttcatttgcaaggaaatgtctgctagtgaagcaggtttcaaataatgtttgtcagtagttctgccaagtaaaaatcgtgttccatgaacaaagctctagttcattttgcaactcagttgtactgtgctttttcctgagaattcataaagcagcagagtgctttatgcatactttccctttcatcacaaagaatatttttaaaaaatgcactaaaggctcaagataattcataatttttgctgttcatcaaggacatcttaagtggaactcccttaaaaaaagaaaaactgagtggagagtataatgactattagtatagtttggtgcctcttccttgatttgtgctaataatgtaccagcagttttgttcacctttgtttttgtactctgattgcaaatgtcaacacagtgtaaaaggcagataatattctagtattgctatgaaaatacctttgatttcacgaacctccaaaatagcctgtgagatccccagaagtccagagaccacactttaaagaacaactggcttagttctttacgtatgtttcctttggctcccagaccacatagatcaagggggatcaaacagaggcaaatgactgagatttttagcttggttactaaataaaagcagtgtcattacttaaggtaatgaaacaggatgcggaatagtgtgctggaaggagaaagtgaattctgagcttcagggggcttgaggaacatagaggttataggaatcttgattagtgcagctcagaagtttttcttatggttaagaaacctcaccatactagtggttgttgagagagaagagggcagaagggaccttgtgcagcaccagcatttaagggtccaggaggaagagaagaggatgatagtacaaggacatcaggaaagaattagaagaaggtcggtattgtccagtgcttcagagaagtcagatagaatggggactgaggtttgaccattggatttgataataagattactggtcacctttgccagagcagtagggggtgaaatccagattatggaagagtgaagagtgcagagacagttatttatactattcttagagaagttttggggtaaagggaaagagagatatttgggcaattaagtatgagagagaggctgtactgagggcagaagatacttgagtaaattcctaggctgagaggaagaagccagtagagaagatattgatgaccactttgatctgaaagaaaagaaaactgatgaaacaagttggtattacagatgtggtacagttagctttgtagtataatctatacttctagagaagtgagaagctgatgaaaactggattccctggccagaaaaatgcacagacctgtgatatttggcatactttttttagtgaacacgggaattccttactaatttttttctgtttaattattgcttagtttgatgtgtcttgctttaaatccatttatttcaacaagcttaaagagatttttttttaatggagatgatttaattttaacaatctgtgattttctctgaatcgaacttgtgttttggcacctttcaatctgtggtaacaaatgacaagaagggtgcaattcttccttcccttgtgcagggattttgcctccccctttctcccagatgaaagatatttgggtctctagaataactgtggtacagttagctccagagtgttttctttctggaggcagtttagacaacagcctcaagtagtgcttttgttaaaaatatacatgtttttaaaagtgcttgtatttctaatattcttttctcctttctcttctagtctgttctctggggaggcagtaaggggccgtggagctggcctcggcctcggcatcgggagaggctggacttcctgtctctctgtgctgaatggctgcgatggcgcccgctctcactgacgcagcagctgaagcacaccatatccggttcaaactggctcccccatcctctaccttgtcccctggcagtgccgaaaataacggcaacgccaacatccttattgctgccaacggaaccaaaagaaaagccattgctgcagaggatcccagcctagatttccgaaataatcctaccaaggaagacttgggaaagctgcaaccactggtggcatcttatctctgctctgatgtaacatctgttccctcaaaggagtctttgaagttgcaaggggtcttcagcaagcagacagtccttaaatctcatcctctcttatctcagtcctatgaactccgagctgagctgttggggagacagccagttttggagttttccttagaaaatcttagaaccatgaatacgagtggtcagacagctctgccacaagcacctgtaaatgggttggctaagaaattgactaaaagttcaacacattctgatcatgacaattccacttccctcaatgggggaaaacgggctctcacttcatctgctcttcatgggggtgaaatgggaggatctgaatctggggacttgaaggggggtatgaccaattgcactcttccacatagaagccttgatgtagaacacacaactttgtatagcaataatagcactgcaaacaaatcctctgtcaattccatggaacagccggcacttcaaggaagcagtagattatcacctggtacagactccagctctaacttggggggtgtcaaattggagggtaaaaagtctcccctgtcttccattcttttcagtgctttagattctgacacaaggataacagctttactgcggcgacaggctgacattgagagccgtgcccgcagattacaaaagcgcttacaggttgtgcaagccaagcaggttgagaggcatatacaacatcagctgggtggatttttggagaagactttgagcaaactgccaaacttggaatccttgagaccacggagccagttgatgctgactcgaaaggctgaagctgccttgagaaaagctgccagtgagaccaccacttcagagggacttagcaactttctgaaaagcaattcaatttcagaagaattggagagatttacagctagtggcatagccaacttgaggtgcagtgaacaggcatttgattcagatgtcactgacagtagttcaggaggggagtctgatattgaagaggaagaactgaccagagctgatcccgagcagcgtcatgtacccctgtgagtagacctcatgcatgatagcattcttgagaaatgttggcacaaggaagaatgaatgaatcgccattatggagagaatgtgattctttgtacataggtgtctaggttctgtttgttttttccctgatgttgggtagatgagtgcatatacatgctagtgaagaaggggaagatacttttgctgtagggttgtattgttgtagtctaaatggtggtaatttccttttgaagtctaagaaaaataactaggagacatcttatgtgtaaaattgtactagtacctctttaagagtgaatttagatttcttttgaaactatatataggacatgataagttaatggcctgattgttgagattttgttgtttccagtaagcagggacaaatgctgagttgacctagttacctttgtaggaaattacagttgcttttgattgaactttcagcagagagcacacccagtcttcaattttaacacttgagattttcttacattttaaggactgacaattagaaaatgcttcagaatatttaatacatcgcctccaagcacagtctagtttcacaacctgactctcttcctattaaaaaaaaaaaaaagcccattttaagcagatttgttaagctgagttaaatgtattgatgtatttggaataaattcttactgggttgttttttttgttgttttttgttttgttttgttttgagacagttccgctctgtcgcccaggctggagtgcaggagtgcagtagtgcgatctcagctcactgaagcctctggctcctgggttcaggtgattctcgggcctcagcctccctaagtagctgggattacaggtacccgccaccaagtcaggctaatttttttcttttttcttttcttaagtagagactgagtttcaccgtgtcgaccaggctggcctcaaactcctgacctcgtgatccgcccacctcatcttactggtttttctaaatctgttggtttgagaaaattttacataagctttttatgggtggcactccaaattggcatggtggagacagagacgtttcattcctgtcactcccaattcagcatctatgtacttaattaaataaagcagtactatattataacatacttaaagatacatgttaaataagtgcatttatctccttaggaatatcagatttgagagagagcatgaggagttggaaaagaggggcaggataattgactagcagatctttcattttctctttgctagaggctggcttactagagaaggctgaaaaagatgaatatgtgggaagaattggtgtttccttgactgtattaaaaggtgatgaagattttcactggagtgtttggttgttgagacagctatgatttttaaaagtaaattttctggtttcccaattttgtttatattatctgcatggatattgtatctgaaatgaaactttttttttctattttgaaggaagaaatggataatttttgctgaatttcttccttgtagacctagttctattatcatttgttagttcactgtgctcaagtccacttctgtatttagatttaaagcaaatgcttcagaggcttgcttcttccgtaacccatctttctttaaatggattagtagcttaattcagcttgctaatattcatggcattatccccactaactttgctgtttaaatcaccgctttaaaaatatcttggttaacgttaaatattttgtgcttagaggtataataaacactgtagttaaaggattttaaattgcatgcacttattttgagtaacagaaaagcacctagacactataagcgtattgttttcaggatacgttgcattgaaaacatttctgagttttggtactgttgtaggtaagcgttacaaaccaatgaaataaaagtacctgagaatttttcttattctgtaggatagtttaatgacttggaaaaaccttaaggccattcattcactacttagttctgagcattcttctcacataatggtttatggtttggaagggtgtgaagtgtataagaacagccaaaggatggcttttaggaaacattttgggatcagttgaatcctcttgcaattaaatcaactgatactttaaaaagttgaattttcatgcgttagatcatatttgggtactgaaagtactctgaagtacatgctctttttgcacattgtaattgtatttagggccgggcacggtggctcactcctgtaatcccacccagcactttgggaggctgaggcgggcggatcacttgaggttgagagttcgagaccagtttgaccaacatggagaaaccccgtctctactaaaaatacaaaattagttgggcgtggtggcacacgcctctacatccagctgctctggaggctgaggcaggagaatcgcttgaacgtgagaggcggaggttgcggtgagctgagatcgcaccattgccctccagcctaggcaacgagcgaaactccgtctcaaaaaaaaaaaaaaattgtatttaaactaaaaccaccagtaaagcataaatactttaaagttcttgttgagcaagatcaccgggttgactcttaaggctggtatttatttagccaagtgtttgttgatcttctgagtgttttaaaggttttcagcagttgaccagacaatgagaatggaggcattgctttaatttaaaaagaagaagaaaaagttgttctttgatgctgagaaatgaatcctagaatgtagttagttaattcttcaggaacttgacccagctggtgaattttggctccccccacccttccagtagctggtctgtattttactcttttgcccaagatagagtggtgggctaggtttcgtctaggcagccctgatgaaaatatttagtagaggagactgttggaatgagctgtttttaaatgatgttgcttaaattacaagtggatagttctgtggaaattataatccctttcttcactaagaattcaattgtttttttctttcccacctcccagaggagaaacagtgatccattctgtgtcgttggtacatgctagctatagaatgattaatttttctatgttgttgaatgtttagcaaattgtatgtttatcattgtattatgcttgacagtaaactatattgctaaatgagactttagagagagttttttaaattaatttttatggttgactgattttatgtctggtttaaaaactcttaccctttttgttttaaactcttcttggaaaattttcatgaaatatttcacatatcttcctttcttggtacagtggaaatataactgctttgaaaattctgcagtacgttgtgtttgatatgatgtcactaaacaatgatatttcatcactgtggaaggtacaggaatttaaattttatctccttgattatgggattaagaaggaagctgcatgcttccgtaaatatcttaatgtttaattcttaattgtagatgtagaaataaaagcatttaattatcatatgtatgtaatgtacttgctgagttgtgcttgctcttctttcttttatattctttgtttttccctcttagagttgtttttttttccctgcaattttgtttaattcctggacccattccacattttgctaaatttgcttttcattttctgggtcctgtgcttataaacttctatatagtaactacttgttaaaataatattttttttccagaaattctcttaattgtgctcttaaatcagcagtgttctgggtacctggaccacattatgtaggtctctctctcctaagtttttttttttttcctttctttttttctctctgtccccgaaattttttttttcttttttttctcccaaccgttactctaggcttatcttgaagttcagtataaaaataacctcataaaacatttcattgtgattactgaaatattgttgaggatattctctgtattctgcaatgccttctttataaagacctcagggagaaagatgtgcagccaagaataattgtatgtttgtctaagcttttagtctgtttttattacctgggtgctgtaattgttcactaggtttcttttttcctattgacatctggaaatttagagctaagcttgtacctttttaatagcttcattttgtttccctattttcatgtttttatttctggttgaatttatgctaacctgtgttttgtctaatagtctcctgaagtctgtttcagatcagggttgggtaaaaatagactatggatgcagttcagtgacactaaagcgcttatttgaattttggatggtcttgattgcagtgagttttctcaccctcaggaattttttttttttttggagaccgaatgttgctcttgttgcccaggctggagtgcagtggcgcgatcttggctcactgcaacctctggctcccgggttcaagtgattctgctgcctcagccttctgagtagctggaattacaggtgcctgtcaccacgcccggctaatttttgtacttttagtagaggcagggttttgccatgttgctcaggctggtctcgaactcctgacctcaggtgatctacccgccttggcctcccacagtgctgggattacaggtgtaagtcactgtgcccagccctttttttttttttttgagacagagtctcactctgtcgcccaggctagagttacagtggcatgatctcggctcactgcaatctccacctcccaggctcaagcaattcttctgcctcagcctcctgagtaagctgggattacaggcgcccaccaccatgcctggctaatttttgtatttttagtagagacggggtttcaccatgtggcccaggctggtctcagaactcccgacctcaggtaatccacccaccttggcctaccgaagtgctgggattacaggcgagagccactgtgcctagcccctcctggggaattttatcctcttggagtttatgaagacctcatggtaaaatgaattactagtgtgtttataggttttgctttttagatactttggaatgttctatattgttgcttttggtctggcttggtggctcatgtctgtaatcccagcactttgggaggccaaggtgggtggatcacttgaggtcaggagttggagaccagcctggccaacatggtgaaaccccgtctctaccaaaaattcaaaaattagccaggcgtggtggtgcacgcctttaatcccagctacttgggaggttgaagcacgagaatcacttgaacccaggaggcaggagttgcagtgagctgaaatctcagctctgcactccatcctgggtggcagagtgaaactgtgtctcaaaaaaaaaataaaaatacctgtaatcccagcactttgggaggctgaggtgggtggatcacgagttcaggagattgagaccatcctggctaacacggtgaaacgccgtctctactaaaaattcaaaaaattagccgggcgtggtggcggtcccctgtagtcccagctactcgggaggctgaggcaggagaatggccagaacccaggaggtggagcttgcagtgagccgagatcgcaccactgcactccagcctgggcgacagagcgagactccatttcaaataaataagtaaaaataaaaataaaaaaaagtaactcttacttgaatttattaagaatacacagatgatgttgccaaagtggcaatcaaattgctttgtcattttttactttttatgtatgtttgtatgtatgtatatatttgagagagagtcttgttctgtcactcaggctggagtgcagtggcgtgatgtcagctcattgcagtctctgcttcccaggttcaagtgatcttcctgcctcagcctcaggagtaactgggactacaggcatgcaccaaacacccggctatcatttttctactctttatcatttcataaagtggtgggttgggaggaacatcagccaggatacccaagtcttctcagctaaacccttcttctgctaaaaactagctataggactaatgtaaccatttttctaattaaagtgagggagctgaccctacgtgacctttaggtctcaaactactttgaaatgtgactgtttatctttaaataacatgaatgaaactattctcatcaccatttttttgcattgggggaagctgaggcaaagaacccagcaaagcactggtataagttgaaacaaaacaggtttcttgacttgtgacttaaagctttggttcttctaatgccttcattcatttctttggttgatttacttttcatagtccattaaagtgattatcttatttcttgatgtatgggatagaaatgtgggaataatttcattgtattcttacagaatttacttcagagctgagtaaactttcatttgttgaacacctttgatttaatgccccttggcttttctcctaatctgcacatgacgtcaagtggcagaagtaggaacttgtgtttttttcttctattctcttctcatttttttcctgagaagaaacgtaggtagtgaaaatcattcttagtgcttgttgtgggattctgaagaaaggaacttaggcatcaggaatttgggtgttacccatttaccgtagatatagttgctatagtgttttctgccaccttgtgattgttgtttttgttctctgaagtgaacgtactcttttatggtagtgttaaagtcatataataagtacttatggagtaagtaaatgtgtaagacacaagagataacagatgaataagctaagtttgtatcctcaagaagtttaaagagtgaagggagtgaagaacttagtaagacaaagatgaatgtttagaacagtgcctggcacttagtgatgttagaaatgaaccttgaaggttggcaaagattttgatagacagttttcttttgattgtgacctactgagaggtcagtataggcagaaagcacagggcacacagagaagacaagttgaaaggtatagggctttggtggcaccatgggaatgggatatgttgaagacatagtattataggtacagatggtaaatgtaatgtgagaagaaaaagagataattccagaaatgatgtagaggtaaattgaatgggacttaataactgtgatgtgtgggggcaatgacgggagggatcatcataggtgattgaagttttaagcctggctgactacagcaatagatggttaccagaagcatttcagtactcagtttgcaaaataatcttaagagctcatgagagtccaggttctttactagagtcttaaaaatgaaggtttctgtattccttacaagttccagcaagtgttaaaaatgaggaaatggctgggtgcagtagcttgagcctgtaatcccagctctcaggaagttgagacaggaagatgggttgagcctaggagttcaaggcttgggtaagctatgattgtgccactaaactccagcatgggcgacaaagtgagaccctgtgtctgaaaaaataaaaaacagtgaggaaataagcttccaaataatcttctataaatgggggaggagttgctctgtagagacctgaaaaccttcattggaggagtttggatttgattaattcattcattaactctacattgaatgcctgctacatgctgggatgctagggatccagtggttaagaaagatacaatccttgtcttgccctcatggggaatatagattagagagagattaatatttaagcgggtaattacatagatgatatatttatgattgttgtgggtgctacaggaacaaagttcagagtgatctgagggtgcatattggatatatctaggcagcatgtgatggggatgtgatggtgagtcttctgaaggaagtgacatgtaagctgagacctgaaggataagaaggaattggtgggtgagaaggggctttgctgctcattgaggaaacaagacatgctaaggtcctggaaatggaaggtgcttgactctcaaagaacagagcaaagtatagtgtattttacaagtagtgagaaatgagaccagagaggtagctagttgccagatcatacagatggccttgttgattatataaagttaaaatttttattgtgaagccattgacatggcttacatgatttgtatttttcagaccccgcttgtgtggagaaggggaatagaggtgaatttaggctaaccagttagctgaatggtggactcagcctttggcaggaaagatttaagagaattggttattggaagtaggggtgatgagggcttgtggctgattgcatgtggtgagcaaaagggaagaggtgccatgggtgattcccagatttttgtttggcaggggtaactacattggatggatatgtcaagatggagaaggagcagatgaggtaggcattcattaatttttatttaaatattttcctttgttgggtatacctggagtgtcctttgtagagcccccgattaggctctgtcagtgtgataaaacaaatagttttaactagaaaagggaaagcatgggtccacattctgttataaatggatggtactttaattcatttccccacctccctaaacatggaccaaagtggactagattattttgcaagctgggtagaaattcatgcctaaggtcatgccctttcatgtttaccagtgaattatctttctccaattttctattgtgcatctgggaaaattatgcttacatatccaatgtaaagaaaacattgagtttatatagatttgaaaccaagggggtttagtatatagtaaacataagaataaatcttaccagttttgattctcattagttaaggctttgtggcaactgtgtcctgtttgattttatatttctataagtgtgaagaaaggtttcttgtaccatggtagacaaaattgctttgaaattattttaagcctgatgaaagttgtagggtctgctctgcaagcagaatatactgaaaatttgctattaaattgtgaatgttgtggtttgctctagcagcctatttagtagcattgtagtaatcatgtagattatattcagaactcaggtaagaggaattgtagagaaaattgttttgggggcgggggaaatggggagattggggaatggcaactagagagaggtgtcatagttcatttaaaatcatgttcttataagttgttttacttaggcctaaaagaatagagggcatgtgccagggaattgaatacccttgtatatgtagtgccatttccttgctctccctttaattgctatttccggtttgtttctcaggtacttacaagagatgtatcctgggaagaaacagggtggcagagtttagggcctttgggactgaattagtcttaaacctgagaacccaggaggattttgaccgaactgatttgggtgagctaggaaacaaggtttttttttttttgagacagagtctcgctctgtcgcccaggctggagtgcagtggcatgacctgggctcactgcaagctccaacttccaggttcacgccattctcctgcctcagcctcccaagtagctgggactgcaggcgtctgccaccacacccggctaattttttgtatttttttttttttttttttttttttttagtagaggtggggtttcatcatgttagccaggatggtctcgatctgctgacctcgtgatcagcccacctcggcctcccaaagtgctgggattacaggtgtgagccactgtgccctgctgggaacaacgtttttaaccaactttgcctaagcagacaacagagttgagacattctggtagagaaataatagcccacatttgttgaattgtttttagctctttagttataaagagctttttacaaattaatttatgtaatcctccaacagtacaatgagatagataattttaattttacagactcaaactgcagaatggaaagtttaagtaacttaatgtcaaacagctaataagagatcaagataataatctaggctctttacctatctcctgggcataagcactagcttttttagtgtaaacagaatcaaattgttcattagatttggttgatgaaaagaggtctaccaaccatcatgtaaaataatggcatttatgtttatattcagaagactattatacattaatttggtaatacgtattttttgaggaaaggtataatggccatatgtatcttaaccagatacatccttaagcctacaatatgagtaaaagaaaattactcattttcttttgtggagtagaagttggatgggttatatgggcgtgatgcctctctcctgtaattccagcacttggggaggccaaggcgggcagatctcttgagcccaggagttctagagcagcctgggtaacatggcgaaaccccttctctacaaaaaaaagtagccaggcgtggtggcatgcgcctatagtcccagcttacacgggaggctgaggtaggaggattgctttgagcctgggaggtagaggttgcagtgagtcgagattgcaccaccgcactccagcgtgagcagcagagtgagaccttgtcttaaaaaaagttggatgggtagaggagggacattttgctagggcagactaacatctaggaagtggttgaagttattttttttaaaaaaggaagaaaagaaaggaattagtatttattgatcacacctttctgtatgttaggtggtttaggtttgttgtctttaaatcttccatatgatgatgataccctgttttacagttgagacccaagactatagatatgttaaataatttgcttgtggtcatacatgttctatcttctgaatagaagataactcctggaactgatagagagagggcagaaaaaagattctattttgagaaatggagcaacctgaaggcacatagctttgctgtttgctgtaactcctttagacagctctctgaccacacagtacgtgggtggacaccagcattgaccaggagggatggtgggaagtttaaatagttttcctttactgtaataaacactctagagaagtgaactattaaaggtttttccccatcaaatggctaaattaaacatttttgacattcgaaagggatgatttatatcttatgtggaaaagccccaaacaactatttccccagttgctggaaaaggagctcttttgagttatgaaggtattttatgttctttctccattattcttaacttgtgcttacaggtgaattgtaagcatgtgctttgtgtttagtattttcctcaagaaaactcttgctggtaaatctagttaccatagaacttgaaaggatattgaaagaatagttgaggactatcctgattggttttcatctacttagtctgtatttgtgtcatttcagtgtctgagtaggtggtttgtgattaacatttcacatgttatttttattgatttggcaagtaccagaaaacttgaaggatgaactagaggttatttttcttagcatttgtggtattagtactaaaaggggagtaagagagtagaaagaattctggacaactgttaagaattgttacattttgtctacctaggctcgagttcctcacttttaaaattaggactgtactttttggaagaatattgcttgttgttttgtggtgggaccaggctgtgatgggaaaggctgttgtcataggcataggcaggccttttgctttgctgaggtatagtgagcagcccggtgaccctccatgtagcctgcattgcatgcagtttccacagggtccatagagttagtgcaaagctccagcaggcctactcacctgcttttctcatgaggcaacctgggaccagtgtgtccctgtagtaactgtaattttttgttgtgttcacttattgcagtgaaaaaaaaatctgagcgtaaggttctgagtggacctggaaaggggtgggtgttgtagtgagagactgaagacaaaggcctgtaacagatgggtatctttttagcttaatcaagctattgctggagtgttatgcttcagaaataagtctcttggccgggtgtggtggcttatgcctgtaatcccagcactttgtgaggccaaggcaggcagatcgcttgaggtcaggagtttgagaccagccttgccaacatggtgaaacctcgtctctactaaaaatacaaaaatgaaccgggtgtggtggcgggcacctgtaatcccagctactcgggacgctgaggcaggagaatcacttgaacccaggtggtggaggttacagtgagctgagattgctccactgcactccagcctgggcgatagagcgagactcagtctcaaaaacaaacaaaacaaaaaatacaaaaattggctgggcatggtgacacatgcccgtaatcccagctacttggaaggctgaggtgcaagaatcacttgaacctgggaggcagatgttgcagtgagccgagatcgatcgtgccaccgcactccagctgggcgactgagcgagactgtctcaaaaaaaaaaaaaaaagtctctaatggaaaacaaaaatttatcccaattcccccaacccctcctcccaaaaagcaaaacaataaagaagttttgttattcttgcttttttaaaaaggaaaataaaatgctttcattatttcccagaaacagttgatttaaaaactattgcagattataaagttcatttatgtagaacaaataaggtacttagtgctttttgcaccgtcaaatgtcaaaggcagaatttcagttactgctttttaggtgcataaaattagcatagttgaatacttcattgattcatttagttgcctttcatagaattttactccaataacaaaaagatctggggtttttctaaaattttcttcaggtcttgagagtttttagctgaattgctacaactattctttctctagatttccaactgggcgaaaatgtttttctttttaaattggcactctcccagcatatttttccagcaagtattctttgggcacaccctgtgcgtagtgaatttttcaagatccttattcaaaaggctgggaggacaggccagtcttttctttgtaagatgaaaacagaatgaagcttgcttaagactcattttgcttctgcccaactgtatatgaaattgatctcatgcaaatacactcaagcattaccagaagtaatttgacttgatagtgtaagtagaaaagctaatttagtatttgcaggcggtttgcttagtgcaacaggtgacctctcaattgagaattcttaatttgttctcaatgataacttgatagtaagcaggtctcaggtccaagagttgagaaatgtgaggtgactttgaaattttcaaggtaattgtacattcaagacattgacatgatatgtatatatttggttttacattttattaggtgctgaggttgtcatttccataatgtccaaagcaatgttagattatttaagcttccatggtttactgatggtattactagatgagataaatgcctttaatttcatccttgaatggtaagattggctgactaatttagggaaggataaggtacagaattgctcttgggtgtttcctagcaggctggccttccaagagcaatagcttaatgtttgttcctttaataagtagtacttaaacagtgatcaggggagttaccataattggtaatctgaatggaaactaaaatgtgtcatcattgaggatagtcagaagtgtccttgtggcagtcctagaaaaggggttccagaattttccgagcagagaaaaatataaacattttcaaggttctaattatttggagactagcctttcaggatcatttatcaccaagattaaccttgccaccaaagggcaaggaaacacttctctggtggttagatcaggaatgatgaaaacacttaagaagaattgaaaacttggttcctgtcttcaatgagtaatttatgtgactgatttttttttttttttttggagatagagtctcactctgtcacccaggctggcgtacagtggtgtgatctcagctcagtgcaacctccacctccctggttcaagcgattctcctgcctcagcctcctgagtagctgggatttcaggtgtgagccactgctcccagccttcccctccactttcaagtaaaagaggaagcattagaattagacattgtgggccgagttccttgggaggatcccttgagcccgggagttctagaccagaataggcatcatagcgagaccccgtctctgtttcgttttagtattttaaataaaaattaaaaaacaagaattaggcattgtgtactaagtattagatacatggtacaggcattaaatgctgaaatcttaggaggagggagtggttagagggaaggattgactgctgtaggctgaggtgataggaagacctgagaagagatggatctagggttaggagtttacattccagtgcaggagttctccatataaacactatcagatactgactttctggatgatctggagtattctttgttaatgtttttttgagacagaatctcggtctgtcgcccaggctggagtacagtggtgccatctcggctcactgcaacctctgcctcctgggttcaagggattctcttgcctcagccttccaagtggctgggattacaggcatgaactaccatgcccggctaattttgtatttctagtagagatggggtttcaccatgttggtcaggctggtcttgaacttttgacctcaggtgatccgcccaccttggcctcccaaaagtgttgggattacaagtgtgagccactgtgcccgcctatctgcatatttttaaactacttaggaggagaagtttttttctgatatttacaaggtatttcccccagcttttgtcatttgagtaatagctatcacaagaaaggattgttcttagagtatgttttcttttgagagatagggtttcactctatcacccaggttggggtgcagtggcgtgatcatagcttactacagccgaagactcctgggcttaagtaatcctcctgtgtcagcctcccaaagtgttggtattataggtgtgagccactgcacttagcctgtaatatcttttaaatagtttttttttttaatagactgtaggaactagagtgttatgctcctcttctgtgtttatgtggtttttccaaaaatgaatgttttttaggcaggttttcttaacagaggcaccattaaccttttgggactaataattatttgtcatgggaagctattctgtgcactgtaagaatgcctgatggcgtctctggcctctaccccctaaatgccagtaggaccttccctcaccctagttgagacaacaaaatttttccagactttattatatgtgcccttttgggggttggggtaaggtcaaaataatccccaaggctgggagcagcggttcacacctgtaatctcagcactttgggaggccgaggtgggcgaatcatttgaggccgggagttcgagaccagcctggccaacatggcgaaatcctgtctctactaaaaatagaaaaattagctgggcatggtcgcacacgcctgtagtcccagctacttgggaagttgaggcaggagaatcgcttgaacccgggaggtggaggttgctgtgagccgagatggcaacactacagcctgggcaatagagcaagactccatctcaaaaaaaaaaaaaaaaaaaaaaaaatccctggctgagaactattggattagggcctcctgtacctatctttgagggggaaaggatgctaccatcaacttttctgaatgccaggaatgccttttagtatagttatttcacttactattttatagcatattttaattgtatagtaagcattgtgtctgttttatggtaaggaaactaaaattgagagattaggctgctcgtggtggcttataccttgtaatcccagtactttaggaggccaggactttgaggccagtgtggtcaacatagcaagaccccatctccattaaaataatcataaaataataaaagggaaagattaaacctggagatggcatcatataaaccatgtataatatgggttacttatgctctgattgtttactccttccccccaccacaccctctcatttctttgtcccagctctaagaaaagcatacaatatccttttcctgtattctggtactgtttaaggctttgcagtgaagatggtttggtgagtcagaccacttttaaagaggaaattctacccttcccttcattctctctctttttataattgtggtgagagcccgggcacggtggcttaggcctgtaatcccagtgctttgggatgctgaggcagggggatcacttgagctcaaggagttcgagaccagcctgggcaacgtggtgacgcccatctgtacaataaaccacaagaaatgagctagatgttgtggttcacacctgtagtcccagctactcgggaagctgagatgggaggatcacttgagcctgggaggtcgaggctgcagtgagcattgcaagtagaaattcttaaagtgcaaccctgaggggggaatatcctccctcatttgtcaagggacaaatcagaatgttagcatttccccacttccctcattgccagtaacgtataatttaagcatgtggatatgccagtcagctttccacagcttaactggggtggagagaggtgtgcgaaccagtgctttgttctttcttgtctttttccccttacttttgtactcccactcctgccaaactagacatcgttttatcctggtgtgttcattaacctctactccaaaaattaagtgtggttaagggagtgaggtcgatttcaaaatgctgcatctgatttagaggggggtatagttgagtgaagaactaggcactgaagcagcagctcatgaggagagtgttttctctttatttaaagcccttacatatcgaggcatctggtgttcatgaaatagtctgttgtgctgttcaactttttcactcttttcttacctgacttagacaattaactcctagggctgggttttccctccacattgcgattccttcagggtcagattgtcttagtttctctctcttctttgtattgatactttatttttttggtgcttctcatttcttcaaatgtaatggaatgaggggactcagactttttctggtttgataatctagtgtataaatgacctggtcttttgatggttcatgaaatctttaactccgtcacctccaagtagccagcccttccatgtagtcttcatttcctatactagtgttctgttcctattacataaaagtcatgtacacgaaacattttgtaaacagccagtggggttttgtatcccatgctgttctgttttcatttccagcccacattttgggaatatgtttctgtggctttatttatatatttactagttaatcccagaacatttatttccacaggcttttgataaaagataaagttactaataagagtgtactattttaccgagtaaaacgacatagaaagctaaggatttccttgtgcccatctttctagaagggaaatttaaagagggctcttccagctctaatagttttataattattcgtgtctcctaagcctgatctttccccacaactaaaatgcgttgatgagctgcgtacctgcatgtatgtctttgtttgcactttcctagtaaattaacttactcaacaagggaactgaataatactttaaaaaaaaatccttgtgatatgaccaggaagtcaagccacagaggcttcatagctaggagcatggctgtcttccctaagccctttagattttaaaaaatactgctttaagtttgtaatgttttatgtcagatgtgctcatgacctggtgcttctgtgtcagcaggtatctccatacagccaagaataaagaaagaaagggatagatggaatgagtttcatcgtgattctaagtatccaggaataatttaaaattatttatcactgtggatttaagcatctggatttatttattttacaaatacttaacattttgttgttttgctctctatcttgctaatcccttttttaaaagggctacttggatgaaggtataaaaaccagtaacttatgaaaccctcggttggtatcagtgaattcgcttattactcaatgtttgcttgtttgacttcaaaaagaaaacaatttaccacctgtgtcagtctgacacctgctcttttcaaacccttttgacatgatctaaataaatctctgaaatcccccccccccctttgtgtctattgtcagtattagtttcacctaaattcagggcctgtcatcctgtgtaacagttgaggctaaatgaggacattaattggtggaaatgtgttgcttcaaaggcatttttaggaataaaactacaaagagcttcatagttgtaatatagctgattcgtcttcaaaaagtattctgttgttttcttgatagttttaggtttttataagtaagttattaagaagtgaatgtttgtctgaaatacgttgttttaagtgaaaggtgttatttgtgttctgggagtaagctctagaatctcaatgtcaggttagtatttaagtggaggtagagctactagtttttgtttaaaatgtttttatgatacagaattattcaggaacttgtgtattgatctgtttgccagcaatgccaattccctcaaaattcatagttttcaatttttgttttcttcccactgtaagtacctttgaggactctcacccagttaacatttgttgtgttcaaattgcatggttctcaacttttgctatacactagaatcacctgggtaattttttagaagtcctgtggttgtaccacagatgagaaaaaatacaccctctgggatgggatccaagcatctgtatgtttaaaattcaccaggagattccatgatgtagccagagtcataaatcactggtctaggatgtttttcagattagggaccatttaaagaaaagctgtagattttccttccagaaacatgggtattaatgattccctaaagccccaaattaagaacccctgttctaggagtagcctcaacatgctagatttaattgtaagcagctggtttaagaaattatgtaagttgcaatgatgaatattcctcgtcactcacaaatgttattcatcaatttaaaaattaatatgtatcaagtactcagtgtgttccaggcatgattttagttacaaggagtacagcagccaataagatattacagttttcagggagttttatcctactagggaagacagataagtaaataatgaccgaaggctagttaacaagtgctataaagagatataaaaaggaaagagcctaaggagattgaaagtgatggttatgggagagagatgtctatattaatagggtggtcagggaaagcctctctgaggaggtgacagtttgaatgagatctgtatgaagtgtgtgagcaagacctgtgaagatcttgaggaagagcattcaaggtgtagagaacacttgcaaaggccctaagatgggactgagcccggtttgttggattttcatcagtaagcccggggtggcaggagcatgcatgctgatccaggtatagaatgagtggtagaaggtgagatcaggagccctgtaagctgttgtaagcatcgttgttttaatttggtagaaactcagttataactcattcttaaatatttagctttatgcttaaaataatttagaaataaccttggacttccatctttttagaaatagctggaaggttagcactcagtatgttgtattacttctctgtgaaaggatctacagtagactgaacttgtctatgttatgagactgctcatgtctttattctttatattcataatgctgaacacaagatactcgtgttttttttttttttttttgacagaatagggatcttgcagttaacttagctgttcttaaatttctgtttataaaagccataatgcataataatttactgtagtcgttattcctagttttcccaggtaggcagtggtaacatctgtttcacaagataaggaagcagaaatttaacaacaatggcagaatcaggatgtcaatcttgtccttttttccttttcccactttgccatgctgccctctgggtaataagatggagactaatttttgaaggcttaatttgttgagccagtgtcattagtttttaggtaacattttaatacagaataagtgtgtcttggtcttattaacagtgctatgttatgtaaaggaatttagttgtaggaatattttctttgaaacaataatacctgtttttttatctcttgattgtaaagtgctgtgggaaatacagagatgacttgtaaataaattctgcccacaggcttaggggatctaagatataattcactgtggtaaaagatacaaagcaatcattgtcagaaaagatacagattaagtgccatagaagttctgctgaagaagaatttctgggtaaagggaaggagacttcttagaggatagatggattttagttctaggtggtagtgtgggaagcaagggagatgtaggtgtttagagggaaagaagaaaggacattctgtatacaaattgagcaaaggtttggaattagagcagtataagcagccacaatcatggaatacaatttggaatctagtatgagaaaaaggaaatgaccaaggttaatgaagattatactcatggaggaagcctttgagtatcaggccaaggaatgttaagttctattttttttttttttttggtaaggaaagtgacttttattttttatttatttatttatttttgagatggagtctcgcactgttgcccaggctggggtgcagtggtgcgatctcagctcactgcaagctccacctcctgggttcacaccattctcctgcctcagcctcccgagtagctgggattacaggcgcccgccaccacacccggctaattttttttttttttgtatttttagtagagacggggtttcatcatctctactactagccaggatggtctcgatctcctgacctcgtgatccacccgccatggcctcccaaagtgctggcattacaggcgtgagccaccgtgcccagccaaggaaagtgacttttaaatcagaaatcacatgatctgtgatggaatttaggaaagttgatattagttggttggattagcacaatcaacagactatgccctgtatgccaaatgcagtctaaggcaagtttttgtaagtaaagttttattggaacacagtcatactcattcacttgaatattgtctgtggctgctttagtactataatggcaagagttgtgtagttgagacggagactgtgtggcctgcaaagcctaaatatttgccatctggccctttacagaaaaagtttgccaacccctggattagaggagtggaggcagaaatcctgttcattgttgttctggttagggtataaacccatgccttcctgtcaaatgaaatgaaggccagaattgtgatagccctagtagaaaaaaagaggcaggctgggcgcagtggcttacgcctgtaatcccagcactttgggaggccgagacgggcggatcacaaggtcaggagatcgagaccatcctggctaacacgtgaaacaccgtctctactaaaaatacaaaaaatcagctgggcgcagtggtgggcgcctgtagtcccagctacttgggaggctgaggcaggagaatggcgtgaacccgggaggtggagcttgcagtgagccaagatcatgccactgcactccagcctgggcgatagagcgagactccgtctcaaaaaaaaaaaaaaaagaaaaaaagaggcaagaatgggtgagataaaataattttttgaatttggtaacttgattaggttaggagtctagggagaggggaggaatttttttttttttttttaagtgtaagcaacaggccaggtacggtggttcatgcttgtaatcccagcactttgggaaaccgaggtgggcagattacttgagatcaggcgttccagaccagcctggccaacatggttaaaccctgtcgctactaaaaatacaaaaaaaaattagcaaggcatggtgggtgcttgtacccagctgttcaggaggctgaggcaggagaatcaattgaacccaggaggtagaggttgcagtgatctgagattgtgccactatacttcagcctgggcgacagagggagactcccatctcaaaaaaaaaaaaaggtaagtgaaggaggatggtgatttgggttagaagaggcttttaattgtaagccattcagcatgtgaactcgtaaaaatgaccttatgttaaataattagttcagagcgctgatcttgagagataggaacgtttcctgtttttgataaatgataggttacccttgtttatggttaggggtgggtttttgtcatggtccaaccaggtgatagttatatatgtgaacatattaaaattgtttttaatgtttaaattctaatccttaaaatgtgacagaactgatttatgttcctcctctcccagttctcttcaaatcatgagagtgaccctcttaaaaactgctttctttcgggggagcggttgttgagaagaatcatgtaactatgtaaaaagcatgtctgtttggtacactatttgctaatgtcagaagtgttaaatagaaataaaatttccaccatagtagctaattattatttagtgtgtgtcaaaactgtgtgctaattactttttataaaccatcgcctttaaagtcttataacttttctatgaagtaggacgtttgtgtccctacctcctctgttttaccattgggaaaaccagggcccagaacgagtaaccacacaagttccacagctaccaaggtcaaggttatttctaccctaaatacacatctttaaattttatattcatcaacaacctagtacttaaaaattcagattcctaagcctttcaagggttttgcctgtgattctatttttgatctttgtaccaaacttcgagaaaataccgtcatatagtcttctattaacagcagttgcctcatgtggagaacacctgaattttacttacaacttcttccaatgctgacccattttgatttttataaacattttgaaatatttgttaagttggtcaagcaagagataatgtgattatgtagtatcttatcagttgagatctttctctctctctctgcctctttctctctcgctctcttttttttttttttttttttttttaaagagtctcactctgtcacccaggctggaggggttagtggtatgatctctgcccactacaccctctgcctcctagtctcaagcaattcttctatctcagcctcccgagtagctggcactacaggcgcatgctaccacatctggctaatttttgtattttttgtagagacaggatcttgccaccttgcccacactggtcgtgaactcctgaactcaagtgatccacccaccttggccttccaaagtgctgggtttacaggcatgagccaccaccccagtctggttgacgtttttcacctccttctctttacagcatattcagaaattttaaaccagtaatacgaaatacatatattggttgatttttctgttgtattttaagcatattgactttttaaatcggatcatatttttgcatgcaagtactatggcttttcaaggtcattctgatttgaaacaacacatttcttagtcaattcattggctctttacccccttttaaaattttttattttttatgtgatttatttatttacttatttttagtgatggagtctcactgtgttgctcaggctgggctcaagcagttcttctgcctcagcctcctgtgtagctggaactacctaaggatgtgcaccactgtgcccagccagatcttcaccttttccaaaaaaagaaacatctaaatgtgaaaccttttaggcctgtcaacttctttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagctgggatggtctcgatctcctgacctcgtgatccgccggcttcggcctcccaaagtgctgggattacaggcgtgagccaccgcgcccggcctcaacttcttgtgatagacacatacagaatttttcagctactctctgcctatggggtagccctaccttgcaggagcagtccaaaaaaaattttttttttcaatttaggatcagtgtagaggaaagagccctggactatcataagactgagtaccagcttggccagtcagtcactttgtgaccttgattaagctatgtaaccttttcaaattgatttccctctctgtaaatagagctgataagatggcttgccctgtttcctgtggtttttaaagaggatcaaatgagtgcgtgaaagttctcatgaaaactagacgtctattcaaatatgaggtggtggtattctcagaaggtcatagatgaatgatgcatttattttagtgcttttcacagtttagtctcaatactgagtgcttactgaggggttgtatggaggcacactagttgtttctttaggagatgtctttagctgctagagtagagaacaaaagaatgagtaaagaggcttcagaaaagctagtatgggctggcacggtggctcacacctgtaatcccagcactttgagggggccaaggtgggaggatcacttgaggtcaggaatttgagaccagcctagccaacatggtgaaaccctgtctctactaaaaatacaaaaaatagctgagtgtcatggtcgacgcctgtaatcccagctactcgggaggctgaggcaggagaatcccttgaactcaggaggtggaggttggagtgaaccaggattgcatcactacactccagcctgggtgacagagagtcactcctctcaagaaaaaaacaaggaaaagctagtatggatggagcacctccatgctcatttcctagagcttatgttttgttgtttgatttcctagttcataacagaaggggttttgtaagctgacctagcttgacaatcctttttgggttttttggtttcaaacatgatcttataaaattatttagtgcattaaaatgtagacccaagtagctgcttagctcttgagaaaaggctgtgtttcagtttagcacaacagtgttttcaggaagataactgttctagatagctctttttttccaaaattcttgattaaggtttggggaatttagaattatctccagctattaaattatcaaattggttaagtagaggtagaaagtttattgcataaatcagtagatttgtcttccaaagaagcttatgaaatagaaagggccaggaggtatacctgtagttgaaatatgggatgggcccatagagagtgagttggaaaatgatagtaagtggttgaacatggactttaaagcatggcatgctctgaagtcatattagaaaagtcctttgctttcatgcaaaactagtctccgtggcttttcattgtgtagatcgggttaaaagcagaatataagaagcaagtttttggatgagatgatagaacttaagtagtacttgtctgtcaatcctaaaagaattatttctggccaaatcctctcctctaaccaccaaataaggagcttgacttcattctcactgttaagaatcagaaacccagtttagaatatccaactcctggtgaacttttaaaaattaatatatatcttgatactttataatctattgtgtggcatccaacgaatgtgaggtaatctggggagttagaaatgccttgcatttcgtgtggaaaaggtgtagtcgtaagtttggcctgggaaggttaatactgtctttgcacatagaaagctaagggcagtgtcatcatcatttgtttgtgaggaggggactgaaaaagcaaaatcatcactactagcctattctaaaggatcttaatcccattacatttttcagattttttttttattatgtagtatcccctggatataatctttttggtgaagggggatgtctctaatttccacgtggtaccccctgtcatatacaggttatgtatctggcagtctacagctgcaattcatggctgtttataaaatttcaccagaacttgtcctgacgtccttttacttttgtaaatgattagaaaaaatgctgagcctgagtatgtatttttgtattaagagttcatttagagagtcccagaaattggcagagttgattcaactttctgtggtttaaatttgaatatgcaattagtagactgctggtatttcagaagtttgttgttgcaggcctcttgtactgaggaggaaatctggaatttctttttctattttaaattagcgttcattcaacaaacattttttgattatccctagagttttggcacacgataggaagtctagaactgtgcagtctcacctggtctcgcaagtaatgggaatttttaaactatgcaggacttagaaggtataccttcccttccttcagaatgatagtagtagtatagttatatctttccttgacctaattataatttttcgttttcccccccatgacaaagtaataaaaacttgtaaaaaacaaagagccacagacatgtgaaacttgttttacctctgctgttacttggtctgttgtaatgccactgtagaaaatactccctttgtttggggtagcataggaaacatgtgatttggaatcagacttcaagttctagctccataattttactagctctgtggtcctcggatatcactcaaccaatctggacctcaaattttctcatctcttctactgggaagataacaacttctttttttttttttttttttttttttgagatggagtctcgctctgtcgcccaggctggagggcagtggcgtgatctcggctcactgcaagctctgcctcctgggttcacgccattctcctgcctcagcctcctgagtagctgggactacaggcgcccgccacaacgcccggctaattttttgtatttttactagagacagggtttcaccgtgttaaccaggatggcctcaatctcctgacctcgtgatctacccgtctcggcctcccaaagtgctgggattacaggcgtgagccactgtgcccggcctttttatttatttatttatttattttttgagacgaagttttgctcttgttgcccaggctggagcacaatggcgtgatctcagctcactgcaacctctgtctcgcgggttcaagcgattttcctgcctcagctttctgagtagctgggattataggcgcctgccaccacacctggctaattttggtgtatttagtagagacggggtttcaccatgttggccaggctggtcttgaactcctgacttcaggtgatccacctgcctcggcctcccaaagaagataatgacttctacagaactgctgaatgggtacatatatgtaaatattctcacctgacttctgcttttccctttatttcactgggaggtattatatttttagtgtatcttacggcctttgaggacttcttagtttgagtatattttagctgtgtgcataaatgtctttacagtgtacttaaggagttggatttttagaaacttgccatatttagaaatctattggattgaacatagtttgaaaagcaaagtataagttaattcctttactatatacttgtactattcttttcatggactttctgatgcttgctgtttgtgcacataggctttgctttttgtatttatttatattgtatgaatctaagaataaaagagagtgtgaacaattcagaagactacagatatatcttgttaggttgctttccaaaaggttcccagttgtagtcataccagcagtgtaacaagcaggttttttgtttaaccacactccaattagcatggaggatcctttaaaaatatttgctaaactgataaataaaaaatactatctttacttaaatttgcattgggaaagtattagtgaagttgaacattctcatatgttgtaatgttttgttttgttttgttttgatacagtctgcagtcttgctctgttgcccaggctagagtgcagtggcatagtcgtagcttgctgcagcttcaacctccaggactcaagtggtcctcacaagtagctgggaccacaggagtgcacccttatgccccccttattaaaaaatttttttttctttgtagagatggggttttgctctgttgcccaggctggtctcaaactcctggactcaagcagtcctcctgccttggcctcccaaagtgctgtgattacaggcatgagccactgtgccaggctgttgtaatgtttttatgattctttgaagcagagatatttatcctttggtaaaaatattggagtcaaacttggataagttagaaattataaattgtttaaatttttgtctgttgatcttttgcctttagctttctttctcaacctaaaatagtagaaattcttcatccttccagacactaataggagaattttaaatttccttgtacatgtttttatttttggaaactacccttttaccaatatagtgaaaccttggctctactaaaatacaaaaaaattagccaggtgtgatggcacacacctgtaatcccagctgctcgggaggctgaggctggagaatcgcttgaacctggtaggtggaggttgcagtgagccaaggtcatgccactgcactccagcctgggcacgcagagtgagacttgtctgaaaaaaagagaaataaagaaagaaactacccttttaattcatcagagcgttttttgtttcataatacaaggaagtaagtcctctctaaccctctttccgaaaaagctgactagtatctcaaaaccacttaattttgtattactttctttgggactttggaagttgcataagacatacaggttaacttgtaaagaatatctttccagaatatgggttgccaaatttttactagattcatttagggtattttttgtgaggatactgtattcttgggcattttgttctttttaattccttttatgagtatacactctctgattgtcttttcttatttcgcacccagattttctgcagtagctcagtggaatattttgagcttagtgtaagatagaccgtttgtaaataaatgtaaagtattgcatagaagaatttatttgtcttagacccttaagcagcccctatgctcccccagtgaagttgatttagatgtgtagacaaccttgaggaaagagaagggctcttcagctgctctcctgtctccaagtttatctaaatctagggttctgtgaaatgatttagtcttcagtgtggattttgctctgtgggatagcctctgagtgtaaatgcttcctgtcctgagacctactgggtttaatgcatttgcttcaccttgttgtgtacactcacaggtgggaatataaaaggattttcagttcaaagaaccagataaacaattttcaatttaaaatgtttagttcttacataacttagttttgtaaagagaaatacaagtactttagttaattgttgagtacattgtctttttttttttttaaacaaacaggatcaatcactgttctgggaatgctttatctgaatttctgatcctttatgcatcctcagcatttaacacataaagtagccctgtgtataactttttgaggaactgcctgttttccattttatattaccattttgtattaccatgagcgatatttgtgggttccattctctccacattcttgccaatgcttctaattgtctttttaattatagccatgctagtcaatgtgaagtggtatctcattgtggttttgattttaatttctctaatggctaatgatgctgataatcgtttcaggtgcttaattggtcatttgtatatcttctttggagatcctttgctcatttctaaagttatttggtttttaaaaattgttgaattgtgttttttgtatatattctggagaccagtgtcttgtcaaatagatgattttcagatattttcttccattctgtggattgtattctcattttcttgattattatttacagaagttttaaattttgatatagtccaatttatgttttttttttgtttcttttgctttttgtgtcacagcataagaaatcattgcctaacccaagttcatgaagaatttactcctatgcttttttccaggagtttcaatgcttacatttaagtagggctttgatcgactttaagttagttttctgtatggtgtgaggtaggaatccaattttattttgcctgtggatagtggatattcagttgtccttgtaccatatttattgtaaagacctttttttccccatcatgtgttttacaatgtaaatttagttgtggaaacttatttgcagcttaaaattttttccggttgtatagattacatatttttcttctttatgctactctttattttccagatatctgcagtaaaattttggcaacaaaaatatatatgtatgtatgtgtatgtgtatatgtgcacaccagagtgctaacagtgattatttctgagggatgggatgggttgggatggaggaagggaagggattactttcatttattttttaatactttgaaattttattatgagcttttttggtgtagtaaaaaatagaaaaagtttttgtctctctggattatgctaatttacttgaattattgtggtggcctgtaaaccaggaccaaaagtatttttaaaaatttttgccttttcccttccctctctcctttttcttttcttttctttcccttcattccttcctctttttttaaggacagtatattctgagaatgctttcagttcgtggagggttagtttccaaagtcagggtgctgttgtaggagagggacggaaactaacaatcagttagtgcctatttttggtattatgcttttatgtacgtaataatccttcacatttttacagttaggcaacaggagtactagacataatgattgacttcccgaggtcacaaggcttagtaattggttaaaacaagaagtagagtcaggttcatatcactccaaaggctgggtttcctctgcttcttcgtgctgagtagtacataataagcaattcattgaatgcttgagtacacatgtgcacatttagatgggtgagtagtggcacaggtggaggaaatctggtggagaaattgatgttagagagaaataatggaaaatgagtaacttcaccttgagggaactaaaaattttgaattcagtgagagcaagtatttaattatatttgtcatggtatttaaagcatgttagtcattatatactttttttttttttttggcctatgaaagattttaaacttggttccaaaatgtggtcaaatgccctgtgaggatgagaaaataatgtcaatactatgagttcactttaataaaggctaagaggtaaatagacattagtaaatagacattggtttcctgtgatgtcctaggtattgttttagattatggggatagagcagcaatgaaagacttctggttttccatttttctgccttcctttttaatgaattggcactagtttcttccttaaaactcaagacttcttagcagattagaaatttgtaatggtaatagtcttgtgtctgatgcctttaggattgattcataagccactgggggtagttgagtgagaataggtttaatgaattctatcacaggattcctggttagaggtgaaatttatgtgtgtcctgtatgtatgttacttcatgacttctcctaatattgtgaactgtacctatgttgatgggttacagtgatgatcctttgactccagttcttactgtcaggtgtgacccttggatcaggtgaggaatactatctcatctttgtcttggacttaatacttttaaagtactttgaaccttagccacgtatgtattcacacaactagatgtgctgttgatttacagaactgaaagccattacaggtggagtctctctgatgtgaaatgtttgggaccagaggtgttttggattttggaatctttgcattatacagttatccttcagtattcttggatgacttgttccacgaacttccgtggataccaaatctgacagtgctcaaatccctgatataagatgggatagtatttgtgtataacctatgcacatcctcctgtatgctttgtcatctctagattacttataacacctaatacagtgtaaatgctatgtaaatagttgttacactgtattgcttagggaataatgagaagaaaaagtctgtacatattcagtacagacattgttttttaaatatttttgctgtttgattgattgaatccatgaatacagagggtcagctgtacttaccagttgaacatcccaaatctggaaacccaaaatgcttcaataaacattacctttgagtgtcatgttgacactcagaaagtttcctattttgggaactttttggatcttgggtttgggatgctgaacttgtatttgcatgtgtggaaagagatcaggagtcaaggcaggagtcaggaaatgtggcttctattcttggctaacttgatggtgtagggcagatcacttcactagcctaagctgcagtttgccactgttcactcctgagggtagctggagaggcttgagaacaaattttaacacactacatagtgcagacaccttttcatctgaatttttcctttgaaggatgagtcattcttatgaaacaattttcttttttttttttttttgagacagagtctcgctgtgtcgcccagacctgagtgcagtggcgtgattttggctcactgcaagctccacctcctgggttcacgccattctcctgcctcagcctcctgagtagctgggactacaggcgcccgccaccacgcctggccaattttttgtatttttttttagtagagacggggtttcaccatgatctcgatctcctgaccttgtgatcagcctgccttggcctcccaaagtgctgggattacaggcatgagctaccgcgcccggcgaaacagttttcaaaacagaaagatggaagtgacattatcaaattaagtgcacactgaaaacttttatgacaattgtatcgagggggtacatgtatttttcaatagatattgattggctgctatagtaaggatttttgctgggctgcgagaatcattttctaagtttgaggatgctaactaaatcatacgtaagttgtatgtgataaatatggggcagaaataggtatgcactctaaaagtagtaatagcttctggtttaaagaagtgggagatcataacaagttggaatatctggaaatatttaagaaaatgctttagcatgaagtattattttgactatcatttcagagaatgaggatgaatagagaataagtgagtagggtagaaagggacaaggtaagagggccaagaggcagaattaaaattaagtcaggggaataagtgtgaataggagtctggaagagataaacaattttggggggaaggatttgatgctcttagtgcacttgctgtttctgtgttatactgtactccagctgtgccctacactcaccccaaagaacagcagaaacatgtgttcaagagaagtgttttaatctggaaataattagggaattacaatttttttgaggtttagctgctgtttgtgggattcagttcccaaccctgaaagtaaaagtaaccatgaacattttgttttgttttttaatttatacacattccaggaaatactattttagtataagttggttcataatggcagttaaattgctcttgtgttttgccaccttggacaaaagtgcttttgtctttctggttttcttcttttggttttatttaattttgaaccctgggaagaaggatatgatgtaaatttaataaaatgagttttcctccctttttgttttttcctgaatcttcatggaacttttttggaaacgtggaacctaggtggggtgggtgacgagaaaggcctgagaaatgccaggaagacatgaggttggattggcctttgggcatccagtctacctaatgtgtttatgtcatgtatgttaccgttgaggaagtcagtgctgattatgccaaatttctactttttctggatcattttactccttagcatttgtaggggaagacatttatttgagcagaagagggtaacgatatggtccgtctctatatactactaagaaggatgattatgggtatgtgaacatgtgcatgcatatgtaaaatgaaacctaatccaagccttgtggtgaaaatactctgacaggcttcagagaagtaagagttttgatcaaggaaggtacatcaacctatataccctagattttttaaagaatgtatagattaggaattctcattttaaaattaaggtctttttgtgacttttaccatggattattattttcccaaatacatgaccctgtttgattagcatatagagttttgacccagggagaggatgcagtgcccagcttctcagtggttaacagctgttcagcctagtgcatatcagaatttatgtgggtgttgaatgatttttttaaactagtgtaggaacacttgataccttctcagtagttatgtgcatgtttctgtagtttcccaagctaatgggagagatcttcaaaatgatgaaattttattgaaatcaaatagatacattaagaaatggaaatgctgaatagagcctagtttgctctacatgctctttggcaaattgttgggtcactgagacattttaagatagcaatataggccaggtgcagtggctcacacctataatccagcacttttgggaggctgaggcttgagcccaggaggttgagaccagcctgggcaacatagcaggcccctgtcgctaccaaaaaaaaaaaaaaaaaaaaaaaaaagccaggcatggtggggcatgcctgtagtcccagctacttgggaggctcgcttgagccagtaaagtcaaggctgaaatgagccatgattatggctccgtactccagtctgggcaacagagttgagactctgtctcaaaaaaaaaaaaaaaaaaatgtatagttgaggggaaaaaaatctgtcacctttaaagtcttggtataattgaatcttttagaatgtctgcatcaaacctgtggatccttggttgtatctctcgttaatctgggtaagatggagagatttctcatggacttgtgtttgccaaccttccatactatgttttatgttttattgtgaaatattcagagagaccagtgcagtgaaccttcccatgtgtgcattgcccaactgtaacaggcatctactcagagctgttctttttttttttatctagaccaccccttacttggactattttgaagccaattctgtacaacatattatttcatctgtaaatatttcagaatctatttctaaaagataggcttttttttttccccaagttatttctccctgtgcttcttcaaaaaagatttgtagtagaggctgtatagagggcacaaaagagtagaaattaagcacaagtgataccgacttccagaagagactatcaggtagacccagacccataaggggacagcaacgagaattcattattggaagatgtcatactccaacccctactggtctctacaagatttccagacccccctacactttgaatactaaaagtacctcagggtttagttctcaacatcctcctctttcctatctctattcttccgccccatcttctgcccttttttttttggagaccgagtctcactctgttgcccaggctggagtgcagtggcaccaccttagctcactgcagcttccgccttccagattgaagtgattctcctgcctcagcctcctgagtagctgggctgacaggtgcatgccaccgtgctcgattaatttttgtattttttttttggtagaggtggggtttcgccatgttggccaggctggtcttgaactcctgacctcaagtgatccacctgcctcggcctcccaaagtgctgggattacaggcatgagccaccacacctggcctcctcgtcttttaagtaacattcatataacaatagttcgtaatttatattttcaggtcagctctatctcctttctgaagttcagactttatctgattgttagtcttgtaaatacattataaacgtttaatgtgtttatttttatttattttttattttttgagatggagttttgttcttgttgcccaggctgtagtgcagtggcgcgacctcagctcactgcaacttccacctccagggtccaagcgattctcccacctcagcctccccagtagctgggattacaggcacctgccaccacgctcagctagttttgtatttttagtagagacaaggtttctcaatgttggtcaggctggtctcaaactcctgacctcaggtgatccgcctgcctcagcctcccaaagtgctgggagtacaggcgtgagccaccacgccaggccatttaatgtgtttgtaatggggctcttgattccttctgctaaaacccagcttattccactgtacccttccatccccatccttcctcatgacagtgtgcagtaagtctagaagtcttcattcctgtctggtcactcccattcctagtcttctacaatactctctaaaatatatcttggatctgttgatttcactcatctccacagccaccatcatctctccttgaaccaatatagtaacctaataattgataattgatatccttgtattgacattttcctccaaaatctgttattttatattgcaactgaagtggtcatttaaaaatgtatcatatcatttctttggttaaaaaactccttcatgagtcgcgcccctaccctccactttcagttacctgaaaggtttccttaaaatttttcgaatcaaacttttaacaactattttgtaataaagataccttgttattgtcattgagcttttataaatctggaggcactttactgagctgaaaactatacaaaagcactaggctcttgggagtagagaataggaagattggatagcaaattttctttcacttatgtggttgcaaaattacctagtctatatccgtatctccatgccttgacgtgtgctttttcctgcctcatagcttttttcatagtatgttgtcattttttcctttctagttggagtgaagaatcgtttaccacctgtcttctgagagttgctttaaagtgctaatttctggttatgtttcatggtaaaatcattgcagctaaggtggtatgatagaatgaaaagaacgatgcccttgggtggggaagtctgggcgtgtgcttggtatcgttccctcagaacactcagtggtcctggtttcagtaagggtttgggatcacatacaacttggatttgaatgttaattttgcccattaaaaattgagccgcctttgacaaattactccatccatctcacacctgaacctcagtttttcttctgttaattggggcccagctgggctgttgtgaggacctgatgttaaaaatgtaaaaagtggtcaccctggtacttggcatataatggaccctaaacaaacagtctccatgattgtggttttgagcaggttattttatctcttcaggtttccatctgcttacttttgtttttttcgagacacggtcttgctgtgtcgcccaagctggaagtccagtggtatgatgatggctcactgcagcctcgacctcccaggctcaagtgatccttctgcctcagcctcccgagcagctaggactataggcacatgccaccatgcctagctaattcttgtattcttttcagagacagggtctaactatattacgtggtctcaaactcctggactcaagtggttctcccacctcggcctcccaaaatgtcgggattgcaggcaagagccactgaacctggcctccatgttctttatacgtaaaattagagggtttaattagggcagcaattctctaacattaatggtcatcacaattacctggagtgctgttaaaacacagattactgggcgcagatttgataatttatgattcagtgggtctggagtggagccctagagtatgggcttctaacaatttcccaaatgatgctgatggtaactacaccctgagaactattcgactggaaaattggattattgaaaggcccctgccaacactaggattttactgtttctaacagtaatgataataggcagtatttgagactatgtgccaggcattgtgcaaagcgcattatatacactatctcatttggttctcatggtaattagtaggtactatcttcctttaaagggttgggtaaattgttgaaagtcacacagctaaataaatgggaaggttgaaactgccctgacctttctcttgaccaaatgaattgcttcctttggtttctcaagtttttaggactcctgtatactcattttacttttttttttttgagatggagttttgctgttttggcccaggcaggagtgcaatggcacgatcttgactcactgcaacctctgccttccaggttcaagtgattctcctacctcagcctcccgagtagttgggattacaggcacgcgccgtcatgcccagttaatttttgtatttttagtagagacagagtttcaccatgttgtccaggatggtctcaatctcttgagtttgtgatccacctgcctcggcctcccaaagtgctgggattacaggcatgagccgccgtgcctagcctactcattttactttttacttacttggcttggcaagggtggtggtggtggtgttgctatctatgtctgagactgcaagctgggaactggtattcaaaacttagtttgtactgcatgatttaggcccttattatgtgttttattgctatcttgcctatcagccctatctcctcagtcaaatttataagcttcttgaggatgtggagcttgtcttttgattactgtatagtgctcagcagaatactgttcacattgcagtaattcatgtgatgaagatgatgggttgtcattgtaatcattttggcaggttcacagtaggcactcaggtttcaggcatagggtgtaccagttatttttgaataatcatgccatggcattcaagttttttaccagtttgcagcttttgcacaattaaggtatgacaaatgtaattttattgagggaaatgcttaatcagtgagctgaactttaatgtaaatttgaaatgaaaaggtcctgtgttctgatttcagattttcagaaactggatgttagatggacatcatgttagccttaataccatgccttaaaatgctacccatattttatttgtattcccattcacccattgatttgaacaaccatttttattcattgtagaagggacttaaataaatgtaaaaaccaggcaaaatttcttctcttttataatacatccttgatcatagatagaattttgtcacttctctgatatttaaaaataagacgggtggcagtttgagtatctataatgaggtgaagatcagcttgtgcttgaaaaccaggacagagggtttcaaagtgtaattgaaaaagactgtggcagtcttcttcatgtgctgggagaatgggaacatttgtcagtttactaaggttttgctttcctcttgtgctttatagaatttcttaaagaaatgtgtttattttacagtgaggactggtaatttcattcctctgtacccctgtaagtggtacagtgaaccacagatgtgttcaaagttagctgttgatatgtgatgagggaggggaaagaggagggacaaactgggatgttattttctatcttctatgtctagatttccttggctggagatgtatttagctgtgcagcagtgactgctgttctgtagagttctaaggcagcattacagggagaagccgtcttgaactgactctctaggtttgttgctattgtagtgttcggttaaaaaattcaagcccttgggaaggaatgtggtggggttaatcaaggtttcttgtttttgttttcgttctatcctttcctgaactgtttgtatgtatgaaacagccttttacaattccaaagcaggtccttttatctgtgctccaaaatgcccactgtgacccccacgtgttaacatgaaggctcaagtttgttgacttctgaaagtgttgtttctttaaaagacttttatttaaatcctctactttaaactttattgctgtaaattggtgattctcaacttgggctgcacattcagatcacgtgggaaacacttaaagggaaaatcccaggacccacccccgattaaattttgatttaatttatctggtgtgggtctccagcattcatgttttaaaagcctccctagttgattcctttttttttttttttttttttggagacaggatctcattcttttgcccaggcatgagttcagtggcaccatctcagctcactgcaccctctacctttctgggcacaagtgattctcccgtctcagcctcctgagcatctgggactacaggcacatgccaccatacctggctaatttttgtatttttagtagagatgggatttcaccatgttgcccgggctggtcttgatgtcctgggctcaaatgatctgcctgtgtcggcctcccaaagtgctagaattacaggtgtgagccactgtgcccagccctccctagatgattctaatgtatggtcactattaaggagtactgccctaagttctgtttttggagagtcctataaatttcttagtagaaaacaggtccacccccacccctaccctctcccacaagggagagttgagactgtccaatctgaatcttattcaaaagcacagaaatataatcttacaattttgcaaatacttagagtaggctttgaattatttttaaagtgatctccaatcttccctttaacagactttgcttgctaaatatattttgtctgtgttttaaaaacactccacactctgactgatttatcagattcctgataccagtaccacaaggacccaaggacctctagctgtgtttggtgaggcaggtctttgtcaatttaagtaatcctgtcagatggtgtagccaatcttgtaactcacgacaaagcactgttgctgagatactgtgatttattttccttaatgagcagtttttttatatatatacgttccattttcagacaggtggtgctttgagttgaatttgcaagttcagtgaaacatggatctcttttttatttaactcccttttcttctcctaaggtgcttaatttccatgcttgacatcgtaccagtatttgccagccaaaataaatgccaatattgtgattctgtagggaaagaagcaggtcatttattaattcaactagaacatactgcactgttcctttgttcaaggacctgaataggacaaacatggcccttgctttcatggtggtcaggtacattctctgaggggatgcagagatgaatagatttttttttcttttcatctctacattctattccattggcaaatcttggctccaccttcagattacattctgaaaataaataacattcctcatttgactgctaccatcaccctagtctaagctattatcatcctttgcctggacaaccttcgcagcctcccagttggcctccttgcttctgaagttactggtcatttatagtgtgtcgataacacatccgtgtccctcctcaaagttcttcaaaggcttcctgtcacacgtagactaaaattcaaactccatatcgtgagctgcaggctctagaggatccaagttctgtctgcttttatttacctcattggtgttgtctttatcacctctcttttggctctctgtgctccagccatgctgtttgccttgctcaacaagctaagtatattcccgcctattttcgattccttctgcctggaaagctttaatccagatctcctgtcagcttggctctgttcttcaccctgttcaggtctctactactgttaaaagaggtgttattgactgtcaactgtacaaggacaacttcactctctgtcctcttactgtgttttttttctttataacacttgtcacagtgacatttcttatgcacatatatatgcatacacacacttttttttggctttttaattctcttcttacctctggaatgtgaatttcctcctgttaggggctttgccttgttcactgctgtaacaaaggtaccttgaaacatatgaggcatccaaaaaatgcttgaatcgagtgaataaaattgtaactgacaagtatggtaaggcacaaggttctgtgagagggcctatcattgaactctcctttggtctctgccagtgtggctagagccacagagaaagcagaggctttgagtctatttactagagatagtgatgatatagtgggggccaagatcaagcagaatcttttgtgggacatgttaagaattagggaagcgaccaggcacagtggttcacgcttgtaaccccagcactttggaaagcccaggcaggagcatcacttgagcccaggagtttgagatccacctgggcaatatagcgagactttgtttgtaccaaaaaaaaaaattagggaaggggtgtttgggtatcttcgtagttattgtgatgttctattttaaattcatacatacatgagggtgaagtattaagttgctctcaagtcttattaggtgctgccactggtaactggtgtaggaaatgctttatcacattgaagaatttacagagaattgtgttctattcagtcatcagcatttaactttttttttttttgagacagggtctggctctgttgcccaggctggagtgcattggtgcaatctcggctcactgcacccttgctgtcctgggctcaagcagtcctcccacctcagcctcccaagtagctgggactacaggagtgtgccaccaccatgcctggtattttttggtatttttttatagaggcaaaattttaccatgttgcccaggctggtctcagactcttgtgctgaaaagcaatctgtccgccttggcctcccaaagtgttgggattgcaggtgtgagccaccacgcccataaaactgtttaaaactgtttctttttttgttgttgccggagcgggatctggtaaaaaccagaaaacctgccagattctaaaggagttgtaacattgctttaaaactgtttctaacttgatgttgttttgaagatgatgaatgtaggttttccagctcattttttattgttctttttttccctttcagtttgatttataagtgaaatttaatacccccattattgggaaaggaagatcctgaagagaacacagaattcaattccttttcagaaaattttgctgcttcaagctgtgcttgggcttcttatccttactgtaattgtgaggggtgaaaatagtcctttgaactttttatgaggaaagtggtgatgttctgtaaaggacatttatttaaatatgattgttattggcttccataatcccccatgtcatctgaccttggattagacccagtctgccagtctgatgagagagccagttgtaaattacctgttgaatttcctgtggatcccctctgttgttctttattagctccataatccagctggatgttactggttacagtttggctaatgatcatgaccaatttttgaagaaaggattccttattggcgggcaaatttttgttgagtggtacagccagaaacattttcacattattctttcctactttaggagctaaacttgcgggctgtttatgtatttgtttttagggtaatcaaattttttctttataacatttgtcacagtgacatttcttatgcacacataaagagtaaccagatattacactgtatgttttggaggaaactgttctggaagacctaggcctaaaactcacttaataatgaagttggggaaatagattacagttcttattaagaaaaaaaaatttcatgttttaaagcccccctttatttgccaaaatattccaaaatagtatatctccttgacatattatccagaacccaatatgccttacatgtttgtcataaagattgagaaaagcagtgtggtctagtggaaagatggagacttttactttttttttgagacgtagttactcttgtcacccaggctggagtgcaatggcgcgatctcgactcactgcaacctccgcctcctgggttcgagtgattctcctgtctcagcttcccgagtagctgggattacaggcgcccatcaccacgcccagctaatttttgtatttttagtagagaccagatttcaccacgttggccaggctggtctcgaactcctgacctcaggtgatccgcctgactcggcctcccaaagtgctgggattacactgtgcccggccgacttttactttttcagcagctttattgaggtgtgctgggattacactgtgcccggccgacttttactttttcaacagctttattgaggtatatttaagaatgcagactgttgagtcagacctgagtttgaattcctactggtactgataagctgtgtgactttgtccagattgctcagtctctaatatgtaatagtgttgaaataacaatatttgctttattgagttcatataaagattagaaaatgatatatgtcaagtaccaggcccttcaggtttcaataagaggtaactatttttagtattactaatactagcctgtagtatctctttctgtccttttggggttttaaagcttgagaatggaaatgaaatggacaacaatgatggtagaatctgttactagtgaacataatcacactaattgatcaaaagggtactctgacataagagttggctttgttttgttaatgagcaaggagtccttattctgcccattttatgtttcctttgaatgtagctgtcctgaataaagagtaaccagatattacactgtatatatgatttggtacggctggagataggagccatacacccctttggtcttgggagtggtaccccctatatggacagatgtatttgggatctagactctagatttagggggagtgcctttatttgtatgaaaatacagccatacctcagagatatcacaggttcatttccagatgaccacagtactgcaataaagtgaatatcacactaaagtgagagacatgggctttttctgtttcctattgcatataaaagttacatttacactatactgtagtctgttaagtatgcagtaggcttatgtcataataaatagtggactaccttaattttaaaatatttattgctaaaagaaataccagcgatcacctgagccttcatgaagtgagtcataatcttttttgctggtggaaggtcctatctccatgttgatggctgctgactagccagggtagtggctgctgaaggttagggaagctgtggcaatttctttccctccctccctccctccctctctccctccctccctctctccctccctccctcctccctccctcctccctccctcctccctccctccctacctcccctcccttcccttcccttccctttctttccttccctttctttccttctaattctcgatttctaattctagttatcttgctgtttcttcctcatctgcagttactttttcgacctgtgtcttgaacctctcagttatccatgagagtcagagtcaacttaactttgcatctgtttcagttttatcacgagattgcagttcagtcacatcttcaggctctatttctaattctggttatcttgctgtgtttttcacatctgcagttactttttcgagcaatgtcttgaacctctcgattatccatgagagtcggagtcaacttcttccaaactcctgttggggttgatattttgaactcctcccatgaatcatgagtgactcaatagaatggtgaatcctttccagaataattttcaatttactttgcccagattcatcagaagaatcactatctatggcagctatagccttacagaatgtattttttaaattataaggcttagaagtggaaattattgcttgatctgtgggctgcacaatggatgttgtgttaacaggcatgataacaggatttatatccttgtacatctctttcagacctctccggcaatggtgcattgtcagtgagcagcagtattttgaaaggaatctttctgagcatgaggtctcaatggtggacttaaaatattcagtaaaacatgctgtcaacagatgttctgacatcctggctttgttgtttcatttatagagcataggcagagtaaatgtagcataatttgtttttattttattttatagagacggggtcttgccgtgttgcccaggctggtctccaactactgggctcaagcagttctccctccttggcctcccagagtgctgggattacaggcatgagccactgcacctggctgatgtagtgtaattcttaagggccttagattttcagaatggtcaaggagcattggccttcaccttaaaatcaccagctgcattagctcctaacaagagaggctgtcctttgaagctttgaagtcaagcattctcctctctttgaagacaggatttctcctttctactctctagccacaaaagttttggattgtgtcttccaatagaatgctgttttttctacattgctgacatgttgtttaatggagccatcttcatcgatgatcttagctagatcttctggataacttgccacagcttctccatcagcacttgttgcttcaccttgcacttttaggttattggagatggcttatttccttaaacttcgtaaagcagcctccgtcatcttcagactttgcttctgcagcttcctcacctctctcagtcttcatggaattgaagaggattagggtcttgttctggattaggctttcagtttaatggaatgttgtggctggtttgatctatacagaccactaaaactttgtccatatcagcaataaagctgcttctcttgcttacgatttgtgtgttcactggagtagcactttttaaattttctccaagaacttttgcatttacaagtttgctaactggtacaagaggccttactttcagcctatgttggctttcaacatacctttctcagaagcttaatcacttctagcttttaaaaaatatatattctttttcttttttgagatggagtctcgctctgccgcccaggctggagtgtggtggcacgatcttggctcactgcaacctctgcctcccgggctcaagtgattctcctgcctcagcctcctgagtagctgggactacaagtgcgcaatgccacacccacataatttttgtatttttagtagagagggggtttcgccatgttggccaggctggtctcaaactcttgacctcaggtgatccgcctgccgccgcctcccaaagtgttgggattacaggcatgagccactgcgccccgtctctaaaaaaaattcttttctttcagctattttaccagaaaacatccgcaagtgtctatttctagcttttgatttaaagcgagagctgtagactcttccacttgaacacttaaaggccattgaggagttactaattggcctaatttcaatattgttgtgtttcagggaatagggaaacaagaggagagggagagagacaggggaatggccattcagtggagtagtgagaacacacatttttatcagttaagttttccatcttttatgggtgcggttcgtggtacctccagaaattacaatggcagtgtcagagatcactgatcacagatcatcataacagataatgaaaacatttgaaatattgtgagaattacccaaatgtgtcacatggacatgaagtgagtgcacgctgttggaagaatgacgctaatagacttgcttgatgcagggttgccataaacattgaatttgtttttttttaaaacagcatctgcaaagtgcagtaaagtgaagctttacttgcttgatgaggttagattacttcagtttctaacccacttttgtagtcgataggagatcacccccattatttctcagccagttaatctcgtggtacttttgttaggaatatgattaaaagtgtttcatatttccagtatgaatacttgtttaagtatttatggctgaatgcatctttatctttatgatagcagcctaaatatgcttgtgtcctacccatagatctgttcctaagtgtggtatgctttgtggctgtgttagtggctagaaaacagatggggacatcccgaaggcagcaggctagtctcctcaaactgtagacatttttttctgatagaggggcttgaagcctttaagagagtcaaaggaacttctgtgtttccagaatcagttactgatttgttgagaattggggctttatttttttagactgtagttgctagcacctgtatgtcacctttaggaaccttgacagatggtccccaacttactatagttcaaattatggtttttcaactttattatcgtgtgaaaactggaaactgtactttgagtacccacagccgttgttttcactttcagtacagtcttcagtaaatgagttattcatgctttgttataaaataggctttgtgttagatgattttgcccaactgtaggataatgtatgtgttctgagcacgttaaggtaggcccagctaagctttgatgttcagtaggttaggtgcgttaaatgcattttcatcttatgatattttcaaattatgatgggtttattgggacaaaacccccattgtaagttgaggagaatctgtacaccatagtttattcattcaacaaataattactaagtgctttttaaggccagaaacctcagttgctgcatttattttctagtggggtgggggggtcaataaaataacaaagtagaatatatatttggttgcagcaaatgctatgcagaaaaaaataaagcaggtaagagggataaggagtacaggggaaaacaatgcagtgataaatagggtcatcagggaaaaaggcctaactatgaaagtgatatttgtgtcaggatgtgaagtcagctgtgtgagcatttgtggaagatattttggacaaaaagaacagccagtgccaaaactttaaggacagagactgcctgaagtaatccggcaagcaaaccagtgtagcttcaacagcaagtggtgaagaggacacaggaggtgaagtcatagacagaaaagggaactgaggtaggtggagacaggttgtgtggaacctagtaggcctgttgtgaggattgtagctcttgctctaaggtagaatgccagttcctgctttgagtagaggagtgacatgatctgattagtttgtggacagaagcaaaaaaaaaaaaaagagttagggggctactataataacctagtgagagaatggtgtcttgggttccagtggtggtggtaaagtgtgagaattaaggttcaattctggatatattttgaagttagagcaggtaggatttgctgatgggctggatgtatgggttataaaagaggaaggaatttttggtctgagcaagtggatggaaggtattgctctttactgagatgggaagactgggaaaactaggtgggagcaggggagaagatcggagttcagtttatgttactgtgataaagataatgagatgctgaaacattctctctttgaatctagctgtattttttggtattgcatattgtaaaatttcgtggtaagtacatgttttacatttgtcaaaattcaaaacaaagcgaaccttgatgtaaatggactttggttaataagaatatgcaagtattggctcattaagtataataaatgtgcaaaggaaatggaagggagggtatatgggtactctgctgtctactcagttcattaaacctcaaattactttaaaatatagtctattaatttaaaaaattaatcatgttaacttacactatcatgttttctttgattgttgaggtcatttctgggggtctgtcttttatttagtgacagcatgttgacttgcccctcgctcccacttgtttctgacataatttcataccaagcatatatccacagtagacctcctttctttcatggaaatgcacagcttatataaatatattgtagaaaattgctgcttttacttagactaaaagacacaagagtcccctgtaacaaacagcttgaagttatttcatttcactgaggtttgtacagggttcctgaaactgtcctgtttcaggagctgccagataacctgatcctagagtgaaactcactttggcattcagattttgtctatgttgatatacctcaacagtttaagattcttttttaacttacatggctccatgaaagagggatgtgatgtttcagtgttcagttttggtagctattaattatcccttgtagccttccacttagaagtgatactttcagattgaacattgtttcttaagttttttcctttccacccctctctcttcttcttcagaaataaagctctgcatgtgtgttggtgtgttttaagtataatttttaatctgtttgtggaaccacagaaatggatccaagaggtaggtaaggtcttaaattgaatttgatgttaaataagctggcctttgacccataggcaatgagtgaggagcaccgttgggtgtaagactagaagcagaaatactaggcattttagaggccaggtgaagggtgaataaggacatttaggtcaattgaaataaaaagaaaaagacagatgtgaaatgtagaaggacttaattatggtaggaacttagtgatttggagcctggcagcctgagcaggaaggtgaaaacattgacagtaggcaagtttagaggaagagctagttttagatgaaagattggaatttgtacaagttgaattttagatgaagtgtagtggttaaaattcaggactctgggccgggtgtggtggctcacgcctgtatccccagcgctttgggaggccgaggtgggcagctctcttgaggtcaggagtttgagagcagcctggccaacatggtgaaacctcgtctttactaaaaatacaaaaattagctggacgtggtggcgtgcacctgtaattccagctacccgggaggctgaggtacgagatcagttgaacctgggaagcggaggttgcagtgaaccaagattgcgcctgggcaactgagcgagactccccatctcaaaaaaaaaaaaaagaaaaagaaaattgaggactctggagccagattacccgtatacagatgtagattttacctgtgcttgcttctctgacaaatgacctaaccccttgacaaatgacctctttttctccatctgtagtatggggatagtaggcaccgtttcatagagttgttataatgatgaaatgatgaaaagtcatgtaatgttgtagcacaatgcccggaacaaaggaagcattcagcaaaagctgctatgtataggatccagctggagaaagcaaattcagtagaaaatattaaggctggtgatacacatttgttagtcataaaatattggagctacgtgggatcttttaccacaatttttgtttacccctgttattttatccatgaagtgtagaagaggtcattaaaccttgagaaatggataaggcccatgagaaagaatgtagaatagaaaatttggactagcaacttaatctaggattattcttaaatttagtgtagggcaatggttttccacctctgatagagggaagcagtgcactgactattggttgtttatccgtcggcttttctactcttccttgcctccctcccccattaatggaatctccaatattgtttaagtatcctgtaattgtgtaattcaaaggatgctaggcctctctctggcttcagcaaggaaagttcatcaaaatgtggtctctagaccatcaaagtgtagtctttggaccatcacctagaaatctgctagaaatgtaaattctgggaccccatttcagatgtcctgagtcggaaactctgggggtggggcccaccaatcagcgtttagcaagccctgcatgcttaaagtttgatctctagtgtagggcttccaactgagataactttagaagataaagcatctaatgtaaatgaaccaagctttcagattagggatgattttgaactgtgtatcatgtgccacatctgaagggattggctactgtttagctaatagtcattaagaggcttgcagacccagtgctggcagatcttgtgtttgtgtgcaatagattttaaaatgctggcaacttactgaattttttttgacacacttgtgaaggccgaagaaaacccaactacaagcaaataaaactaacgtcgggaacatgaccctcagttagtgctcttttatctaagagtttaaaaacattgtgtgtaaagcttgcttcatatcacagattattaccttaggttaaatttctagatgtggactttttctggggtgggggtagtggggagtggtcatgggataatgacagttttaaggcttttgagaaatgttatgttctccagaatgaaactgctgttttgtcagcagtgttctgaagcctaacagatagtagtttttaaagaatttccaatttaataaacaaaaaagacattcttggattattttatttggttgatttagtagtgtatttcttttgtatttatttgtcacttttttatataaagaaatctgtaaatctttgtgtctttttgagttatttgaaagggtttttttgcattttaaaagcataattaaaatgcaaattgttttccctagctttttatttatttatgttttaatttttatggtttttgaatgatagaagttttaaatttctttagtcagatccatcagtctttgtaaaataccgttttaaaagcctgggcttttcattggaattagatagactctctgaaaatctttggctgctttgcgaggcatgcacatggttactgctgtgaactattcatgaataggatatccccttctccacctgccactgccaccatcactaatatctatttaacagacctttattgaatgcttactgcatacataaaaggaaactattaaaatggtgtggatacatcagtgaataaaacaaagacgaattcctactctcttggaatttacgttactggaaggagagtccatacacaaatttgtgagatagtttcttcacccataagtctggcagcttttaaggaatggctagaaagctttgcttggctgggttgcttcgtcaagtactgtgtgcacatggctgttcagcatggaattctcagggttataatatctcttaacatgaagtctctgtgctcagttgaagctgcatacccatttataacctgtcctggaaagtcatctagtaccacatccaccatattctgttgaccaaagtggtcacaagctccctcagatttgagggggaattgacagaaatctgcctctcattgggagaagtgtcaaagaatttgtaaccctttttaaaaacattccctcataaaaatttttttcttcacttgtaataaatgtaactttatactttctaaaaatgtaattttcaaacattacttcagtattactgttgattactgagattattttgccatttaaaatatattttcaaacactcttttggaagctacagatttatagatttttgttgtacatttaaaataattccctgccaacaagctgtgaaagggaaaagtaatgcaacttttattcactgatggaaaagttcttgagctgtattggaaaactgataagaaattggaggactctaaatgagtttttagagttaaggttaaagattgcattgcacttaaaagtaaagggaacctctggaagaggctggacagaagagtcacaaggttgataatgaattgacttattattccttcctgatctacttttaatattttgtgtcttgatagaaaacattattatagtttaataatgttttgttgttgttggtttttgttttttgagacggagtcgcgctctgttgcccaggctggagtgcattggtgccatctcggctcactgcaagctccgtgtcccgagttcacaccattctcctgcctcagcatgcctagtagatgggagtacaggcacgcaccaccacgcccggctaattttttgtgtttttagtagagacggggtttcaccgtgttagccaggatggtcttgatcctctgacctcgtgatccgcctgccttggcctcccaaagtgctgggattacaggcgtgagccactgcgccccgcagtaatggttttttttgactgtatgtctgtttcctttgaggactttacgtgctgagctatttctaataaaatctaaataactaactttaatttttgtgaagtataaaatcctatctcagtttgaagttgggtctagttttcactctgtcgtaagtttttcaggtcagttgacttatttataagaggcttggttccggggattcttctcgtctatgattctatagttagtaacatgagttataaaaccaatcagaaaatgtgccataaatggaaacgtttccaccgtagtttccaactctgaatgctccttatcctctgctttgtcacattggtaactactgtggtgataacttactgtccagcagttatgtggcatttgcctgatgtctgtatgcagcttaagcattttgtggttaccctctgtgatgagcctagagatctctggggtaaatgttaaaagcggtctgggtatgttttttaaatgccttagtatttctgcctgattgcaaagatttatcggttggctttcctaaagttgttggattgtttaagcatactttttgagtagagtcaaagtatcctataaataaactgtttttcattcataatgtcatagtaaagccttgtttttaatttagtttgaaatcacatatagttcactgaaaacccgtatatgcatcatgtaatacatatctaaagttatcttcgttccttgaatgtatactttccttgggatttctgtttagctttcaggagcagtacagtgggggtggggacgggggtaatatagaactgttgacactcgatagctttatactattttctcatctgtagtaaggagacagaaaatctgcactttctttttgctctttaaaaattcttgctttacaggctggacacggtggctcacgtctgtagtcccagtactatgggaggctgagatgggtggatcacctgaggtcagcagtgtgagaccagcctggccaacatggcaaaatcccatctctactaaaaataaaaaaattagctgggtgtggtggcaggcgcgtgtaatcccagctacacgggaggctgaggcaggagaatcgcttgaactcaggaggtggaggttgcagtgagccaagattgtgcattgcactcctgcctgcatgacaagagcgaaactccatctcaaaataaataaataaataaaacttgggtttacaaaaatacctgtttgccaaagaaaaaatgaaaaaaattcgtggactttagtacaaaatttcagtgaaatggacctaaatctggacagatctttagagagtgtctaaatcaaaaggagaaactgttaaaaagaaaaattgttctaaacctcatctaaacagaatccgtgtgatataattcataacctccttctgagaagaaatgaacatttctgttatacacttgtctgataaaccttaatgggattaaggcttctgctggggaactagttacctccccactcagatgactgtcatagtctaataactttaaacaagatattgtcattttttaaaaatctagtttacgaattagccattgccatttcctaatatagctctatcaagagtgtatatgtctttaaattagtatatcagagaccttctttcttgcttgaaagattgtaataaaatactgacatgtggtcttaactaaactgggaaaaatattgtaagctgttatcagcaatgtagaagtcctagggagaatttgatagtagtctaagaacattagaataaagtttttctagttttagttctgcatgttagggaatctttatccttcttcctcttcagatatttaagattattttgatacttaagcagcctgattcagttagatgttttagtttttttgtttttgtttttgtttgagagggagtctcgctgttgcccaggctggagtgcaatggcgcgatcttggctcactgcaacctccgcctcctgggttcaagcgattctcctgcctcagcctcccgagtagctgggacaacaggcgcctgccaccatgcccagctaatttttgtatttttagtagagacggggtttcaccgtattggccacgctggtctagaactcgtgaccttgtgatctgccctactcggcctcccattgtgctgggattacaggcgtgagccaacatgcctggccctgagcatctttttcttatcagtttgctttaacggtttgacagtctgacttggcttatgactctgggcaaatcatttaatcctttgggccccattttgggctcattttactcatttaaaaattgagatgcttagagatagataatctctaatgtttcttttggttttaaggtttttggcactttctgagtgggtgatttagatttagatttggcctcatggcttaatcaagatcttacaaagtctatgtgaatgttattgactaaggaattttcttgaaacatctgaaatgaattgagcctttcaggtgtctacctataaggactgtaccccctcccatgtaggttacatctgtacatacagggtagacttcatgcagatgatcataaattcattaacattttataaagaaagtgcctcgtaggtttttttgttttttttttagtccaactcatgagttttttggatgagagaactgaggagtatcttgaatgactttctttgagcatgatctaccgtgcgataaacagtttgccccacttatacctacaggtaaatttgagagacacaaaggcttgcatatgcctaactttaacaaaaattactttccccacatactctgcatgctgcatactcttagttttctgttgtattcttttccattattttttaaatgctgggtcatggcttaaacttctcccttgccattcatttgattgttaacagaccataacagctatttggtggcttagccaaagaacctgcaaacacgtggggccatgatggggctaaaaggcaagattgaccttggaaagctaagattttattcttatcagtggttcatatacagcaaggtttcttagtgtcagctctactgacattttcttgtaggaaactgtcctgtgttgtagtatggttagcggcatctctggcctctaccaagtaccatccccccacccccagttgtgacaacaaaaaatgtcttcaggcattgctagtttctttgtattctttgtagtcttcttcccacttaaattgatgtctaaaattatctgtcccggccgggcctggtggctcacgcctgtaatcccaacactttgggaggccaaggtgggcgggtcacctgaggtcgggagttcaagaccaccctgaccaacatggagaaaccctgtctctaccaaaaatacaaaattagcccggcgtgatggcgcatgcctgtaatcccacctactcgagaggctaaggcaggagaatcacttgaacttgggaggcggaggttgtagtgagccaagattgtgccattgcactccagcctgggcaacaagagtgacactccatctcaaaaaaaaaaaaaatttatctgcccagttttttgttttgttttgttttgttttttggagacaatgtctcactctcacccaggatggaatgcagtagtgtgatcttggctcactacaacctctgcctcccaggttcaagcgattctcccacctcagcctcctgagtagctgatactacaggcacacaccaccatgtccggctaatttttgtatttttagtagagatggggtttcaccatgttggccacgccggtctcgaattcctgacctcaggtgatccgctcgcctcagcctcccaaagggctgagattacaagcgtgagccaccactcccggtctggattctttttttttttttttttttttttttttgagacagagtttcactcttttcacccaggctggagtgcaatgacttgatcttggctcactgcaaccttcacctcctgggttcaagcgattttcttacctcagcctcctgagtagctaggactacaggtgcaccccatcatgcctggctaatttttttattttttagtagagatggggtttcaccatgttggtcaggctggtcttgaactcctgacctcaggcaatccacccaccttgggctcccaaagccctgggattataggtgtgagccaccgtgcctgtcttcattcttaatgattatataacactccctatagaggtgtacaataatatactcagccattctcctttgggaaatacagttgctttcagttaccttgatagtaaacattattgtattggtgctctcgtttctgtgggatcgaatcttgaaaagtggatcagagagcatgagaatttttaattaattttccaaaaaataaacttttctggtttctgcttttcttctgttctttaagaatgcctcccaatgcagtgattatgctaaagtctttaacacactttagatttatttttgtgtgtagtgtaagataggaattccctctcctttcttcccaaatgtgtagttggttatatcaatatcaacaattaaatacaatgttctttcttctgagaattgagatgtcatctttgcatattacgttgccatgtatacttggatgtatatgttgtattttgtggtctgctgatctctttgtctagtctagttcaaataccatccgtatctattgattatacttgttgtataatggcaattttaataattggttgggcagagtcttccttaatattctctttcggttgggcacggtggatcatgcctgtaatcccagcactttgggaggtggaggcagggggatcatctgaggtcaggagtttgagaccagcctggccaacatggtgaaaccctatctctactaaaaatacaaaaaattagctgggcttggcagcacatgcctgtagtcctagctacctgcgaggctgaggcaggagaatggcttgcccgggaggcggaggttgcagtaagccgagatcacgccatcgcactccagcctggacgacagagcgaaactccatctttaaaaattatctttcagtgttttcttggcaatgtttgaacactcattcacatgaactcaaattattgtgtcaaatttatcatcacatattctatgcccttctttaaaaccgcttaagaaatgcatcagacgtaaaataactgctccaacttaataatttaagggaaaaaaactacaattatgataggtagttatcacaaccaggaatatgacatgttcttgttatttgtttcactatagttttaattatttttatgttctctttagttatgcattgagtgcctgatacctagtgacactgctgtttttgtaatactatttctacctattactactgctttgtatctaggacatagctttttacttttctgactgtgcatttttattcatgctctattccatgcttgacctgctttccccacctcccaccccaaccttatttctctcctttcagaactcagcacaaatacttgtgattcttttcttgcccacagtattcttttccattagtatttctaaatagcatatatttgacaatcaaatactctttttatttgtttcagcatcttttcacagaaccttagtgaattcagagggtcatctccccccttcctccactttgacttatttttgagaaaattgatttggcagtaatacttgtaaatttgtatattccaactgttaacaaaaactctggcccagagcacctatgtcaagtcttggctctgcttgttagtggtgtgaccttagacaagttacttagccttattgtcttagtttccttattataaaaatggggcagtgatgatcataatacccacttgacagggttttaatgaggatttcgtgaattaatatctgtaatgtgccagaccagtgttttgcatggagtaagcacttcatttgtgattcctataatttctgttacttaattctcatgaggaaacactagtaaaatgaagtaaaacataaaccttcttattatatgactactgtgctttctctcattagaccagttaaaaatctaagcctttagctttaactatattacccttattcaaacacataaaagatttttcctacatgctaggtttttttgaagatgagtattgccagaaagctttttacgacttaagatgaacagttactgtggtcacttgttcctgtcagtagtcctaaatttaggatgagtttatcatcatcactgttctacagttaaggcactactgcagaataatctcccattgaagcagtctccctagtcaccctctcacccctctacatgcactttgctgtgcatgctggaatttgattcagaacaaaatgtacttgggtctctggttcctgtttctcaagtgtgtttaaggagtatacgtttttcaaaacaaatatttgtcattagatgtaagggcatagagtaccttgtggtaactgagttagttcaaccaggtatggtagtcagaagcttgtaagagcagcagcaacttcccatttactgagcacttataatggaatgctagactttaaaaatgttatgtcattgaaatcacacagccaccctgggagtgatatcttccaatttttaggatggtaaaaatgtccacctttgtgccctcagtcattctttaactgaaaactagctcaacctttgaggtctatgtcattaaaaattatttcttaagggtttttttttggtgggggtgtggtttttgagggaggcaaatttatataatatataatgatgaacatgacagaatatttttcaatttgatgtggcagaatcgaaatctgccaataaaacttaactatcttacacgtatcatataattcacgattctgttagtaagtggtttgcaaaagcatagaaattgagatgtgagaattttgtattttaccatgtgtaaaagcggaaacgtttttactctggaacatctatagtaccctcagcaagtttccattcaagttgtgtatggttgggattagactgggtgcagtggctcacacctgtaatcccaacattttggaaggctgaggcaggagaatcacctgagcctaggagtttgagaccagcctgggcaacatcgtgaggctccatttctatgaaaaaataaaattagctgggcgtggtggtgcacatctgaggtcccagctactgcagagactgaggtgagagtggttgcttgagctcaggtgattgaggctatagtgagctatgattgcatcactgcccttcagcccgggtgacagtgcaagatcctatctccaaaaaaagaagagctctcaaatatcttgttagtagttttcactttgtaatatagctttattttccctggtttgtgtatacttggactaagagtgtggactataattgcttgactcgctttcagcattagaggccagagttagttttatgaggaggccagagttagttttatgaggtctgttggcaccagatgagaaaaggggttagcttcagtctggaattactttggttttaatcttttgtaaggaaaagttaggatcatagttccagcctgttaccctcattccctctctcttcctgcttccttccttccctttgaacaaatatttgagtacctgccatttgctaggcattgttccaagcacccagagatattatggtgaacaagacaaaaatctctgttttccggatatgattctagtgggggaaacagacagtaagaaagatagataattaaaaataattttcatgaaggttctattaataaagccaggaagcgggaaagaaaggtgtgtagggggtatttggagaggggttgcaattttataggacagttaagggaaagccttaataaagtgtcatgtaaggaaatgacctgaagaaagtgaggatatctgctttaggaatagcaaataaaaggtcctgtgggtgacagcttgcctaacatgttcagcaaacagcagtgactggaatggaatgagccaggaggagaacaggagatgaggccagagaggtagcagggattgggtgatagaggctctctgtttgaggccttacagggtcgttgtcaggacttgggtttttagagatggtaaacaactaggctaggttttgggtagaggagtgacatgatcgaacttatccttttatacaatattaggctggctgctatgttcatgataatatcctgaaagtggtcaagggtgagagctagaagcccatttagaggctcttggactcatctagaaagattcaaccaaagtactaacaatgaagtggcaagaagtggctgaatactggatatatttgaagacagtgccaataagatttgccaattgagtgtgtttatgagagagatagaggtggtggggggttgaaattaaggattacatggaggtttttgacctgaacagatccatctagttgaagcaggtttgggatggcatataggagttggggaggggaaagtatcaacttcattttgatcatgtaaagtttgagacactttttagacattcaaatagaagtgttgagtaggcaggtagaaacaggaatctggagttgaggggagcgatttcagctcgaggtaggaatttgggagtcagaaacatagttggatacttaaagccatgagtttgggtaagatcacctagaaaggaagtataggaaagaagatttagtgatttcgcatatgcagtcttacaaggaattcaaaaagacaatagaaaagccaggttagtatgtcttgaaagagaagtggagaaagtatttgaaggagggagtactcacctttgttggatactggtgatggatcaagggtggtaaggactgaaatgtggaaattggatttagtacagtggaggtcattggtgaccttgaccagcagctttggtgcaatagtgggttgaaaccctgtgttaaagaaacagtgagaagagacaaattagaataatgagtatttgccgtaaaaagaaatagagaaatggggcaataacgtttcctctggcttcctattattagcagacctcctgatccatcccccttgctgttgctgcagtgcttccctggtattgaaggaaatacttcccttatatggaggcagggaatgagcctgtctgagatgctctttgttgctctcttggaagccaggaaatgccaaacttgggttaccttctttcggttggatagtgtttattagatgcttttgtcactgtgttgttcctttagtcctggggcctttaactagtttgccttcccttttctatctttcagagttttcctttgattgcctcttgtgttatttgcaggatttataattgtgcttagaacagggatgagctgggagaaagaatagagtctacaccaccttgcctgtaccagggtttcttctatttattcacttttttgtttgttttgttcctttttaccacatttatttttaagaactggtaagtttattaacaaattaatttttggttcaactcattttcttgaagatgggttctgttgctaaacctcagtgtctttaaggactatttctgaaaatatggtctcagctgggcgcattggctcacacctgtattcccagcactttgggagaccgaggtgggtagatcacctgaggtcaggagtttgagaccagcctggccaacatggtgaaaccccgtctctactaaaaatacaaaaattagccaggtgtggtggtggacgcctgtaatcccagctactcgggaggctgaggcaggagaattgcttgaacccgtgaggcagaggttgcagtgagccgagatcgcaccactgtactccagcctgggcgaaagagcgagactccatctcaaaaacaaaacaaaacaaaaaaagtatggtctcatagatatcttacataataactaagaggctttttcttcataaaggtacgtgagacttaactctctcaggcaattcttagacttactaaagttggagcattattcctggagattgtgcgttggaacttgtttgatttctcagtagctgactgggggctcaatgataatagctagctaagtggtggggccaggatttggaactcagtgttcactgactccagacaccatactcttttccaataaaccgtattttcaaagtgagaaagaagatgtttttctgttggatttagtattaaaattctctcattcttctagagatagccggaggcaagttctccctgtggaatatgtgggactggggtagtagggatgaaagggggaccctgcctcaatacactgtacttttctgctccttcacccttctgggggggtgtgtgtgtgtgtgtgtgtgtgtgtgtgtgtgtgtgtgtgtcaaggccttgctctgtgtgtgtgtgtgtgtgtgtgtgtgtgaaggtcttgctgtgctgcccaggctggagtacagtggcgcagtctcgactcactgcagccttgacctcccaggctcaagcgatcctccctcctcagcctactgagtagctgggaccttaggcttgcaccaccattcccggctaatttttgtatttttttgtagagacatggggtttcacctgttgcccaggctggtctcgaagtcctgagctcgagtgatcattttggggttttttgtttttgtttttttgagacagggtttcactcttgtcacctggtctggagtgcaatggcgtgatctcactcactgcagcgtctgtctctagggttcaagtaattcttctgcctcagcctcccaagtagctggaattacaggcacccaccacattccctactaattttcgtatttttagtagagacggggtttcaccatgttggtcaggctggtcttgaactcctgacctcaagtcatctgcccgcctcagcctcccaaagtgctgggattacaggcctgagccaccatgctcggcctcaagcaatctctttgaaagagaaattagtatcacatacagaatttgaacattctaacctcagtttaacttttgaaaggaagaaaagtagacagaaaattaattcactctggaggagctgctctggaatggcagtactttgaataactgagagcctttcactatttgtcatttgctttattcttgaaacataacagtcttattctctaaagaagacacagtaggccatgtgcggttgctcacgcctgtaattccagcactttgggaagccgaggtgggtggatcacctgaggtcaggagtttgagaccagcctgtccaagtgaaaccttgtttctactaaaaatacaaaaaattagcgaggcgtggtgacgggcacctgtaatcccagctacttgggaggctgaggcaggagattcgcttgaacctgggaagcagaggttgcagtgagccgagatcgcaccattgcactccagcctaggcgataagaacaaaactttgtctaaaaaaaaaagaaaaaagacacagtaagtagcctagtattttgctcaaaatcttcatgctcaaattccatgttcagtcctacagccagtcaagaactgtaagccatttccatacttctttgtcatgccattttttcctccattagaatacttcagttaagtgtttttaaaatataaacatttgagaattaaacaggataaggcatcagctaaaactctctcatattgtttatattttttgcaaatttacttgtaaactacatgtgcacagacatcattaaaaattgtcttacagttaaaacacatggtagttcccataaggaggcatggataatctagttggagaccagttatatatatgacatgacttggaaataatagcacatacaaataacaaaataagaggatccaactaagcttgaagaggacaaagagtgaattgtgaggtacgatgcacaaggaaaaactttcctggagagacgtgggttttagtgttagaagatgcttctgggtattttctggttggaaatttgcatagggtatgacaaacaattacatttcttttattgtgctaggcagagtatataatatgtatatgtttaccatgtttgatgaaaaatctgactgacgggtattgaaaggagtttaaagtaccttaaatgatttttaaaagattgagtgtattttaaaacatatctcaatcttaaacatgtaaaaatttaatgtacaaaaaaaatttatcagctgacctacagaaaatgaaatgtatcaaactactaaaggttgtttgtttgtttgtttatttttgagacagagtctcactctgtcgcccaggctagagtgcagtggcgtgatcttggctcactgcaacctctgcctcctgggttcaagcaattctcctgcctcagcctcccgtgcagctggaactacaggcccaggccaccacgcctggccaatttttttgtatttttagtagagacagtgtttcaccatgttggtcaggctggtcttgaactcctgatctcaaatgctctacccacctcagcctcccaaagtgctgagattacaggcatgagccagcacggccagcctagaggtgtcaaattatcaagtttagaagtatgggctttgtgttaaaggcacagtcagtaaaatccacaatggaggaaattctaaaggacagatagtgctgtctcttccacagattgtgaggaaagaaaatgaggaggagcgtgttacgagcttgtgatgtattaagtaaatgaattgtgtggatcttatttgactctgatttggagaaaactgagacaatccaggaaatttaaccagtaactggatatttaacattaaggaattattgttttttagattataaaatatactggtatatattcttaaaagaccttacattttggaaacataccgaaatatttagaggtgatgatgtgatgttgggaattggcttaaaaataattcatagggatgggagatagatgttatagatgaggtaggattcgccaaaagttgatagttgaaattggttgatggttttgtgggagtttattatcttttagcttgtatttgtaaattttcattcaaacagggtctgagataaataaaagagcatgaggaaagatgaggattgcttatattgttttataagattaacatggattgccaggttctgtgtgacctggccctgcctacctgtatccattgtcaagttgaatgaattcttttcgttgttcactgttggagttctaaccacataaccattgtatacatgtcgtttctttgtgacacaccacagttccacctaatgtcttctgctccacatccccaagccctaccagtttgtgcatccaagtcctattttatgctttggaggtctgtttaaatatttatatcacaagtctttctagatcccccagtctaaatctgacatagttaggatctcttatcgtatattttatatgattatttgattattaacatctatctgccccattaaattgtaaactttagccacagttcttgtttttgcatccctaacctagtctaattcttggtaactaatagttgcttaaatatttgttaaatggaaggaagaaggatagagtgagttcatggtgggctaaatgcttggctgaaataaactaccaaaactacacaaatttcatttaaatattagaggtaatctagttgaagtagtaagacaaaagtgctgtgttcaatttcaagggtctgtcaggatgaattggcagtttaggtagaattggctctggggctgggtgctgtggctcacacctgtaactgcagcactttgggaggctgaggcagacggatcatttgaggtcaggagttcgagaccagcctggccaacacggcaaaaccccatctctactaaaaacacaaaaattagccaggcatggtgacaggcacctgtaatcccagctactcaggaggctgaggcaggaaaatcacttgaacccgagaggcagaggttgcagtgagctgagatcgtgcctctgcactccagcctgggtgacagagcgagattccatctcaaaaaaaaaagtattggctctggtacatttgttccacattactacagatatctgtagaaagctgacacaacctaggtcatgtgacagatgagaatgggttaagacgaagtatgtatccgagttttttcctgggttttactttacaactaaaatgtgggatatttaactctggacagtttggttctcttctttttctccttgtgctttatcccctccatctttttaaatttggtggtaatgtcactgataatgcaatgtctattctaatagactactttgatttttctgtttagagtggaacttttagatgactctaaagttcaaagctcaagaaactctcagaatatggcttgttgctaactgaaaacacttgtttcctgaatttatctgagaggtttttctttaatcttattctgtttttcttccttttttgtacctttttgatacggaatttaaatccatggttataatgactaaattgttatttctttttttttttttttttttttttttgtagacagagtcttgctctgtcccccaggctggagagcagtggcacgatctcgactcactgtaacctctgcctcccgggttcaagcgattctcctgcctcagcctcctgagtagctgggattacaggcgcgtgctactaagcccggctaatttttttttgtatttttagtagagacggggtttcactatgttagtcaggctgatctcagactccttatcttgtgatctgcctgcctcggcctcccaaagtgctgggattacaggcctgagccaccgtgcccagctgactaaattgttattcttatctaatacatacattttaggttgcagttaggattacatcattgtatggctatcacaactttgtgaagcagatgttgttcttatttgcagaggtcaatttatatgtttaggatcacataaagtaagtaaaagtgagaacttgtctcctgatcttccctctgtttcacactgcttttgagctaggtagtgagtacttgtgagtggttttttgtttttgtttttttcatgtgactcagcaatttcaagatttctcattcctgccccacagtgaccctaactcttaccctgaaaactgttaatctggcaattgtacgctctgggatgatctcagttttatttgaatcttttggtttttaaaagttatctaaataacctggagatttcagaacttagatgtctcaggatttcctgcacacttggaagtagcacataatcctttgtcaatttatctaccagtgtgaatgtagcactgtgtagctcactgtgaacagtcattttactttagttggctaatagaacctttgtttcattaaaaggaaagaatcgagatgggactgaaatcagaatcaaagttgaaattaccaccattcgggtttttctggcatgtttgttgccttaatgagatttaaaaaaatttatgttaatacatcagggaagagaagcataatccaccagccctgttctactggattgacatacaaatttcccatcttagaatagaattaggtgacttaattagaggcactaggcctggtagtcaacatgtggtgttccatgtggttcaatgtctagcttttggtgctacttatctaataaatacaaaagagttgatctattgataatcccttttaaacccattgactattaataactttaaagaactaaaaacaaaaattaatttttagccaacatgtaagctgaaccctgaatttgcaaggaaaaaaattaattacttttactgtatggtttaagtgtgtttatagagggcgctttttttttttttttttggggagagggagtctcactctgttgtacaggctgaagggcagtggcgtgtggtctgggcccacggcagcctccgtcacctcctggattcaagcaattctcctgcctcagcctcctatgtagctgggattacaggcgtgcgcgactacgtctggataattttttttatttttagtagagatggggtttcaccatagatttcaccaatgagaagtcttaaaattgttgagtcacatgaagaaaacaacaaaaaaccattcacaggtactcactacctagctcaaaagcagtgtgaaacaaacacaggaaagatctatgttcttagagtcaacagagcattctcaattctctgtggtaatagtctaactgtgtaaaaagaacgattaaagtacaagttcatagctaatgaaatatttatatacaacaaatatttcttatgtaaaccaatactagcacatagctggttaacattaaggtgtactattcatgtggtgtcacaaaagcaaatattgatactgcatttaggtaaccaaaaagtaattcatcatgtaacattttaatgaatttttgtatagcacatggtgacaaagccatttttaccaataaaaagtttataaaagcaatgagcaaaatacgagttgaaaagaattcccactcaggtgataactacagtatatatagtacatgtttttgtatggactaggataaagcacacggtaaaatcaaacgttctaaggcattctagtgtcctactcaggcacatagttaaaacagttatttcactaatagcacagaaacaagcatcaggaatgagttgactcatcagtgttagaatccacgtgattttcttcattattgataatgactatattagaaaccaagtcctcattgtatttaaagtattattctgcaaccttagtcctgtgttctttcctgaagtctgtatggtataacattaaacatgtccctaatgttcaatgtgtgtcccttgttttgagctgtaaattgtcagagtgataaatttacacttcgaatattgaggaggaagtctatctttacctctgataagctgagtttatatagcttgtatttgttttttttttgttttgttttttttttttttgagacggagtctcgctctgtggcccaggcgagagtgcagtggcgcaatctcggctcactgcaagctccgccttccgggttcacgccattctcctgcctcagcctcccgagtagctgggactacaggcgcccgccatcacgcccggctaatttttttgtatttttagtagagacggggtttcaccgtgttagccaggatggtctcgatctcctgacctcgtgatccgcctgcctcggcctcccaaagtgctgggattacaagcgtgagccaccgcgcccggccgcttgtatttgttaaggaacaaaagatgtgaagctcttattcttgtgttactgtttagtggtgctctgctctgccactggagtatggtaacatcttcatatcttatccagacttgttaactgtacacctctcatgcttaataacagtttagctttctgctcatattgctggtattttgaacacaagatacttcttggacgcttgagttgtggttttccatttttcattggagatgatgagagtttgagcagcattatggaagaataatgttgtaacaactttctcctggaaatcacttcgagttctaaaccatcacatcacagatacacttgtaaaatgaaacttgttcataaattgggaattgttagtattccttagtgctgtcttgcctttctttaattagtttattaaccatattatccaaaacatattatcaggaggctcgctttgtattgttatttaggtaaatacctgtgtaggggacataagaccttcattaatatccaagaaaaagtgtatttatcaaagttcttgcgaactaaaatgttttaagtaattttcttttccttttgtattttcaaaggagctgcatggttccttaaacattagaatgccaggatgaaaaaggtgtgaggggagttgattgaggaaaagtagtatgattgactggtgttgggaagagcagctaaggaggctgttggggttgcccagtggtgatagatggggacctggtgtggtggtagttttaggaatgaaaggaatctataaatccaaaagattttgcaggatagaaaggtggtaagccttgaaaagtaaggaaaggtgggaataaaatacgagggttaactagttttgtctctttgtgggtagggggcatttttgttgttcaagaatgatccctagtttcttattgatctcttgagatcatttcctggatttagggtagagctagacctgcagccaacattgaagcagataactgtactttaaaagtatctttttatcttgaagtggttccatcaaaattagggaactgtaaaatgttttctttctaaaagaagagacataattgataattatcacagtggttggtttgaatggtttatgtttggtccatacaaaagttaaaataccattactacccttggtcttaattattatggtatgattaagtattaattcatgtcttactctgtcgtggtcagatttgttcttttttatttttgacattttgtattttgcccctatgggagactgtgttcaagttcacctatagtcataagttttagcagtgagtgtgtgtatcctgatgggaagtggggctgagggctgtgtgactgctgctgctttctgggaaaatagttttgtggtagattatgaaatatttagattacagaatatagtagacaccatgtatccccagtgtaatatttaaacaatgttaatgttgtcacatttccatctttgtttttttacatgagaagtcaaacattataggtagagctaaaatccaacttctccatcccctttccagagataatgaggagcttgattgtaaatttgttgtatgtcagttttaggcattttaaaatatattcatcagttatctgtattggtaacaatccttattaatgtttatttgtttatttttgtgcagcttttgcattccccattgttgagattaggtcatgttgatacatacagtaaataaattgctagatagtatttcatcaaattccttcactacttgtgtgtacttaatcttgtttagtttttttgtagttgtttcattcaacattgtgttcttagatttaatcatgttgatacatacagatgtcgtttatttttattactatagaactattaaatgaataaattatagtttatttaccaagttcagcagaattagaatataattagtttttatctattacagactctcctccagtgaacctgtttccttatgcagaggaatgtgtagtttatgttctcagaaacagaatttcatggctgggcatagtggctcgtgtctttgggaggctaaaggtcaggagttagagaacaacctggacaccatagcaagaccccatctccacaacattttttattaaaaattagccagtggggctaggctcagtggctcacgcctgtaatcccagcactttgggaggctgaggtgggtggatcatgaggtcaggagatcgagaccatcctggctaacacagtgaaaccccgtctctactaaaaatacaaaaattagccaggcgtggtggtgggcgcctgtagtcccagttactccggaggctgaggcaggagaatggcgtaaacccgggaggcggagcttgcagtgagccgagatcatgccactggactccagcccgggcgacagagcaagactccgtctcaaaaaaaagttagtcagggctgggtgcagtggctcgtgcctgtaatcccagcactttgggaggtcgaggtgggcggatcccctgaggttgggagtttgagaccagcctgaccaacatggagaaaccccgtgtctactaaaaatacaaaattagccgggcatggtggcgcatgcctgtaatcccagctgctcgggaggctgaggcaggagaatcgcttgaacctgggaggcgaaggttggtggtgagccaagattgcgccattgcactccagcctgggcaaccagagtgaaagaaactccatctcaaaaaaaaaaaaaaaaaaaaagaaaaaaaagccaggtatgtagtatgctcctgatcctagctgcttgggagactgaggtgggaggatagcttaagcaaaggaactctaggttacagtgagctgtgattgcaccaccacaatccagcctcaatgatagagtgtgagaccctgcctctcaggaaaaaaaaaaaaaaaatacagtatcatgatggttgggtatgcacattttacacctcgctaagtattttcaaattatttttcaaaaatggtggttccaattttaactgttaccagcaatatattaattgctcttttccatttctcaccacctgttggctttatgagactgtgcgttttcccatccagatttcaaacagcatcttaatgttttacctaatatttatattttaaccaaattttaacgagatgacacatttttatatatttattatttgccttttatgtgaatttcctatttctgttaagattgtctttttttcttttatcctatttctgagagttctgttacatattctgatgtttaatcgtcagttatatgtgttagatatcttccaccaaaatgtagttggccttttaactttattagattttctattgtatgttgaaaagtaggtgaaatctttgtgtattatctaagaaatgctccctgctctaagtcccgaagatattcttttaagtttggctgttcatatttagcaatttgaaatgccaaaattttgtaattatatcatgaagaagggaactaattttactttttcctttaaagaactggccagtttagtactatttattgagtagtttgatcgtttctgcactgatctgattttttaaaaatttcccgttatcttttatgtatctagttctacgttttgaggctctctatagttttgcagcaaatctggctgtctggtaatgtgtatttgcatcatgccttcttgcaaatttcttgctgttggtcctttattccatgtgaacttttagatctgtttctcagctttcattaaaaatactgtaggcaatttgattggaatttctttgaatttatagatgttcatgagaatcgccatcctaaaaaaatgtgtcctaccatttgtatagatcttcatgctttcaggcgttattttctctgtaaagatatttaatatatcattagttttgttggtgttatgaatggtacttaatgatattttctactttattagtttttaaatattctttactgaacacttttgctgaattctttattagttttaataattcttagtgtcagttggatttcctgtatagattattcttaatgtatgttttattttggcatggacaataattttattgtcccagagaaattaaagggatttcagagaaactgtgtgccacaggatcaggatgctagaacgcagttccacttaatttgggaaatacctatttggaagtttatatccatgtgcatcctgatgagcgggaggtgtcttgtctctctcttgggtttttcttgacactagagttagtctctgcaagggcctttaaaagttaaattccactccccaccccccaatctggtatagatattactgctactcttggatttcactcagtttatttccttttaggagacgcaggtcagaatggaaatgggctgcagaccgggcagctattgtcagccgctggaactggcttcaggctcatgtttctgacttggaatatcgaattcgtcagcaaacagacatttacaaacagatacgtgctaataaggtaagggataagtatctgatgtttttaaatgctgccgaaaactatcaatatcgcttttctcacatcccctcccacctcgtaacccccataaccctcttcttaactattgcaaagtaaatggtttaatgacctgatatagtggtttaatttaagaacctgatgtggctgcgcgtggtggctcactcttgtgatcccagcactttgggaggccaaggcaggaggatcatttgagctcaggagttcgagaccagcctgggcaacatagtgagaccttgtctttacaaaaattacaaaaattagttgagcatgatagcatgtgcctgtagtcccagctacttaggaggctgaagtgggagtatcgcttgagcccacgaagtggaggttgcagtgagccaagattgtgccaccacactccagcctggacaactaagaaaggcctgtctcataaaaaggaaaacactattagaatataatgtttaactgaacgtgtatttagaacaaaactgtgtgggtatctgagctaacaggaaacaaggaaaacagactgaataatgcaagcaagccattgatgttaactgtcatatttgttagatttatatttgttagttccctgttataaaactgccacatttcatagaacttaagatgctactgatggtaagatgtaccattattttaagtgcttactgtgtctcagcagtgttctcaaaaatcctaccttcatgaagcttacattcttgcaaagtattttttatattagcttggtgtggctgagctctatctttatgtagacccatgtctagaaaaagtctattgctactaaaaataagggtcaaaatgcctttttgaccttagtactagtcaaagccttaagaaaatggctttcctgtgaacagtatccattaaattagtaggccaaaagttgaaggttgatcaactgataaaatgaacagaatgatcagggtttgaagtgaaagttctgtgggctatctaatcatttaaacttttattctaaaaatgtcactgcggacttatagcttctttccagattggagatacatatatatatatatattccccctccccctaaaagttcaatagagcatactttaattgaggacacagtccagagggctcacttttttattcttactagtttgttcccttagggtagcatacaaattaaatcctgatttacttatttaaaaattagctggaacaaaactaataaacattctagatttggtgcatattttgctttcccaagtcttcacaaaggaaattttaaagtgagatttgtagaacttgaactggaatgatgactaagaataactaggaggtgactggatatgcctgtactgaggagaaaaacacagtctttctctatcagagacacctcttcagtgtctgtttctaggtttttatagccagtagttaagtgggattttctatatttgagaactagagtctcttagtaacaactgagattagtataatagtagtcataagtgctgcttcatctttttatatacattcataaatatatatgtgggtttatatatgtgtatatgttatatcatcttagttccttgttataaaactgctacatttcatagaacttaagatgctattgattgtaagatgtaccattgttttaagtacgacaaagaaattatttcagttaaaccagggcataacagaaattgtaaaatgcatcttgatttaaaagttgttgacatgtggggagagtacctcttagaattgatgaaatactgtgtatcaattctcaggaaactgaaatgacatagaagtataaaagacacccaccctccccccccccccccaaaaaaaaaaaaacaacccaacagctcaaaattatctcgctaccaacattatggtacattttcctagcacataagtaatttgttcaaatacagtcatgttacgtatgtgccctgaatatttcccagttggtttttggaaaacatttttaatggctgcatgctattggctttctttgttgactatttaagttacatttgttatttaaattaaatatgccatgataaatatctttatctcagtcaaaggtatgaatgctcttttatgttcttaatgcattcttcagagaagtattttggcagtgtcagtttatagtctcactagctgtgtataagaagatactcacctcatttggttcatgctttattcttcagctcatcactcagaagtaatgacagagcaattttcagaaactttcaaaatatcaaaatatctgaaaagtatttctaaatatctggaaaataatctggagttttgtatataccatcacacattgcttaacaaaagggaaactgagaaatgtgttgttaggtgatttcattggtgcgtgaacatcataaagtgcacttaaattcaagctgagggccgtgcgcagtggctcacgcctgtaatctcagcactttgggaggccgaggcatgggagtccaaggtgggtgggtcacctgaggtgaggagttcgagactagcctggccaacatggtgaaacccctgtctctatgaaaaatacaaaaaaattagccaggtgtggtggcgggtgcctgtaatcccagctactcgggaggctgagacaggagaatcacttgaacctgggagacagggtgcagtgagctgagatcgcgacactgcactccagcctgggcaaagcagagcgagtctctgtctcatatacatacatacatacatacttacatatatacatacttaatacatacaagctgaggtggtatggcctgctattcacttagacaatatggtatatagcctattgctcctagggtataaaccagtacatcatgctactatactgaatactgtaggcaattagtggtaaagatttatgtatttaaacatacctaaacatagaaaaaatacagtaaaaatgtagtagaaaagataaaaatggtacacctgtatagggcacttaccatgaatggagcttgcaggactggaagttgctctgggtgagtcggtgggtgaagggtaactgaaattgaaaagcctgggacatgactgtacactactataaactttataaatactgtacaccgaggctacactacatttattttaaatatttttttcaataataaattaaccttagcttactataactttttgctttataaacttttaagtttttaaaactttttgactcttttgtaataacacttagcctaaaacacaaatacattgtaattgtacaaaaatattttcttcacaccttattctacaagcttttttctatctttaaaactttccattttaaaatgaaagttttattttttaaactgttttgctaaaaactaagacacaaacacacacatgaacgtaggcccacatggggtcaggtttgtcggtattactgtcttccaccttcacatcttgttacactgttaggttttcagggccaacaacacacacggagctttcattgcctgtgacagtgccaacagaaggacctgctggaggctgtttcacagttcacttcttttaatgagtagaagtactctctaaaataacgattaaaagtatagtatagtaaatacataacactttttattatcataagaaataagtgtaacagtaacatagcttttattatcagctattatattcttagtgtacataattgtatgtggtatacttctaatagcagcactgtaggtttctttacaccagcatcaccacaaacacaggagtagtgctttgtgctaaaacaggtattcttcagctgtattaaaatcttataagaccatcattgtatatgtggtctgtcattgaccataatgctatttggcacatgaatgtatgttgcttatccaagagtttcatcattcaaagcgtattgtattaagcaccatacttggacttggtaaatttttgtttctaatcgtggctttgctaccagctgcttacatgaaccttgagaagaaaagtcacttaacatttctgagcttcagattcttggtctgtaaaatacaacatcatagataatcttttacttctcagagttccgataggaagaataaaactaggttgatagttccaataagtaatgcatcaagaaaattcacagctttacgtgtcgtatttatacatttctttttcaacaaatggattagtttcctagactgtcataacaaactatcacaaatgggatggcttaaaaaatcagaaatgtgttctctcaccgttctggaggccagaagtctgaaattatggtgtcaaaagggccatggtctctatggaggctctagggaagaatccttccttgtctttttccagcttctgatattgtgctagtccttggtgttcttggcctgtagctacatcactgcagttgctgcctccatcttcatatgaccatctttctctttgcatctgtgtagatttccatgtcaggaggacaccagtcatattgaatttagagcccacactaaatggctcttcataacttgattacatctgcaaagaccctttttctaaacaaggtcatattcacaggttctgggtgaacataaatttggaagagacaatattcaacttgctctaacaagccatggaattttcccccaatgatatattcacatgcatttagtctttatgtaacactataattaatagaagtttttgagcacttgtgatatgtcaggcactgtgctaagcattttactctcattcacgattttcaagataaacaatggaagatcagagcagtcaagtagtttgttcatggttacacatccaagtgagtgcagagctattgctcaagttagtaatcactttaagtgcttgggttttttttttagttactgaaatggaagaaagtttttcctatgtgttttggttaagtgggttggtgttcatattttccatgctgcaccaagatttcccagcacttcctgggttgcacaggtcttttttttttttttgagatgaacctaggtgataggctgaatcttggtgataggctgttgagttataatttgtcttcgggtgggagattggagggatggtggggcttttctttttaaggatttactttgttgcttattaacattaattttatttaagtggcgtattaccaaaaaaaaaaaaagtatttgtgactactgctaggtgattctaggatccagacaccagtttctgttctgtcagaaggtaggtattaccttccaagctgtgaagtgagtagagtcccttttgggaataatattgctctctggagaaagaatataacttctaggaactcctctgtactacttctgcatgctgttgtactcttttaattttcatagtttgtcagcttgttttttaaaaagaaactcttccatgctttagaaggagaaacgaaaacaatatacgtaccttgagtgtatactaattaaaggtttactcatgtatgttcgtttaatgatcagaataaatcttcagaggcttgtaaaaggcagagctaaatttaaactcaggactttttatctgattccaaagcattttttttctaacatactttgctgttgtgtccttttcatcatttcactgaaacatgtttgttgaaatttcacacctggtaaatgaggggaaagaatagggactaagcagtttttaagaggcagggtcttgctctgttgcccaggctgaggtgcaatggccagatcatagttctttgtaacctgaaactcctgggctcaagctatcctcctaccttagccttgcaagtacaagtagctgggaccataggcaagtcccaccatgcttagctaattgttaaagggttttttttattttaaaggatggggtctcgctgtgttgtccaggctggtctcaaactcttgacctcaagtgatcctccttgccttggcctcccagaagcactggcttgactcttacgttgttttttaaaatctcctcttctgactactctttgagattacacagctgtagctgaggatggaaatgttattgaggatgggaggtggaagagcattgaaacttttgaatagggaaggagttgaatgggaactgcagaagcttataacacctttctcttcaaaattttcataaagctgttgaagttctcatcttaatagggttttttaaagcactttagacaacttatcttttccaggtagcccagggtgattcttgtggaactggtctgcagtggggtcactggtttgtcttgagatgcatagggaagattgacctgatagagtgatgtaaggaagtatgtgaaattgcctgttagctgtattgcaaatacagttgagagagggttcatccacagaggagtcacttaggaggtattaaggctgcatgtaactgtgacccattccagttcctttggtccttgtgtaaagcagaagcttgcttcactcttggagttttctaggcctgtgcagcctaagcatgatcctggctctgactcgggacatggcgaaggaaaaggagactcttgacctttttcttcggcttctaccggttgctatttcatagtacagcagccctaagtttattgccaccaggctaatggcacagctattcaacactgacccagtttaaacctggaatgttagggaagcccatgttggggtagcatgacaggtgtggagtagaacattatgaagttttctcagctaatgctaacctttcttttcatggttattaaacatgagtaaactttatccgaaataagtgttattgtggcatatgaaacattgtatacagaaaagggcaaagtcattaagtgtatagttaatgaataagtatagctcaaaatatattaaatatattttggggaatgttaagtaattatgtagacctcctctgtaaagcctcactttcatcagtctcttcagttaggctcttttctgctctgacatcaccttctctcaacttctgttatagtactgtcataatactttgtctctttgtctgttcaaggctagatgaacataagctccttatggtagaatctgtttttattttattactgtgttttcacactaccttgcacgtggtagccactcaatagatgctacctgcatgaatgactcttacctacttggatgctttttatttgctcagcctctttttagctgttttcatcctttttggtgtgaggtacagtattaaattagaggatccagtgtttggttttgaatgccatagtgaacttacatatcttgggggcaatggacagtgtatggatgattgttggttgcttcagtgtaacacttgagcacatattttcaaaaataggtttaattaaaactaatgtgtattcaaatgtcctctgaacaaatgaagaagagttccattcttctggttgtggaagctagaaaccttggcagtgtctctgactcttttccctcctatcttgtaagcacattggcatagctggttgattctgtcttcaaataaacattcaagcaggggcacagtggctcatgcctgcaacccggcactttgggaggccagggcgggtagatctcttggccccaagagtttgcaaccagccttggcaacatggtgaaaccccttctctactaaaaatacaaaaaactagccaggcgtggtggtatgcgcctgtagtaccccctcccacttgtatctctctctctctcctgggcttaagtgatcctcctgaatatctggaactacaggtgtgatattacaccaggctaatttttattattattgtttttgtggagacagggttttgccacgtcgcccaggctggtcctgaactcctggcctcaagcagtcctcctccattggcttcccaaagtgctggaattacaggcatgagccgtcacgaccaaccccaccatttccacttcttaatcccctcactatcctatattttgttctctctagcatttaataccttctaatgtagtacataacatttacctatttacattgtttttctttgccgcagtattagaacgtaataagcactttgaaggatgggttaggggagagggataggtctctcattttttcttgtatccttagtacctaacaaatgctgatgagcggataaatgatttaattaactgaacaaaagaggaatgaaatattagttagatgcagacttttgccccagttctgccatgtattggcctgtagagacataagctttgacctacatcctctgtgggtctataaaattatgtcgatgaatagatggtccctaccaagttttattatactctcttaggagatgtcttcataatctatctgagggttgtatttagaaattattctgtagtttaaggaaaaattcttccctttggaaaatactgactgcgtccttactttcatataactgaaaaagaaaaattgaaggagtaattttatatctaattgttagatttatttatcttctggctataattattataaagttaatattttcctgttaggaaaaaaattatacaactcaacaaatatttgctatgcatttattttcttggtgtatgactctgctaagggacatgggtcatttaaatatatttgtattttgtccacatcttcaataaactaacattagttaacaattaaaggctgggtgcagcggcttgcacatgtaatcccagcactttgagaggccgaggcaggtggattgcttgagtctaggagtttgagacgagccttggcaacatggtgaaagtccatctctaccaaaaaatagaacaattagctgggtgtggtggcttgcacctgttatcccagcactttgggagtttgaggcaagtgcattacttgagtccaagagttcgagaccagcctgagcaacttggtgaaaccccatctctaccaaaaaaatacaaaaattagctggatgtggtggcatgcacctgttatcccagctatttatggggttgaggtgggaggatcacttgagcccgggagggggaggttacagtgattcgtgaccacaccactgcactccagcacaggtgacagagcttgaccctgtctcaacaaacaagaaactgaggcaataataagtgaaataaataatgtggcataagattatgaatgctctggaaatgagatttaaatacacagaaagtaagatacaatcaccgtgctttaggaggtctggcagtgtggataaagcaagtaggaactcattaacccgggacattttcttggaaggaggtgggacttgttgaaaatctctttggaaggacgaacggcaatttggactgataaaatataaaaatgagtataaataaagatgaacagctcatgtgttaacctttaattcagttttttttaaccttctactgactaataacccttacctccagcagcagcaacagcttcacattcattgaaacatttgtctaggagatgatgagattggtataacactaacaaatatttggggaaagtagttggaaattgatctttaaaaaagttcttaggaaccggttatgggaaaatttgaataataaaatgatttttggcatgctttgtacaggaagcaggaagacagtttgggcccttaagtagggaatatctgttgaatacaacgttttgagaaggcagtggtgtacaagataactgtcttttgcaaatagtttttatttggatgtgataaagtttgtaaggtatatcttatgcttttgatttagggaagaaaatattttgaagcagaagttctttaaccagagaaacctcattttaaaggctagggttaatgtttcttgcttactagttaatggcctttctcttgtttctgaggagactccaattctttttttttttttttttttttttttttaatttttaaaattttgaggtggagtttcgctctcgttgcccagactggagtgcaatggcacagtcttggctcactgcaacctacacctcccaggttcaagcgattctcctgcctcagcctcccaagtagctgggattacaggggctcaccaccacgcccagctattttttgtatttttactggagacgttgtttcactgtgtcggccaggctggtctcgcactcctaacctcaacctccccaagtgctaggattacaggtgtgatctaccacacccagcctccaattcatttttgttgttgttgttgttgttgttggagatagagccttggtctgtcgcccaggctggtgtgcaatggtgtgatcttggctcattgcaacctctgcctcctgagttcaagcgattctccttcttcagccttccgagtagctgggactatgggcatgtgccacgacgcctgggcaatttttgtatttttagtaaagatggggtttcaccatgttggccaggctgatcttgaactcctgacgacctcaggtgatccacccgcctcagcttcccaaagtgctgggattacaggtgtgagccgccattccgggaccctccaattcatttttgatacgggctaagtgtagtcatattccagaatagggaggcagtgcttcttttgcttcaagagaaaaagagatacatacttcttttttaaaaactgaaataaaattccatttttctttcttaatgttttccccttttctgcagcttgtatttcatattggttttttagttacaaggaccccagggatggatcatctggtttagtggctcataagagtctgtcgtatggcctagagagctaagactaatagtcacaatccctagtcccccaaatctatactttaggatgttctttgagcccaaactaatcaagtctagtgtttttcaactttacaagtttaggacttaccaggggagcttttaaagaatagtagaatatccacctctgggcatggtggtaggcacctgtcatcccagctactccagaggctgaggtgggaggattgctggagcccaggagtttgagatcagcctcggtaacatagtggggttggcggggtgggggaggagagagacacccacctccatgtacccaccatgtcctgcctcccttcccccataaaaaggtagactacctggccccacccccagaggtactgagtagatgttggacctaagccagtatagtttgataaggttccccaggtgattctgataataaatttccattaagagcttcttaatctagttagatctctattttttagaccagagaaagagattgggaaccctgatcacttgcatcccagtctttcggttatatagtgtcatagccttatttttgtcacctcttctggtatacatggtgggattcatatgtagtattttgtttttttaataataagataccttctgcctttacccatcctggctcattatatgtacaatggggaggacttgtgggttcatttttaatttctttttatgtaaattgtttcctggaatgaatttccaaaggtctgaatttgaaattgtcaagcaggaacttaatctgaagtaatatttatgcttatgaaaaaagcaggttcctttgggccagcttttaagaagctcttggtttctcataaattgtaggggactgttccacatttgtttcattcagttttgtttgtgcaggtatagttggtggagtacatgattaagaatagtagcattttcagcttagtaagtcataaactgcatttgttggctacaaaaactgcattgctgctgttaatctagtggagtctagtaatatggtataaatgccataatctggtaaagatttcatatctgaaagatatgaataaagatgctaaatggctgatgagccatgtaggtcagagcagtcaagtggcagagaggggagcctgggtctgctgcttgttgaaatagctctttgggaaaacaaagctgctgctgctgtagtttgtttctgaaccatagggtgaggaagagggggcctctagtacaccaacagtccttttgagacttaactcctaaattaaatttgaagtttatactgctcacttatgctatttttctcctctctatcctgcaggggttgatagttcttggggaggtacctcccccagagcatacaacagacttatttcttccacttagttctgaggtgaagacagatcatgggactgataaattggtaagtataaaagatagaaagggggaaatgcgtgagaattaagggtgttgtcttggcacaccgttttttctctgtaactaggatccttgcattggctgaagaaggggaactgtatctacttttatcacttttggtgttttaagatctgaattcctgaatagggaatctagggcccatcctgcagctgtgtagctgaccataggattaaaagcagctccaattctcaaaacactacagccagagcaagtaaggctttagggagtatcattgggaatcaggagacctgggtgtggctctgacacctgagacataaggtcacctttctgggccactctaatatattatagccttttcattaaaaggttagactagaggttaaattcacaagaacactgaaaatggtctctgtgggtgattcactgttattctataatgagcattaaactgtcattttctgtttccttctgtatcctagctctactgtgattccttctctttcctggtttctctcaataccatagttaattttctttctgaattccaagagcacttgttcttttcacttttttactttgcctaaaaggttactgggttttatgaatattcatatttcttgatttaagtctccataacttaattagaaattccaaagtcccacaaccgtagtttattattttgattatgcttcagataataaagctagtgtgaagtgatggctttttaaatggtgagttaagcaagctgttcttgtatccgcaaataaaccaaccttatagttcttttatttattttaatcattgttagcaggaacgcatgatgtggtggaaactaaattttctctgaggcagatattggagatgtttagatcttggaaagatctctcacctaattttgaaagccagccactgttgctagagataaatgtgaagacactagaagattgatagttcttaactggaaagtagttttgaataaattaaagagcagaatgccaagttttgccactatttaagtctataatataagttcattgcatgctgtttacagatcttttttaagttattaatgaaacttttagtgaatggtctaatcagggtaaaaattgttaagtgagaaaggaaacatagatacattggtggtatgggtacaggaaacatgaaacatgaggcatatgtgataggggagtaagttctatgtagatacttatatatttgtatatagaatttagggattccaaacttttttgagtaatctccctgtagtcatgttttctcttacctcagcacttctgaaggacagggcataacagtcctccattgtgttactaatcctcattgtcttaaaaaatccacagtgattgtgagacagtttatacagattcacttgtacacacacactctttaggagcttggtcctttccctacccttcattcatttacttgtgtgttaaattgtaagattcctgtgtgtgtattaaattgtaagattcttgaaggtcaagaccatctttccctttgtgttggccatactagtttcaacattgtgcaatagaatgctttttggattgagtaaaataaataatgaaaacaactaagtatacactgtcactattttgtcaaggagagattaccccttccctgttttcgtgaattatctaccctttatgaatatatccatgctttctgaaaagcgttcagaaagtattaagagaagacaggggttggggggtggggtggggggagcagggacaatacatttccattgtttattattagtagaatgggcgcagagcatatgtttcttaaaagctattgacttaaatttttaaaatgccaaatatttgcaaagctgtgcgtatgtcaattgccaggcaaagtttttctgtataagaaggcagtatttaactttgcttgtttgttccccaggtttttttgttttgttttgttttaaattttaggaaagtgacttttctcagttttgcttaaaaaaaaaaattaggttgcccgggacagagggcaactgtaggttttcatacccacatgtaaccagcctgttttccattttgttaattttttccccaaatggaggtaggtgtatttattccttttttttttttttttttttttttaagacaggctcttgctctgtcacccaggctggagtgtaatcgcacaatcatagctcacttcagcctcaaactcctggactgtgcttgtttattacccaaaaatatatttgaagacttgtagtttaaaaataataatgtcagaggtattttctgttatgtttaatttttttattctcatttctgaaactcagctggaattaacaaaaaaatcagcgtctttagaattgtcaaaatatagtttcaaaacattagatataattcttttctttttctttctctctctctctgtctctctctcccctctctcttctttttctctctttctttccatctttttagacagggtcttattctgtcacccaggctggagtgcagtggtgcgaccttggctcactgcagcctctacctctcaggttcaagtgatcctcccacctcagcttcccaagtagctgggactacaggcatgtgccaccatgtctggctaatttttgtattgtttgtagagatggggttttaccaagttgcccaggctggtctcaaactcctcagcacaagcaatccgctggccttggcctccaaaactgctgggattacaggtgtgaaccactgcaccagcctagacataattcctaaatatatagtgatttactgaataacaagggaatcatgatggtggccaaactgttaacagtattttaataccagataaaaaggaagaatgcaggaatatgattactcagtagcatacaaaagttattaatatcctatagaacaataaagctgtaactttggacattgttttcaacaagatgcaaaccaactttaacttgtcagcgttctaaaataaacatccagtaagacttctgggccctaatcaattatagatagtaggtaaaacaaagttaaataatttatggagagtcagatgtttcctgggtgggcttgttaggtaatgtcccagtggtacactgcaaggatacatagtctttttgctttatttccaaacaggatgattgtttattgacagaaccagtatatatctgcttgggtcttgaatacagtacagatattattgaactaagttgttctaaaaggacccaacctatgagcaaaagaactggagactgaattcatgggtgaaccttttttgagtcatggagcaaatcaaggaatattttctgggttagggaagtgggtactgtttttataccacagagtagtgggttagagaaagggaagacctaaggaggaatgcctagaaaaatgcctctttttttattttaacctcttcattctgacttctgactcaaaggcagttttaaaggtgtaaggctagctgagggagagaaaacttaacgggcctctagcttggtagctgccgataagtcgtgtgtacagataaatgcttctgtgaaatttaagactccttttgaacaaagagggtgtgcccttggaaagagagcatgtaaaaagcggttgagagttgttctctagtgtattgaaacatgcctcttatcttccccaccttctcattctctctcttcaaatagaagcttgctttcccctgcttaagaaaaagtaatgagcaaagaagggcaagcttggaacctgtgcatattactaggtaaattactcaacaatgtcagcaaaatttcagacagaaagtattgccaggaagagatgagagcattctcagtccatgtgccccagagcttctagaattcaatagtcactgcttcatgggcttgtttgtatattatcagaggatggagttcagggctgccaagtaggtagaaattgaaggaggggaatagtggcaaagagggagctatgggagatggggaggggcataggcccacaatctatttgagcccctttcagatctttgtgctcacccctgacctgcacatgtttagggaagattttatagggcatagtggaaagcagtaattggaaggctgaaagagctgagcagagaagatcatcattgcctaatgcagggaaggcagaatttggagttcgaattccaactagacttggcaaaaacctgagggctttgattgaaaccaataaaggctcacacttaaagagttaaagaatgtttcccaggacgaaggcattcaccataggattaaggagggaaccaaaatagactccactatgcttttataaaaacaaaactagctccacaaaatgaaggtaaccaggtagtagtagtatgcctgctagaacaaaaatcaacactctttaggaaaagctaactaaattcagagtctctataatgtattgcatacattgtctgtatataatagaaaattaccatacatatgaataaacatgagaatatgattcttagtcatgaggaaaaagaaaaaaaaagatggaaaaaaattgaggaacttaatgactggatttttgaatttaaacagtcagtttacaaatgtatgaaactttaggccgagcacggtggctcatgcctgtaatcccagtactttgggaggccgaggtgggtggatcacctgaggtcagaagtttgagaccagtctggccaacatggtgaaaccctatctctactaaaaatacaaaaattatccaagcgtggtggcagacacctgtaatcccagctactcgggaggctgaagcaggagaatcgcttgaactcaggagacagaggttgcagtgagccgagatcatggcactgcactgcagcctgggcaacagagtgagactccgtctcaaaaataaaataaaaaaatcatgaaacttcaagaataataaccatgagaatcacaacattgtagtaaaaatcgtgaaaatcaaaggtgaagaccttattcctgagctgtgatgctgtttaaaaattaggaaaaaaacctaacgcctaacatcacactacttggtgaaagtgcttgttttgttggtctacaattaggaaaaaaatatatcctaaaaatattgtaagctgggcacagtggctcatgcctgtaatcccagcactctgggaggccaaggtgggcgggtcgcttgagcctcagagttcaagaccagctccagcaacctgacgaaaccccatctctacaaaaaaatacaaaaatgagcctggtgtgggggcgtgcacctgtagtcctcactactctggaagctgaggtgggagaattgcttgagcccaggtggtggaggttgcactgagctgagatcatgctactgtacttgagcctgggcgacggggtgagaccctgcctcaaacaaacaaaaacattgtactctgtcttggctaatgcaatattgcaagaaaaaagcaattaaaggcatggaaattggaaaaggtagggcaaaactgcttgtatttgaagatatgatacttagaaaccccatggaattccctaaacctgtgagaattagagatttagccaaggtctccaggtacggggtcaatatataaaagtcaattctatttttatttattagagcaaacaactgaaaaataacccggagaaacagttccatttgcggtagtatcaagaaacataaaatacttaggaataaatctaacaaaagacgttaatgactttattgctgaaaccataaaacttctgaaaaagattacataagtgaacggagatgtatgctgtatttatgtgttagaagagtcaatgttagacacaatgattcaatgcaaacccagtgaaaaatcccagcaagattttttggtttatgttgtgttgtttttggtaacaattgaacattgattttcaagtatgtatggaaatgttaagtattttcaagagccaaaacaattttttttttttttttttttgagatgaagtctctccctgtcactcgggctggagttctgtggtgtgatctgggctcactgcaacctccacctcctgggttcaagtgattcttctgcctcagcctcccgagtagctgggattacaggcgtgtgccaccacacccagctagtttttgtatttttagtggagacgggggtttcaccatgttggccaggctagtcttgaactcctgacctcaagtgatccgcctgcctcggcctcccaaagtgctgggattacaggcgtgagccactgcacctggccagtagccaaaacaatttttaaaaacaagaaccaaattggaggagtcacactctcctcctactacctgatttctagccttcttacaaagttaatttaaaatttataatttgcttttaacaatgtttgatagataatgaaagttagtaaaagctaattgtcattgttccagactgcactttgtgtctgaaagactaagtagaaccaggtatctatcttttcttgagtgcttcttgttcttccaacaagcataaaatgggagtgctggagggagtcagtaaaggtagtttcctagggaaggatggacttttttctgagtcttatggacttgctgaagcatggtgtagggagtaatgtgtaatgcagcataggcttgaaagagcctggcattatcaggtaactgcaaatacttttctgtgatggagtgttggatattttggccaattcagaatggattctatatttatcttaagtgagtactgtaactgataggaacctgtagactgtacagatttatgtatgaatgaagtttgttttattaatgctagatacattttttcttcattcttttaaaatatgattttaggctgggcacggtgacctaaaatcccagcactttgggaggcagaggtgggcagatcacctgaggacagaaatttgagaccagcctggccaacatggtgaaaccccgtctctactaaaaatacaaaaattagccaggtgtggtggtgtgcgcctgtaatcccagctactcgggaggctgaggcacaagaatcacttgaacccaggaggcagaggttgcaatgagccaagattgtgccactgcattccagcctggtcaacagcgagattgtgtcagaaagaaagagagagtgtgtgtgtgttgaaatagtagtacagagtctccgtacggagctttctctaatcttaacacatcttgtcacaataatcgttaattatcagaaccacgaaattaacattgaaattaacattgaacttatacaaagtaatagacatactttatttgaatttctgtattattagttttcttattaatgtcctttctgttgtccagaatctatcattgcttttagtttttgcatctctaaatgtccttcaatatgtgagagttctcagtttttgtatttcattacttggatacaagatttctggtcagttattttgtatagcgttccacaaattggtgttttctcattattagaggttacgcattgttttacaggaatgccacagaagatactgtacccttctctacaccacagggggttcatgattttgacttgtctttctaatagtgatgataggtttgttcccttggttaaggtggtgcctgacagctttctcctctgtaaaattagcatttttccctttgtaataactgacaatatttatttatttatttatttatttatttatttatttatttatttagagatagggtctcactttgtcacccaggctggagtgcagtgtcgcaatcaccactccagccttcacctccctggctcagctatcctcccatctctcagcctcccaagtagctgggatcacaggcatgtgccaccatgcctggcacatttttatgttttttgtagtgacaaggttttgccattttgccctggctggaataaatgactgtcttatagggagacactatgtaaatattctgttgctcattatatttttactcataattttattgttcactgatgactttttcctacagcaattattgctgtgttgtttactaaagggtggttgttctacttcctacctgcattaaatggaattctgttaggaagaggtgtcttcccccctcatttatttactcattcattgactcagttgtgaatatcaggatggtcccatggatatttattttatttaatggattataacctattactgtttatacagttgctccagttatctcaactttgggtattgggcgctctttcagattggctcctgtgtccttttagcatgtaccgcttatattttgaaatactttctaatactagatgttccaggttcctcttgtattttgcctacttcagctcaggttccttttattaggaactaaaatctgagtactagttgtgctcattgttacttcgtaagtgtcactgcttctaggatgtctcaaaaggcaaagcaaggaaacatatgtatctatgctcacaggtgcatacacacacatctatatttctgtatctacttaacctgtatatatatataaaaaaccgtaagttcataccagttcaacacagcagccttcccccttccttattgatactcgtttaatcctagtacccgtatagtctcacagttgtcatctagtacccctgtgaaaaacacatttgctaactagagtacaatatttttgtacagtatgttaactgttatgcagtcaaaatacagttttctgaagttacgtaggttagttatttccttccaccaaatctttcagtatggttatgttgttttgtaatacagttaggttcatttgttactacagtattcaattctagccttccctgttttccccaccccgcattgttaatttttatttttgtatgggaaacattactgtggttctaaaaaagctatacattcttctttatatccttttctcactcaacgtcctgtaggttagcaatttcagtacgttttggcttatctttcctgtatttttttgcaccgatgagcagacacatgtatatattttttaaaatctccttcttggataaatattttttaaaatactagatttgacgttaaggagggttttgtttagcgaaaaacattgcttctatggcaattaacaagtaacacattatttgtgtgttagtttctgtttgtaaaatgatcctgctcctttaccctttccttgctcatcctactttacagaagtgatgagaaaaacaagtgtactattaagtgaagagctaatgctttctcagaagaaaggcatgctaaaaatgtaagctattgctgtttctttttacacagtccaagatacatcttcattccattggtgtaagtaggaatactcttcctttctttgaagttttgcagtctctagggacagtgagtagttcattggcctgacaagggttttgggatagaaggtaaagggacagatattggccaagaaatatttgacccacagtgttagaaaacactgacaagttaggtcttttataataaattgggctatggataaataagttgaacaataagaatttaagatgcatttttgcatttgctatatttctttaaattctagatagttattttcaagtgttggtaaacataaatcttaggcttaggaaccattggattagtaacagcattatgctaatcaaaactttaaaaaaatgagttcaaaattgttataatgtaattttatagattttcttttatcctcaacctgcagaagccggaaagtgaggcacatagccccacataggcagaaattaaagcctaggcaataacttagtgaaaatggaattttcagaacattccacttcttgtttagtacaattttatggccatggtgctagctaatggaaatggctagtatactatttataggccagcaatattttggtgaatttaagcgaaactatgctcagtatcattgaaatgggggtggggtgggcttgagacatgaaatcaatcatacaaagtcaaaaactattttaacccaggaataagttaaattcctgtcacccagttagcattttctttccattttaatgtttgtcagaaagggaataactaaccaaaactgaactgttgacttttctagccaaacgaatgtgatacatttaaaaaatgacattgcaagcaggtgtgacatggcattaattgaataaagtaaaaatacatatttgcaggtagagtttaattttattgtgtgcttttaagtgtgtggctctctgtttttaccccttaaccctctctactttttggtgaaacaaatctagtagacattggttcttagaccctagaaaaaacgacccccgtaaaaactatttagttttagcttttcattcaaggcctctttgtcacgcttacttgatctggcccagagtggagtaatgaatgagatgcctgctttatgtgaataacaaatttgaatctcattgctatgttagtaattttatgctgtacacctggccctttcaatcggggcggggggaggggtggggggagcaattcagcaaccctccttgctacctttaactgtaagattactccaaaagataatcccctagggccctgctttggagaggaggggattacagaggcactctgtctaccactttagcttttctactctttctttctggctgtgggatgcataaaccctgagttcatctcaacatcaaataaaattcaaatggaagcttcagtgataatccttattttctaggtaggagagtcttaagttctttcatcctttttgcagttgcctattggatagcagatatctcagtcatgctttagttttctaaaaacactaatgatgtaaaccactgcagtagtaataagctgaaattagtatgcggatttaatatttcttaagtgtttgttaatgtttatcctctgcatttgcagccttttagactgcaggataggaaatgttcattttttctcaagggagagtgcctgcatttaaggagctaggtgaaattacatgtgtttgtgtgttatgtttttctttttccaaatggaacactgtgattgggattaatattttaagctctttgcattgatgatgggttgcaggacatgtccaaatgcctgctgttggatactagcttgattacagaatttcccaagatcttaagtagatccttcctgagtatccagtgctttcttttttgtggctgggaatgcaggccagccacagtccctttctgatgtttatgctcttgacctctgtatacctctatgttcttgacaacatttccatgttaataatgtgttgcctgttgacttcaattttgatttgggggctgaattactccaggaagattcaggtttctataagaaaatcaataacattcatgttaaagctgaatagcatttaaatatatacacctgcagacatgagaaacaagacaggctgttatagcagtagtagttagctatatggatcgtgacattactggtgattttacttgacatattcttctttagactttgtataagaaagataaatgttttgaaatgagactttgttagagaatggcaacattttatcttgacaagtgttcttgcagttaaatctcataatccctaccagaaaaacttaatcaaatggagagtcagtcaacccgttacttaaacgtagtaccttctagaacacgtgaaggcactaccatataaattatatataccatatataaatcaaatataccatataaattatatataccatatataaatcaaatcactgccataatttaatgccgaaataaaaacaaacagcatttttaaacagcatttttctattgaaaggaaactttttcatctaaaccagaacttctgaaatctagaatacctataacatgcctgaagttatacatctgttagttaataccaacctgaatcttaaattcttttgatttttcttgttctttgtcataccatatttgtttagcctttttgaggtttcccctgtgtagtaaatccttactagcattcaggagggtatttggttttatgggggtttctttttaatataaaactattacctaaaatgtaaagaaaatttcagaatagttttacaactgtaacactctttgtcttgttgttatctgtgtatgtatatttttagtcactacaactatattaaactattatttttttctcttgaaatctcttcttccataagagaagaaatatcctttatgattctttttaatattttgatttggtgtaccacaactgataactatagttataatgcttacaacatttagattattgatagatatcattgcagtgaccacctttgtgaataagatttttggggctgtgtttgttgagttactcctttagggtagatttttaaaaattggttagaatattttgtcagaagataggaatatccttatagctcttgctgcttaataccgtgttgctttccaagggaaatctgcatagagcttaaggcaatgtgtctatgccagatttactgtaatttttgatagcattgacaattgttcaagatgtttgtgatatcttagtagatgtacaggatatccaacaaaaaagacagccttttctcggtgttcactcattgtagcatacttatatgacttgtctgtgtatatagtttgatctgtattttaggataatttgtattaaaacttttagattatcttcccaatctgttttttgtttttgtttgttttttgttttgttttgttttggagacagtctctctctctctctttcccaggctgcagtgcagtggcgtgatttggctcactgcaacctccacttcctgggttcaagtgattcttgtgcctcagcctcccggaggagctgggattacagacaggcgccaccatgcccaactaattttgtatttttagtagaaatgggattttaccatgttggctaggttggtctcgaactcctgacctcaggtgatctgcctgcttcagcctcccaaagtgctgggattacaggcatgagccaccacacccagcctcagtctgttctttttgatgcttgtctaggactactttcaggttcagtcctttggtgttttatccttgggggtataaagacaaaagaaatcagtattgaaaagtagaatttcagcctcaaaatatttaccttgaaagcatttgtaggaagcatttataggaatatttaccttgaaagcttttataggaaagagaacttcagcgtgccccagagtcagttcaagtgtaaggagacaggttaggtgtggtggctcacacgcctataatcccagcattttgggaggccgaggagggcagatcagttgaggtcagaagttcaagaacagcctggccaacatggtgaaaccccatctctactaaaaatacaaaaattacatgagcatggtagtgtgtgcctgtaatcccagctactcaggaggccaaagcaggagaatcgcttgaaccagggaggtggaggctacggtgagctgctatcatgccactgcactccagcttgggcgggatagcgagacttcatctcaaaaaaataaagtaaggagtcaaagacccatagcctttctgggatagttcaacaattgctagaactgagggatagctgcatctgttgctttattgcctatacctcagaggtgctatatgactggcattcatactgttcctatccgttttgagcctagtaaatatataatttgttttgaatactgcaaatcacactttttctattctttctcatctgttatttcattttatattctaaacatatttgatttgaatactctaaagacaatagttagtatctgatagcatcagataattagattcattgagattttattaactttgttttctgtcagggaaaaatgtgtgtgtgtgtttatttatttatttattcattgagacagggtctcactctgtcacccaggctggagtgcagtggcatgatcatggctcactgcagcctctgcctcctggctcaggtgatcctcctcccacctcagcctcctgagtagctgggactacatgcacgcaccaccatgcccggctaattttgtatttttttgttgtagagatggggttttgtcatgttgcccaggctggtcttgaacccctgggctcaagagatcctcctacctttgcctctcaaaatactggggttacagtcatgagccaccatccccggcctgtgtgtatatttttaaacaaagcatagtttttagaaaacaagcttctagcatactctgttagagttaagcagatattaactacatttaaatttcctcttagtcatcttgatactgatgttagtatatccttcttgatcattagttgaaagcttatgttactgtgtaattgttttgctaagcttctgttccatagaattattgaggtcattttcctgtcaataggtacttacttttagtctgtacatttggattcctcatccctcttccccccaaagcaaaagctaatataatattctccttctctctgtcaacctctctctctctctttttaattagagatgaggtctcgctgtgttgcccaggctggtctcaaaactcctggtctcaagcgatcctcctgccttggcctcccaaagtgctgcaattatagttgcgagccatcatacctgaccactgattctcttattttctttttcttcagtcattcaagttgtgtttttcaaattgatcatcagaagttttaggtgctttgtgcaaatgaagtggtggtgcttttcaggcaggggtgcgcttgggtacatgttaatttcttttttcctttttcttaatcagattgagtctgtttctcagccattggaaaaccatggtgcccctattattggtcatatttcagagtcactgtctaccaaatcatgtggagcactcagacctgtcaatggagttattaacacgtaagttttagctcttctacttcctacacttagtagacttgtaaaggtgttttggagctcttagttctctttagccaggactgaccctggtttaaagaagcggaagccttatcacttagtaacatttttaatcttcactgtataatgaagcagtgcattttaattaattgtatattttccttttacctactaaaatggagtgggcatggagtaaaataaaagacactacagttactgtgaattattattgttttaatcttgcaggaattcctcagaagtgcttatattaacctcctctgcttaggacagattagatctccaagggctatgtttgtaaatctgtatttatgaagattcaagggagaaaacaaaagattcagggagattctgtacaagtgaatgatgtgtacaacacccttaaaattcgggtttcatagaactgattctaaggaagcccattaacatttgcaaaattcatcattttctaaccaactgtagttctctagactttatttactcgtgtgtttgatgtagaggagaactcaatcactagaacttgagtttatttattgacttttatctttcagacatgatgtagttaatgtgcaccaagaaccttacacataagcacacacaggtagattaacagacatcaagaggagacctgcttctgctctagaatgcttctttgtgtctgaacattagcaaatagaggttgaactagtataagaggctttgtttctttgtgttttcttgttgtttatttattttgtttctttgtgtgttctgagaatactcttccttccccttgtatagtcttcagcctgtcttggcagaccacattccaggtgacagctctgatgctgaggaacaattacataagaagcaacgactgaatctcgtctcttcatcatctgatggcacctgtgtggcagcccggacacgtcctgtactgagctgtaagaagcggaggcttgttcgacccaacagcatcgttcctctttccaagaaggtcggtacagatgagagttggtcattgtcaagcagtgagccagatgctcagatagagttagtctcttgccaactttggtgttttctaaacttggctaaccaccaaggtcttctggggagctttataaaatactaggttcctgggccctgtttgctctggagttggatgttggaatcttgttttcagaaaacacaaagctcctcggtgactctgcagctagttttgaaaaccactgtcttgagctttttaatagaaatgggagagactgaaagtttaagtactgcccttaacactttgaaggagaatagtgtgccctctcaccttcactgttatcactgaaaatggcagtatagaatcctttgccctaaaaaagaatcttggccatgtgcagtggctcatgcctgtaatcccaacacttcgggaggccaaggcgggaggattgcttgagcctaggaattgaataccagcctggaaaatatagtgagaccttcatctctacaaagtatttaaaaattaagcatggtggtgcacacctgtagtcccagctattcaggaggccgaggcaggattgcttgaacccataaggttgaggctgctttgagctgtatttgtgccactgtacttaagcttgggtgacagagtgagaccctgcctgagaaaaaaaggaatcttcactaaagtttttaaattgatattactaaaaaaaagtttgtcttcacaaaggaaatggagattaattcacaactgtagggaattttagattgctgactcttcaaatagcagttgcctttattccaaaactaatgagataataatattccagtaaaattggtactgtgcaggaattaagagcattatctttgaagatgataaccttgggtttgaatcatggtactaccacttagtagtttggtaatttggtgcatgttaaccaccctgacttccactcctctccaaagcctcagagatctcatagggttgtttgagggttcaatgaaatatatgtaacatgcttattgggatgtctggttgataagttcctcgtacaaagtggctgttattgttaccacttttgttgttgttcattcattctttcaacaaatatttattggcttcctgcaacgagctaaatctgtctagtcactgggtatacaacactaaacaaaacagacaaaagtgcttaccctatgaaatattctagttgttaagagaaagaaaataataaatgaactctgcagtgtgtcctatagcattaaatcttggagagaggctaggcacagtggctcatacctgtaatcctggcactttgggaggctgaggaaggaggatcacttgcgttcaggagtttgagaccagtctgggcaacatagtgagaccccatatctttaaaaaaaaaaaaagcctgctgtgggcgagcgtgtgtagtccatttgctcaggaggctgaggcgggaggatcatttgagcccaccaggttgacactgcagtgaaccatggttgtgccactgcactccagcctggatgacagagtgattgagactctgtcttttaaaaaaacaaaaaaacaaacaaaaaaaacacacgtatacatatgtaactaacctgcacgttgtgcacatgtaccctaaaacttaaagtataataataataaaaaattaattaattaaaaaaaatcctggagagagaaatgcaatagaggagggaatagagagtgctggagagctcagataaagaagaggtatatggattagccctttgatgtattccagagcttaggtattcctcctcattcctgtgaaagatgaggaaaggattgggaagggagtgacgaataaagtagaagaaaaaccaagagagtgtggtatgtgaaaggcaaggggagaaagtgttttggagagggaggaggaggagggattgtctgtgtcagttgttacagacaggatcagtaagatgaaggctgagaattgagaccattgaatttagtggggtggggttgttgcagacattggtgagcagttttggtagagggagaaaggtgaattaaagcatggttggagtggtttcaggagacaaggccacagaaggaattgagggaaccattgtagataacattttcaaagaatgttgctgtaaaagagagcagagaatgggaatttttcttaagagagccactagcaacatatttgctaatgacaaataagggagatgagagaattgctggaacaattagtatttgcatggtgaattttcagtactttccttgttttattctagtatgcagttgtactgtgtaagtttgccatgttctctttaaagaaaagaattgtagaattgactgtcaggcgataccatttcttcctgtctattcctcggactctacctgaaatatcaaaatagcagaaatagataagaataaggtatttggcagggttttcatattgacatttcagtctcagtttttttttgttttttttttttttttttactaatagtcgtatatctctaaaagattttcagaggagttgataacaggaatgtcagaaaacagtatattactgtcaagtgtaggaaaatagctttttgtcaattccttgatgaatttaacacagaatgcttttacattttaaaaaaaaaaaaaaaaccgccacctcatgaaaataaagcacccttcctctgttttggcagtttaccagccactatggcatgacatcaggagtcgtataaaaattttctgaagtatgtggtggcctcctggattttgttttttaatatgtgaagtagccaaccttcttctgatccatgcctaagaacgaatgtagttttgaatgtacatataaaattataaaaggtagcttaggcaagagataggcataaaactaaatatccttttgttccaatgccactttctaaaacagaatcatcctgacacaaaagtaagctgcatgaaaaataagacagagaaattagttgactttgggaaatataccatgtactagatctagcagaaagctggagttcttccagagttagagacacaccccattccttctgtctaggttgctttctgtgtctcacatggctcctcactcatgacatgacctcagtggtatttgctgatgagcaagcatcttgtcttctgtcatcttgaattgctcggttttccagacagatttattcaacagcatttttgaatgcccaccgtattattcagggcagccaggttgcattggtaaggaaaacaaagcccttatcttcatggagcttactttctaatgacagcaaagaagttaacaggtaaattatgttctaatattgttacatgacagtgagttcacagttattgtgagtacagagtacagaacacacaaagcaagtgattaatattttttccttacctgcatcttaaatgatctctactgcattccagaaccaaataaaacatacttgagggaactcattgaggttttgttttgttttgttttttctttgagatggagtcttgctctgttgctcaggctggagtgcaatggtgcgatctcggctcactgcaacctcctcctcccgggttcaagcgattctcctgcctcattctcccgagtagctggggttacaggcatacgccaccacgcccagctattttttgtatttttagtagagatgaggtttcaccgtgttggccagactggtctcgaactcctgacctcaagtgatccacccgcctcggcctcccaaagtgctgggattacaggcgtgagccaccacacccagcccaattactgtgtttttaaagggctatcagcttagttgaattatggctggaatatatcttaaaattgagatgcacgtttagtgcagtaactcttttgcccttaaaaaggctggccaggcacagtggctcatgcctgtaatcccagcactttgggaggccaaggtggggcagatcatgaggtcaggagatcaagaccaccctggccaacatgatgaaaccccatctctactaaaaatacaaaaattagctgggcgtggtggcacgtgcctgtaatcccagctactcgagaggctggggcaggagaatcgcttgaaccaagaagtcagaggttgcagtgagctgagatctcgccacagcactccagcctggtgagagagtgagagtccatctaaaaaaaaaaaaaaaaaaaaaaagctgttgttatatcacttgtacttcttaaaatcaatgactaaaacaaagtgttcagtaagttaaactcgttgggaataaagagaaatgagatctatcagtaaataaataggaagccttgaatgcccaaactgatgatttgggtttcagtctataagttttaaatttttgagcagagaagtgttgtaagctattttgggggaggtaaatctgctgtaacatgttttttttttttttttgtttgtttgttttttttttttttttttgagtcggagtcttgatctgtcacccaggctggagtgcaatggcacaatctcagctcactgcagcctccgcctcccgggttcaagcaattttcctgcctcagcctcctgagtagctgggatcacaggcacccacgacgacgcctggctaatatttgtatttttagtagagacaaggtttcaccatgttggccaggctggtctcgaactcctgacttcagctgatccatccgccttggcctcccaaagtgctgggattacaggcgtgagccaccgcgcccggccaatctgtaactattatgtttgggatggattggcacaagagactggaggtggaaagacagactaacagtagtaatcctggaggagataatagtctaaggcctctacaactctgaatgtggaatattttaaatgtaatctaaggaataaccactagggtgtggtaagtgaatatcagagtaaggctcatggagaacatggagtacttcctaaatcataattttattataaaatgacggaattactagttgtaattactgaatagcctatattgctatttattgtgtgtttcatcactttaggggtctagtatggtggatgttagtaattatctaagtgaatgaagaagcactccagtggaaagttcttatatgccattatgttcttttcctggcccagtgcctaagtgaagtaggtgtttataacttaacctaaacgtactaagatttcagatcaataaagttattaaaataaaattggtaccagccaattttcaaataaggttgctttttattttttaagtaaaattatgtttataattaaaccataagacaaatagtatttttttaaaaaagaaaagaatgtagttttattaataatttactgcattgttctcattctcaatttactgtggaccattagaaacttgtgtatagtctggcagtggaaaccatcagtgtttggaaatgaatggttgaaaaggctgggtttttttgtactaataaccagtagaataggtaatggctacatttattactaacatacccttgaaatttttattgcccttaatagcatttctttcaattttttaaaaagtagcaatttcctaacaaattggcagtgtactggcatcattttagaattttgtagtccttgttgtcataggggggattgctctgggccaaattttaaagctggcttccatagaattccgagtagtcctcctcttcttcccattgtatcacacttgaagagtgacatttttgtacagggcattctctcatggctatgaccaggtttcctgtagacatcagggtaaataaaggtgttaatatatgattctaggcctcctagttttgattccacctatttaaatccagtttcatgacaccatggttgaggactaatgaactagaatatgagtcagtattaaaagttaataatttgatacgttcttccttgacagagtgcaatagaccttggaggcccaaccaactttttcatactagttagacatttggaaaggagcaagcatgccatgtagaaaattgtaccttaggacataaagctactaaaagaatactcagaaatcactctgtgcttggaacagttacctctaaactgttatgacggtgttttatatatacattataaaacacatacaaaataaattttgaaagactgagataaaatagaagcttacacgttttgtttcttcactctgatggatcttcaagagccagttgtgggatatgcttgattgtgatagagttgccaaacctttgaaaatctttccacatgttaacagtggatgagttagataacgaatatcaaatgcaaagcaaaagcaaatgattataacctgtccttgagccaaaagaattcttttagtgttttggacgaatatgctatgattaacagaaaatggtgaatagagttttactttggtattaattccttcataagtattaaattgagtatttcttgggaattccttcaaagagaattgatagcattgcagtattaattaagggaacgtgggaatttcttcgtgtatcaagtattttatctcattattttattgagatgcaggtctcactgtgttgcacaggctgattttttgttgttgttgtttgttttttgtccccctcccctcccccaagatggagtctcgctctgtcgccaggctggagtgcagtggtgcaatctcttcatctcaaaaataaaaaagccagctgtggtggcagctacacaggtggctgaggcaggtgaatggtttgaagctgggaggcagaggttgcagtgagtcaagatcaagctactgcactccagtctgggcagcagagctagactctgtctcaaaaagataacagtctgtttctctctcttagttccagctgagaacatgtgttgatcagtttccttttctctctctctctctctcttttttttttttttttttttggagtcagagcctcgcctcgctctgtcacccaggctgaagtgcaatggcatgatcttggctcactgcaacgtctgcctcccgggttcatatgattctccttcctgcctcagccttccaagtagctgggactacaggcgcgtgctaccatgcccagctaatttttgtatttttagtagagacggggtttcaccatgttggccaagctggtttcgaactcctgaccttaggtggtctgcccgcctcagcctcccaaagtgctgggattacaggtgtgagccactgtgcccagcctcctttcctcttagcatatcctgagatctaattctagtctcctcacgagactgccagaaacatctctgcccttttcagagactttccacttagctttgtagcctcctaccattcacaacttcagctttttctttgggagggtggtacttggaagtgtgtcatgcttagttccctgtcctctttttattgataatttgacatttcaagtctctagtgttatccattcagccctacaagagtaccaaaagctctgctcttttttttttctttctttctttttttttttttccgagatggagtctcgctctgttgcccaggctggagtgcagtggcacatccttggctcactgaaacctccatctcccaggttcaagcgattctcctgcctcagcaagtagctgagattacagacacgtgccaccatgcctagctaatttttgtgtttttagtagagatgggttttcgccatgttggccaggttcttttcctctctggaatcttagctttcaatattgtcattatgtcagcatttttcttatgttttgagagagagagagagagagagagagagagagagagagagagagagagagtgtgtgtgtgtgtgtgtgtgtgtgtgtgtgtgttttaaatctggcttttccaattagtgagagtgttggtttgatacaagctatccatataggtgatttatttgttgagaaaacttcatttatctgataccttagtttcccacagcctactttcttttaaaaattttatccctatagtagtattttcttgcctcttggcatatctaacaatgttttatttatgttttaagctgaaaatccaattaataattttccctgcttgtagcatgtggattgtgccatcttcctttaaagaggctttgttttgctggcaggtaaattccttgtcatttgttaggtcaggtgaggagttggccaccttagtagtctagctccacaactaaagcaggatcttctgtcttgaattctctatgcaactttggctggtcacagtttaaaagcctctcaggcttgtgttagctgtggaaaccatttcagctcacagctgcctagttgctcttgcctggcctgatagtttcaccctttacatgcaccttttaatatttagcaaacactcagggggatcttatgaagatttctggggctctttttctgtaaagcttcctcctctcaagaattttgccttgcaattttcagtttccttagtctctgaattctgatctagtgagaatttgcttcctcaactcagtgaagctattatactctgcttcagatcctctccctgccctgcagtctagaatgtacttccagacggaaaaccagggcagtcttagagaccaccccatttatttctcagtgttatactgcctgttgtccagttttctggtttatgactgaaaggtaaatctgatcactattactctgctagaagcagaagtcctgtggtgtcactgttttcttttccaaattttgttatgaaattattcagatacgaagttgaatgaattttacagtgaacacctatgtagctactccctaggttctaccactaacattttagcatacaatcatccttccatttattaatccatcttatttttagtgcatttaaaaaacagtgatgtttttctgtcccttgtttttcttgaaaactagtagaaacgtgaataagtccagttttagtttcgtgagaaaacacaaggtggccgccttatgcttgtatcagaagacacgtaatgactaaactgtttgttatcaaccactggtgatcattgcctggacccattgttaaattggaagctgaagaatggtgatattctacttgtatcatttctgtttttcttttattagctagatagaatatgtttataaagggaaaattgtccttttcaactatttgtttaccctgaggtacagtttgtacagaagaaagcatgatttgttgtttttttttatttaccaattttcaaaataacaaattagttttctactatcctctaaggacagtcactgaagtttttcatgaaggggctgtgagtcattgattgaaacatatttgaggtatttcaagccattgtagtcttttctttatgatgctaacgttatctgatctttggtaggggaagctctcttcaggcttgttcttgacaatagtctttgagagctttgttcttactattaatttttattttttttgttttccttttttactgagtcttatgtttactgtgactcaccactaatatttaatgggagcctgtgctttgaatttttctagacgggatgaccgtaatttgaacctcatggttctcagtgattttgtcctcacaggagacatttggcaatatctgtagtaattactcattttcacaaattgggggagtagggaggcacatgcaccatgaggacagagatgctgctagatatctacagtgcacaggactgtgccccacaacaaagaagtgccagctgttgagaaatcatgcggtatactaatttagctaacatttgtgtaatgttttaacagttacagagtcatttgatctttcctacactcccatgaaattggtattattagtcctttttaacaagtgagaaaatttaaggatgtcatgtgacttatcaatgatcatattatacagtgttaagaagctagaattttgaaatcaagatctttgatggtaaatgttctatcaagtttgatggtaaatgttctatcagtagctatacttacggttttacaaaagtgattaagagtcgagagccagatactgttgtgagttatttatctttaaaacaactctatcaggtactctcctgttagtaaagatgaagacacagtaacttgtcttaaggccacacagctagtaagtggcggagtcaaggttcaaacccaggcagtctggctccacagctcatactgttaaccactatatattgcttcacaatttttttttttttagatttgagtataatatttgtttttatatttaaatctttatttggggccaggcacggtggctcacacttgttattctagcactttgggaggccaaggtgggtggattacctgaggtcaggagtttgagaccaaccttgccagcatggcgaaacccccgtctctactaaaaatacagaaattagccaggcttggtggtgggtgcctgtaatcccacctacttgggaggctaaggcaggagaatcacttgaacccggagatggaggttgcagtgagccgagatcgcaccattgcactctagcctgggcaacagagcgagactctgtatcaaaaaaataaaataaaatgaaaatgaataaatctttatttagaattaattttggtgtgaggcagaaatgcagccgttttcttctgtatgacctcttggttttcctgattcatttgttgaaaaagtaatacctccttttgtttttttaaactgatttaaaagtattattttagttaaacaataaactgtcatatatactttggtcaatttttgtttttatttaaattttctgtttcttaaccgagggcagattattttaattactgtaactataaaacatgtaataggccagatcactcccctgtatttttgcttatcagaaattttggggaatggttccttacattctttcagttgtatcttttagattatttgtttaaatcccctttgccttgtctcccctcccccctcaagtctattaagattctgcattaatttgtagaatatcaatatctttaagctttgtgcttaaatttcttgttaaacttattccagggcattttttgttgttacagtcaagaatataatcttttttcacttttttttttttttgagagggagttttgctcttgtcgcccaggctggagtgcagtggtgcgatctcagctcactgtaacgtctgcctcctgggttcaagcgattcttctgcctcagcctcccgagtagctgggattacaggcgcccgccaccatgcccggctaattttttgtatttttagtagagacgaggtttcaccatgttggtcaggctggtcttgaactcctaacctcaggtgatccacctgccttggcttcccaaagtgctgggaatacaggcgtgagccaccgcgcctggcctttcacttgtatttctaaataaaacttactttgggccggacacggtggctcacgtctgtaatcccagcactttgggaagctgaggcaggcggatcacgaggtcaggagatcgagaccatcctggctaacaccgtgaaaccctgtctctacaaaaaatacaaacattagtcaggtgttgtggcgggcgcctatagtcccagctactcgggaggctgagataggagaatggcatgaagctaggaggcggagcttgcagtgagctgagatcccaccactgcactccagcctgggcgacagcgagactccatctcaaaaaaaaaaaaaaagttactttgaatactgacatttaaagaaaaagacacgatgtgagagaatgaccatggaattagtggttgaagagccaagtgcagaggcctgtgatctggaaggttgcctgctatcttggagaaatatagcaaggaaatcagagtaactggtagtgtcagctaggagagtaacaaaaaaatgaggtgaagtcagagagaggggatagaggcgacaaatactataggaccttgtgggaaccatgcaagaagtttggtttctattcctcgtgagatgagaagtcatttggaagattatgaggttggtatgatgtgattgagattttaaaacaagatttacactgattactgtgttgattgatttggaagtaagaaccagtaggaggaggatcagttaggaggcttgaagaaacccatttgagaaaagatagtgacttggactagattgagtgtagttgaggtggtatgaagtggttggattctgccaataggatttcatgactgggaccggtcgcgatggctcacgcctgtaatcccagcactttgggaagctgatacgggtggatcatctgaggtcaggagtttgagaccagcctggccaacgtggtgaaaccccgtctctactaaaaatataaaagattagctgggcgtggtggtgcatgcctgcaatcccagctacttggtaggctaaggcagaagaatctcttgagcccaggagatccttgttttttttttcttttaagagactgactcactctgtctcccaggcctggagtgcagtggacatgatcactatagctcctcactcctgggctcaagtgagccacctcagcctcccaaatagctagggctacacatgcacaccatctgttgtgatatttttaaaaatttgttttcttattgtaaaacacaatattgtatgtgttcttgttgttttttaacttaaatgaattcatgcagatgatttggcatcttgtttcagtggaagagcgtgtgcgtgtgtacacttaagtttgtctgcaggatagattcttggtgtggatttgtgcaacatgggtatgaattcaagttttctttcaaaaattttccaaaatgtatcctttaataagtattaaatatatctttggccgggtgcggtggctcatgcctataatcccagcatttgggaggccgaggcgggcagatcacgaggtcaggagatcaagaccatcctggctaacaatggtgaaaccctgtctctactaaaaaaatacaaaaatattagctgggtgtggtggtgggcgcctgtagtcccagctacttgagaggctgaggcaggagaatggtgtgaacctggaaggcagacttgcgccactgcactccagcctgggtgacagagcaagactcttgtctcaaaaaaaaaataagtattaaatatatttttatatactcctcgggttctattagtactttacagtttttaatttaaaagtgagattactgtttaagttacatgtgtgcacattacccttttgtcaagttataagtagaatttctaccctttattttatttttttaaatttttaaatttttttggagacggagttttgctcttgttccccaggctggagtgcagtggtgcaatctcagctcactgcaacctctgcctcccaggttcaagtgattctcttaccagcctctccagtagctgggattacaggtgcccaccaccatgcccagttttttgtatttttagtagagacggggtttcaccatgttggccaggctggtctcgaactcctgacctcaggttatccacccaccttggcctcccaaagtactgggattacaggcgtgagccaccatgcgcagcctttttttttttttttttttttttttttttttttttttttttggagacaggatcttactctttttcccaggctgcagtgcagtggtgcaatcatggctcactataacctgaactcctgggcttaagcgattcttctccctcagcctcctgagtagctgggactaaaggcatgcaataccatgctgggctaaattttttttttttttttttttaattttaaattttattttaagagatggagtcttactgtgttgcccaggctagtctcagactcctggcttcaagcaatcctctctcccacctcaaagttttgggattacagttgtgagccaccacgcctagccacatctattgaatttttttattgttgttgttttgtttttttgtttgtttgcttgtctttggacttagtctcattctgtcgcccaggctggagtgcagtggtgtgatctcagctcactgcaacctctgcctcccagattcaagcgattctcctgcctcagcctcccgagtagctgagattacaggctcccaccaccacacccagctgacgtttctattttcagtagagtcggggtttcaccatgttggccaggctagtctcaaactcctgacctcaagtgatccacccgccttggcctcccaatattgactttgacttaagtgatacactctagccataaaatgtagtgttgttaaatgtcccatatggagagctagttgatgtcatgggttggtttctagtctctctctttttattttttatttgctatacctactggagtgagataatctcttttgaatattgaaagtttcagtgtaatttttggatcctaaccaattttcctaaatcctcccactcacccactgtgtgatctcattttcatctctacctactcatttctctttacctcaaaatgtcatcctctccagaaagccagctctgattacatagatacagggattttttttttcccaaaacaataccagttaatattgtctacacaaaagtagcatgcctagttggtatcactccctttcagtggcttctagttctgtgtgatttgcccagtctaacctttaaaagactttatttgcgtgccacctctctatgtggttacaatagaatgtcgggggaatgttgataaagaccacattgttcttatgtatatctttctcttacacaaatccataaaaggctttcgagatgtctctgctgaaaataaatggagctctagtaaatgttagagtttttgctagtagagttttgatgctttttgtctttgttctactactgagcttgcacctaggatgccttcttatagtgccattcaacatgcaagtttctttttctggggctgtgtgtccaggtgactttatgagttaggctttggcaaatgccagacttgttcatcctaacactagaatgtagggatcctgcattcagcatgacctgaaatttgctcaaagtataaaattgtagatgttcagtttttatacagaattcaatcttttgaagacttaaattagttcatatttaactttggacttacctggagaggttatcaattattctgcccacatgtgcacaaaggaagttcagtggaaataatttctaccctttggaattaatctaacatgaagactatgaaagtgagcatttgctgtacaaaatgttattttattacttaggtatgagctttgtaacagtggattttaggccaggttaaagagtagttaataagttacttttaagttacaagcttcagggaagcttgccacctggcttgagaccacctgaaagtcttttgaagaagaggtgtgaaaagaagagaagaggtgtggttggtaattgaaggctcctaggtggataaatttgctgaagaaagcaagtaatgtcccacctgggaatcaagaaccaactgttcgtcttagcggaccatcaaggtcgtgaaagcatgcagagtttataaagtgttctcagaaagcacagttttagtatctttttaaactgtcagaagtttgatacctaggtaagcacttagagcttcaagtagttagatttcatcaatgaaaaggaagcaagtttccttacccactttgaaggtcagtgtgttagacaaatggaaatcttttaacaaactaatcaaacatccttttagtagtgtcacacaagtatctagaaaggtcttcgcaataacaaatggggagctaacttctcaataacaaatggggataacaaatgggtagctggctttttatcagatgctgaattgtcagttttgtttggcttttttcacaggttcaccggaacagcacaatccgccctggctgtgatgtgaatccctcctgcgcactgtgtggttcaggcagcatcaacaccatgcctcccgaaattcactatgaagcccctctgttggaacgtctttcccagttggactcttgtgttcatcctgttctagcatttccagatggtaagaaagaccacagactagaaagtctaatgaaagaaacttgagagacttctaggtgaaagaaaatcagccaaggtgcagttacaactcagatactttcaaggtacaactttcgtcaaccaagtcttctcttagaattttgcaaaaagactgtaacagatccaccaaaccagaaggtgccactaaaaggttgcaacttaatatgagatttccttctaactcttcaagtagctaggagggatctgggctcagttgcctctagccacagtaatctggtccaaaatacgcttagtatatctttaaaaatgttttgtctgggccaggcgtggtgggtcacgcctgtaatcccagcactttgggaggctgaggtggacggatcacctgaggtcaggagttctagaccagcctgaccaacatggtgaaaccaccgtctctactaaatataaaaaattagccagtcgtggttgtgcctgtctgtaatcccagctacttgggaggctaaggcaggagaattgcttgaacctgggaggcagaggttgcagtgagccaagattgcaccattgcactctagcctggataacagagcaagactctgtctcaaaaaaaaaaaaaagttttgtctgtgcgtgccatgatataatgtaggatggacggcagtgttctaggagaatatcttcatactggcatttatgtggtaacgcgacagctttgcagggtgtagataagcacaaatcttcgttgttagcttgtactgtctttctaaagtttgcctccctgttaaatctctgtgtctgacagccctcctttcccacctcccttcccatacctgtacctctcccacttgacaaaagaagagcattccttttggccatattgagtcccactatgggtcttgccccagagtgtaaaaatcttgaggctcggtgtcgtggcccacgtctttaatcccgtcactttgggagaccaaggcaggcagatcacttgaggtcaggagttcgagaccaggtgtggtggctcacgcttgtaatcccagcactttgggaggccaagacgggcggatcatgagatcaggagttcgagaccagcctggccaacatggtgaaaccccttctctactaaaaatacaaaaattagcagggcgtggtggcatatgtctgtaatcccagttatttgggaggagaatcgcttgaacctggaggccagaggtcgcagtgagtcaagatcatgccactgcactccagctcgggcgacagagcaagactgtctcaaaaaaaaaaaaaaaaaaaaaaaaaggtcttggatggtggggacaacaaataaagagatcatttctaagagttctcagcacctgaaggagaatctcccaggtattaagcaaaaaagttttgaattttaaaaataaaatagagataactcaggaactcctatcaaccaagtcttctcttagaattctccaaaaagactgcaacagatctaccaaaccagagggtaccactaaaagattgcaactaagagatttccctctaactcttcgagtggctgggatgggtctgagctcagttacatggtcctattccttgtctgtcttagaataaatactgagttaatatctaaagtctgattagctaaataagtttaaaagaagttttttttttcaattaatgaagctaaatatatttacatgccaaagttttgataaaaatgtttttaaagcattatgtagtattcaaatataatctttacaactatctgaaattatgattttttaaaaatcacatatcaaatgggggtgcatgagcaaagacattttgaaaccactattctagatggaagccagcgctttcataatctggattggtttcattgaattttcacgtaatctcatgatctgtgcccagcctacagaaggtaggaatttcctctcaaatcactggtgggtttttgtttttgttgttgttttgttttgagacagagtctcgcttttgttgcccaggctgtagtgcagtggtgtgatgttggctcactgcagcccccacctcctgggttcaagcagttttgtctcagcctcccaagtagctgggactacagtcgtatgccaccacgcctggctaatttttttgtatttttagtagagatggggttttaccatgttggccaggctggtctccaactcctgacctcaggtgatccacccgcctcggcctccctaaagtgctgggattacagtcaggagccactgcacctaccctattgtgttttatcaatatgttaatgaattatgttatggctgtttgtgtatttgctttctgttatttaaattttagggaccaggcacagtggctcacacctgtaatcctggcacttttggaggccgtggcgggttcatcatctgaggtcagaagtttgagaccagcatgggcaacatggcaaaaccctatctctactaaaaacacaagaattaactgggcgtggtggcacacgcctgtcgtcccagctactcagcaggctgaggtgggaggatcagctgagcccaggaagtcttggccgcagtgagccatgattgagccaatgcactgcagcctggggaacggtagtgagaccctgtcttggtggcggggggagtggggaagggatgggatgtaatctccctgaggataagggctccatgctgttcttcataatatctcccaggtagtctgtaagttttttttttgttttttttttttttttaatttttattttttagatacagggtcttgctcggtgccctaagctggagttcagtggagtgatcacagctcactgcaaccttgacttcctgggctctaaacagtcctcccacttcagcctcctaagtatctgggactacaagtgtgcaccaccacaacctgcttccccgcctcccgccccctacaaagatggggtcttgctatattgcccaggctggttttgaactgagctcaagtgatccacccatcttggcctctcaaagtgctgggattacaggtgtaaaccaccacgcccggcctgaactttttcttcaagggccatatggtaaatatcttaggctttgcaggccatataattgatgtcagttcatgtcacaactgctcaaccctgtcattgtagcacaaaagcagccatagacaatatgtgaacaaatgaacctgattgtgttgcaacaaaagtttatttataaaaacaatcattgctaacccttgtcctagagagaatccttctaattgacagttgatcaaacattagataactataatcccctgttctgcatctgttcttcaaatgattgcatttctggccacctaaatccagtagataccgggatttttggcttttgttaccaaaaccccctagctgtgataaggatgtggtgtaatattcctgtggccatgtgatttcttgtaagagaaaggaaacagaaaacctggaacacatggatagtcaggagctggtggagcaataaataaacttgaacacaatgagtggaaaacactaaaacattttcctctgtgcttcagattccagagtcactgacttttaccttcccttgccattggatttatgtagcccatgtaactgcagttactatttgtatagcattttaaagtttgtagtactcttctcatatttgtctcatatgctgctttcaaaattctttttttttttttttttttacttttgagacagttttgctctgtcacccaggctggagtgcagtcgtgcaatctcgggtcactgcaacctccgcctcccaagttcaagcaattctcctgcctcagcctcctgagtagctgggactacaggcacgcgccaccacgcccggctaatttttgtacttttagtagagatgggggtttcaccatattggccaggagggtcttgaactcctgacctcgtgatccacccgtcttggcctcccaaagtgctgggattacaagcatgagccaccgcacctggcttttttttttttttttttttttttttttgacagagtctcactctgtcactcaggctagaatgcagtggtgtggtttttggctcattgcagcatcggcctcccaggatcaggtgattctcccacttcagtgggtagctgggactacaggtgcacaccaccatgcctggctaattttttgcatttttagtagagaagaggtttccccgtgttgcccatgctggtctcaaactcttgggcccaagcgatctacccatcttggcttcctaaagtgctgggattataggcatgagccaccatgcccggcccagaaattttgtaaggtgttacttcagtgttagtgctcaaggaacaggcttggtaaggttgtggcttatctaaaactaaatggctaatgggtttgaatgccttcacagttcagacccagattatctgatgcctgtccttccttttactatatttcaagttcctttccagacagattattaagaggagtcagatttttaccctttttgggattctggctacagacagcgccactaggaagacttaggaatgtttgttgggttactctctgaattactgtgttgaattgtatagtctcatacttgaagaaggacaggaagcccggacacttaagcacactcattggatatcacctgctaaacagaacagtcatttctttgtcaacagcattaccacatacagttgcaaataacctcccccaccctcagatatacccagactgtgtgtctctcagctcctgttccatcattcagcatctctactaagaggttccatttcccttgaacattttctgtcctgctgactgcaggacactatagatctgacatgaatgctgccctgccgcataccttacacctcccacaccatcattcagagcaactacaggcagcaatgagggggaatggaaagaaagatagggaacactcccccttttctggtctttatggtttttattttcctgcatctaatcctatttgtttttctgtctatgtctcacacacacacgaagagcttctagctatggccctggggtttggacgaaaaagttggtcattaaattctccttatgagactgtggagatatatatatatttttacatgtaggctctattaactactgtatttgcctgtagattaattacacctcagttggttgacctgaagacctgattaccatgtctaatattattcctgttggaataattttgctttgacccaaacaactgccacattcagaatgcagtccatttggaaatcagaagattcccatgggtgcagagatagccaactccaaagggcaccattcacataatatcccgtgtaaataacacaccccctgaagtcttgggattccctgtacatcattgtatagcagtaaataacagtgaaggctagcagcttggcatacgactgtgtaggtcaaacatttgtgtggtagattttactactgggccacccttacaacctcttctctagaagatgttttaaagtggcaggatttccaacttttttttttttcataacaaggttaaaaatgattttgattcattgattccatatagttacatttataccagacataaaggcagaaaattgtttgaatgtgatacttagctgttttctggccccataggacagatatttttttaagtagttttagtgctgtttcctaaccagtttgtgtagtttgttagaataacaaccaactgctgcttttcatcctggagttgtgcctcgcaccttgactgtacctcagcccctctcattaagtgtgtgtgggtgatagaaattgagggactgtgttatagccaactctacgcctggctgtggaaggtggagagactagggtataataacctgttagtattccagcaggaagggggctttgttttatcacctcaagtaatcaaatccagttaatccttagttggaaatgtagaggatatataaccttggagaaaagcttgttaactttataaaaggggcttaataagagcaccacctgctggccatgaagatctgtggtattttgagagagcttgccaaaccctgcacatgaggctacagcaacttcccagcaggaggaagaagtgagcattacaaaacacccggaaaaagtgcgcctgagaaaatggtggaaagtaaggagccagacagccaggtgaatcgtggaatgtcagaccctagtcatcctgaagtcagggtcttctcattcatctttcattttgtttgaggaaacagtaacttaaggatgacattagtaattcgtcttattttcctgttatttacctgataaggatcagcaccctcttctctgaaaatagcagtttacctatgtgggtatggaatgtaggagacctctagctgaatggatctctggtgtgttctcttccatttcatatccctttttttgcttactttcaggtcccgtatccagtctattttagatttttaactcttcacagaacctaggtattatcacttactagttagtatatgaactcaaccagcaattcctaagatatcttttttttttttttttactgactgggggatctaactgggttcctgttcactcttaacatggaagcaattaaaaggcaacacagcaaacttctaacaaagtctagcagctggagttccttaaactgtttatactgggtttaaagaggaatcgctcttgattccgcttaatacgtcaactggagagtacaaggtagtgttccatgacttgggttctacaatgtgccaacttgcacttaagagcatttagttgaggggaagggtttaggagtggagttccagttgaagagtcattgactaaacattttagagttgagagactcatagcagtcatataatctagcagtaacaaatagatgtcctttcttgtgcctattcaaatgaattgacagtaactgtctggagttatttaatgtattgtttgggaagaatctgaggtctccagtacaacaggaaagacagctgtgtttgtacctccagtacaacaggagggttagagaatgaatgctagaatgttgccagccctgatctagccccactgcctcatttcacaggtggaactaaagcccagctgaatgatttgttcttgctttctccttctactcgagatagaaccaggacctgaatccaggcctacttgtttctagtcattgctgttttcactataaccaggtctctcatatccctgtcccttttttttttcctggcttcattttcagatttgggagaacgatgggggaaaataaaaggaaaaaataaaatctatgttttttggagttccattacatatatatacaaaacatacacagcctttgccaagtgggagtaactcttctgctgacaaaggggtattgtgggatgggcagaagtgacctcgtctcctttcttgagcctcttttatacattccagctcagcccagctttcagattgttttacagggccgaatgcttctagacaatgctttatttcctaggatttggtatagctgagtttttaagtgtggaaaagagtgattatgaaaaatgtttgagaagacagcactgtcctcagagactgtgtttttacacttggacaggtagcaaatgtttgttttcattaaaactttaatagttttcctaatttgtttcactgtcataaagcccagcaatcatggagctgagggtgcttacccactgggaaaaatcatccctgagaatgttagctttttttttttttttttttccccaactcagatttttattccagtcctggaaggcctaacattcagtcctcgaaggcataacattcagtgtcatgaaattcatcatctataccataggcaggagtggctaaatttcttttactctgcagaactggcttggaaaatattttgtactgtctatttcttgggagtaatttgagaaataattgactttactacagaatcctctccatcctctggatcagtgagtagcctcaaggtatattgtctaagagtatgggctttagggttgtataatcttgagtttgaaagttggttgttactcattaaactatgtaaccttggacatagttaatgtacctttctgcacctgttccctatctttaaaataagcataattgtgtttgcctcatggaactgttacaaagattaagtggcacacgcatgatgataaacacacagtgcctggcagataataatgggttcagtaatgttaatttagacgtctcttccctgccttcttatcctcagttcagattgagcatatcctctgtgctctatgggacccaaaaccccataagcttttagaaaatatattaaacaggccgggtgcagtggctcacgcctgtaatcccagcactttgggaggccgaggcaggtggatcacgaggtcgagatcgagaccatcctggctaacacagtgaaaccccgtctctactgaaaatacagaaaactagccgggcgaggtggcgggtgcctgtagtcccacctactcaggaggctgaggcaggagaatggcatgaacctgggaagcggagcttgcagtgagccgagatggtaccactgcactccagcctgggcgacagcaagactccgtctcaaaaaaaaaaaaatatacacacacacacacacacacacacacacacacaaaataaatttctaatagttctagaagacatgctatcagtgactggaatttgtaattatttttgaaagatggataaagacaagataactgtgaagaaataaatagaaagatagcccaaagcacatgccaggagtaagttgctgtgaggtgggaactgattacaggaggtttttgacccagaattaaagggcagaaggagtagtgataggacctgggcatttgtctgggtgataaatttggactcattttggaatagctaggttagattttcctttcctgtcctctcaccccaccagagccttcttccttgaagtagtggtgtttcattctattctgaagcagtggatagggactctggcgggaacttctgagcatgccccaagtggttaccgattcccaggaggaactgggaggtgaggaaaaatgtgctggcttttagatttgaatatccctggaaagctttgcagaagcttgaaaacagactcacaccgctatccatggtggtgaaatgtcagaatattgaaaacatgaaaaggaaaatctaaaagttgtacatcagcaccagaggttccagtcagagtaataggcaagaagtaaaaaaggaatacagattggaaagaaaaggtaaaacagtctccatttgtagatgatgtacttatgtctatagaaaatcctactgaataaacaagaaaaagtctataacgaagtagtttcacaggctacaaggtcattatatagcagtttattgtacttctatatactagtaatgaagaactgaagttgaaattttaaaaggtactatctttaatcatttccatctgagacttttgtcagcctggccttcactgcccgtatttctatcagtattttggtcaaaaccatttaacaaatctctaagaagttccagactttccctcatcttcctgtcttcttctgaaccctgcaaactcttccaacttctgcccatcagaaaacattaattcttaggaataaacttaacaaattgtatttaagaccggtatgtcaacaataactaaacgctgtcaagagaaaatcaagacaaacgtaaatagatggagagagagataccacgtcagtcgattgaaagattcagtattggtggtggaacacatggaagttgtccccaaattgatctgtagagtcagtgtaataccacaagtttgttgttgttttttgcagaagcttaaaaggcaaaaaccagaccacctacaagtaagaaagaatccgattccctcttaaatatagcactggatattagaatacacggaagaattgaatagctttaaatgtttgagaggaaaatggtttaaatctagaaattccttttctaaaggaattgctcaaggatatattcttgggaaaaatctaagaaaatggaaagataagaaacagcataaaaaattcagtccaaaagatgttgatttgtgatattgaacattaaccagtcagctaaaaatccccgataatctcatgatgggaattggcggagccacagaggaaggaaagagagaatggtatgtagttcttatttggagagagtatgtagtactcagtacagtgcctgataacatagataatgaatattgttgaataattgcatcctgattaactttatattgatagaaaagaagtaggcttaaatatgtttttaaatctctagaatagaaacaggatgttttcaaaccagtaaattcaacaaacaaggatacaagaacaaaaactccatcaaccaaaccaaaaaggtgtcttgttttgtttccctttgggacttgaaagtaaaaagctaaagtgacctgcttgcaaatagaagaatgaccttcagtaatgttcacgtaaacagatcttccatatgacagcacttgccctgccaagtgtcaggccactgggcaaattaaaggaggatggagtgtaggtcttgaacactagagaggccaggtgtttggactaacctgtagcattttatgtttcttgcagatgttcccacaagcctgcatttccagagcatgctgaaatctcagtggcagaacaagccttttgacaaaatcaaacctcccaaaaagttatcgcttaagcacagagcacccatgccgggcagtctgccagattcagctcgtaaggacaggcacaaattggtcagctccttcctaacaacagccagtaagtgtcagggagccgggaagtcccccagagtatcagtgacttttcattccttttatattctcaaatttgtagtttgcatgcatgttggggttgggagaggcagttgaccgataaaaaattcagctcacagtgactgcttctgcttgtcttggatgctctcagatggacttcgggagctattctagacaccatggatcttggagcaagacccaaaatgctcagtgaacagccagcaatggcatggcattgagttcatctacgggcaggtgtcttctgtatcctggtgacatgtttctctggttctgggctccctgtgcctatcctagccattgtgcaaattactagaaacttcagtcctgaaggactgtcctgctgccctgggtatacggcgttggcctagagagaactcgagagcttggaactcgaataagaaaatatttgagaggacatatttcacagctctttttctgttcccctcttcagagctgtcccatcaccaaacccggcctgacaggacccacaggcagcacttagacgatgtgggggccgtgcccatggtggagcgagtgacagcgccaaaagcagagcgcttgctcaacccaccaccacccgtgcatgacccaaaccacagcaaaatgagattgcgagaccattcatctgagagaagtgaaggtagggccaggcccatggcacctctacctgcaactgcacctgctcagggctttctggggcagcctaggcttctcttaattacccccagctttgtccttcactttctaggaaagcagagtagagggacgctactgcttctaaatggaggtcacttcttaactgctacagcaacctctgccctgcccctacttcccacagctagtgtgcttcacctttttatcctctaggcatagaaaacatttttgcctttagtatgtattgctgccattccaagcttgtgttagaagtaacgctggttaagatagccatgtatttctctcttttctgttgacttctgcagtgttgaagcatcacacagacatgagcagttcgagctacttggcagccacccaccatcctccacacagtcccttggtgcgacagctctccacctcctcagattcccctgcacccgccagctctagctcacaggttacagccagcacatcggtaagtacctgtgtggggttggccggacaccccctctgcaggtcacagctcactcaagtggctccagaggacagtgtgagggtgggttataaagcccagggcatttataggatctcagctcatcatgacatatgtatgtatgtctgtaccatttttaagtcaaagtcatggtacttgaccttctgttgtttttcttgagttgtttttcatagcagagatggatttatgctgagccatccatagaaagcttgatgcagggacaaactcttaaggtgatctgtgactattcaagatctgttggactaagtttcacacaggactcaacagttccgtggccctaatcctgttggcccaagaagtgaacaagagaggaggggtgggtagaggggagattcccatgggcgttggaagcagtgtttgatttccttggttttactctctgggtgagtggaggtgaagtactaagaataaacactaggcgtgagggtaccagaagagaagggaagggagaaggcagagtccatgctttttaggtatacagagcagaattacagatccagcaggcccccatggcaggacatttggcatgcacacaccagattttacgataccacactccatctggaagcagtttgcacagctattccagacacatttcctttaatttcattctaatattttaattcctcaagtgtgccctcttggaacatacatacctgtagctgctatggacctactcaaagggtcctttttgtataataattacaatgtaatgtaatggtaaatgtaaaagtctgcaactgtaatgtttattgaacacttactacataccagtgatcagtgatttacatgtgttacatgttataatgccttttgagatgtaggttggtactgtggatttcattttatatgcatgaaaactgtcaaggcaacttgtgagggttataattatgattcaaactcaggcagcctgactgtagagccagctcttttaccattacactacacaggctaagcctgggtgagggtattgcagaggcaacttaggaagttccttcagagcctagatcaggaaacttccaagctcataaaatggactcactaggctcctgtgatcaggtaggaattcacattgttctctctttgctgttacaaatcaatcttttccaaatggtctctttgctcttcgactttctttacccccgtaacccacaaattttatctaaataggtgtgtagtgtccctcacatactcagttatccagcagcaaagggtttcagataaccaaagtatttataaaaaagagtctaaactaattctgatagaaaatctgaactcagagattcaggacttggtgagcacttcaatatttctgtgtctggagaatgttaacttaggcctggatcacttgaaatttttaccatttattgagtaaaaattttgtgtatagcactatgctaacccctgaggctctctcattgccaagttttttcaaagactctggatttatgtaaaagaagataggccaggcacagtggcgctcacctataatcccagcacttggggaggcggctgaggcgggtggatcacttgaggtcaggagttcgagaccatcctggccaataaggtgaaaccctatccctactaaaaatacaaaaattaactgggcgtggtggcatgtgcctatagttccagctactctgaggcaggagaatcacttgaactgggaagcggaggttccagtgagcggagatcaagccattgcactcaagcctgggcgtcgcagcaagacttcgtctcaaaaaaaaaaaaagaaagaagataggccagataacagcaggctctcagtatctgcagtatctgcagtggggattggttccaggacctcccatagatagcaaaagctattgttgctcatgtccctaatataaaatggcatagtatttgcatataacctatgtgtatgctttaaatcccatatactttaaatcatctccagattactgataatacctaatgcaatgtaaatgctataaaaatagtatgctgtattgtttagagaataatgaaaagaaaaatctgtaccttttcagtacagacacaatttttttcccccaaatattttcaatccacaattggttgaacccatggatacaaagggccagctctccttgaaatcaagtaaagaagccagaggacactggagaaaggtagggaggagagcgagtgtttttgtcagtgcttcccaaaagccagtagctgcatcagaatcacctcagcagctttaaaaaacaaaaccaaccaaccagacacttctaaagatctgatttgttgctggctgtgatattgcatgcctgtagctccagctactcaggaagatctcttcagcccaggagattgagtccagcctggacaacatagtgagacctcatctcttaaacaaacaaacaaacaaaattctgattttataaaagagcgggggggagtcctagaaccttttttttttttttaaaaaatactccttaatgttgcttctgatatacaaccaagtttgggaaccagttttattctcatcacctgctctctatctctggctctaaataggagatagtagttaatttagacctaatgagtagctaacataatagggggtgtgtctaggcagaggatgagataagagcccgttgaaccatcccacaacctgctccagtatctttttctcgaaggtactaacaacaagcccaagaagtttcagggaaagtgtatacctgtttctgccagcagtttcacatttattcttgaccaagatactgggaaggctgtctctcttgaggctttcttaagatgcatttcttgtagtgggatgtataatttcagcacagatctggcagtggcagaggtctctgggtatgagatcactaatcctcagctacagaactcaggcaagatccccaaaagtctgtttaaccattttggttaaccagatatcctaaatttctgaggtcaatggcagtcatctgatttgatagagaaagaaattgaagtgaaaagggcattgtggtcatctgaagttataaatgacagtgactgaaactctggcccaggaagtgctgacttttaacattctctgagaatgtcctaagatgataggatgaataaagggtatctcaccgtccaggaacagaggatagaggggttagttataggggacttcttactcctccaaccccttccctgtggactgaccacacttggtggtttaggtataaatgcagcctcttaggtgttttccagctgttttgttgccatggcagcgtgtttgttatgccactgtttccttctggcctctcacagctcagttgctagtctctgtttcaggatagggtattaactatctgggcagcagcagctagtagacttcttcctccatccaagagactaagccatttagttccctagtctcccagctactgtagatgcttacctctgcctctgatattcgatccttggaagtcttatttttccaagagtttggtcttctcaactatttcctatagaagcaaatttcctttcaccaggaatgtgaggtatagtcaggttctcctctttagtttccctccattcatctcctttgatacagctagaaagctctcagctctttccccaagaatcatcaaaagaggggaaatcacataaagactgggcagatggtgggtgcagatttagctgaagagttcagatctttgagaaggaggtgcattcatgacaaccaaggttagatgatgtattgagatgggcctatcctttgggcctctttcagcataagctttcaagcattgcttttaggggaggggccactatgagtcttaagtcataaacggggataaaggaaggaaataaagattgtaaaaggagaggaggttaatagaggtgtatatagagtaggaaccccaacagttaagatcccaggtacccacccctatgaaatttacgcatgagcccttgaaggaagagggtgaccagtgggacttatgaatgggactaactcctcatgaccacctggtatttctccgtgaggttttttgctgttggagactgactcctaggtgggagcagctgctatggtcattactcagcttcaacccaaggacccagatgcttggttattggtgatcctgctttaactcttagatgaatgatttgatgtctgtaaaattgtaccttccttttaaacttaatttttatcttacagcagcagccagtaaggaggagaaggggagagagctcatttgatattaacaacattgtcatcccaatgtctgttgctgcaacaactcgcgtagagaaactgcaatacaaggaaatccttacgcccaggtagaagctcagaatagttggctcctctccccattcttcctgctattgccctttttccctcttctcttctgaccaagagttgggccctagtctttggttctgtcttctcattaagagaaattcttatctgataagaacgaaattatttctgtatatagttctctctcattccattataggaatacaccaaacgaaccagcagtcacagcctggtaggccattcacttactggtctagagaccggttttgtcaacacatacagtatgttttaaaatactgaatttgttgtcaacatcaaagcaggatttcacataaaaatctttgtttccagcttttgttgccaaacagaagattaggcaaccctgggtatgcatttccatatgggagcaatcagctggtcctgaacagtggtggtcctctttaaacaggtttcttttcttgtgtttgtcacagtctctcagcctcagccttaccctaggccgcttctctcatttctggccttcttgggcatttgagtaggtggccaatttcacaggccttgacagggtagggagactgagctgtgatagggcagagcctacccggcagagagcagtgtcacccacaggtgcaggattctcatccttgcatggacactttgaccctgcccccagttttagcctgcttgccatctcatgattgtctgttcttggttttgcagctggcgggaggttgatcttcagtctctgaaggggagtcctgatgaggagaatgaagaggtaatggcctggttcttctgttagaagaacacgtgtgtacacatgcacacatacatatgagtgcacacaccctaaatggcctgaagacttgtgggtgtgaagtgcaagctccttgtattcctgtcgtgaccgggaagaacctagaatggggtgggactggttcttaactcctggagaaaagaggggatcgatgaagctgctctattgcagattgaggacctatccgacgcagccttcgccgccctgcatgccaaatgtgaggagatggagagggcacggtggctgtggaccacgagtgtgccaccccagcggcggggcagcaggtgatggggcaggcttgggtccccagggcctgtggagagagggtggacagggagtttgggccctacttgagtccatggaattgctactgcctcttggttgctcatcatactcatctactggcagtggcaaatagctcagaatttccttggtgtttgttggaactagtggagatacatggaactagtggagatataaggagccaagtgctagatccttgctgagaagtcactatgtaattctgaattcccatgatctgtggcatttggaagacagttggggggtcatggtgattcaacccggggagcttggaaggcctcgctacaagttaaccttcctttggacagtggctttgtgatgccacttgaagaaactgcccccccttaacgtccatcactaccctgtctccatttattgttaacagtggcagaaaccctcgggattctcaagtagaaagttttgggagctcttacttttacttttttttctttgactacagttttcaaagtctacacgaatctccctaacctcctgaattcactaggcactttgctatggactcacctggcattgttcagccatgcttttttcttgggatggtaaatgttgtatacctacccctccagagaatagtgggaagaaatgggagttgctggatcctaaggaaaatctgttggtgtttgtttgcctcaactcctccagtggggatgcttttttcatgccctctacccccataagtaaacatttcccaggcactcagatttgcattccttggtgtgcaggtcctacaggtcatcagacggccggacaaccccccagctgggcagtgccaacccctccaccccccagcctgcctcccctgatgtcagcagtagccactctttgtcagaatactcccatggtcagtcccctaggagccccattagcccggaactgcactcagcacccctcacccctgtggctcgggacactccgcgacacttagccagtgaggatacccgttgttccacaccagagctggggctggatgaacaggtaagggacgcagcctttgggtggggttggcatggttgggggatggaaccaggaaggggcagcatctgctgaagagggacctagccatcccctcccccttttgaagggacaaagggctgcacttaaattgatctcctcaacgttcagtggaactgtattgatcactgctaaatgatcaatacagttgtctgggtataccctaggaggggtgttcccagactgtcgcaggaacactagatagactggtcctaggctccaggccacaaggtttgtggcagggccttggagcaggaagcaggctggctgggactgggtcctcaaagagcaacttgtctgcctacagtctgtccagccctgggagcggcggaccttccccctggcgcacagtccccaggcggagtgtgaggaccagctggatgcacaggagcgagcagcccgctgcactcgacgcacctcaggcagcaagactggccgggagacagaggcagcgcccacctcgcctcccattgtccccctcaagagtcggcatctggtggcagcagccacagctcagcgcccgactcacagatgagcgggagacagccatctaaacagactcactaactattggcattaaagcttcagaaatctctgcgtttgatattcaaacatcatatgccggaaattttcacagtttttagtgaacttaaggaatttagatcctactttggtatttttttttcttgttttaatttttgttttgtttttgtttccatgttttcttgtcacacacctgagcacttcctcccgttggcaaacagaagttcaggatgagaccctgctggcctggtcctggcacatcctctgcactgttgaatcactggacttactgatcttagatgaccaccccctccctcacacctgtgggcagggcagaacagcctggcgggctacagtttagcatggccttcttgagctagggtggaatggggcagggtgctctggactcttaccccctcccctcccatctgtggcttggctctgctgtggccctcctggctgggtccccttggtttttcgtgctggaacatccccaccagagcctctctgccataactgccagctgctctccccgagtgctcagctggcagaacacctttcctttctcacccagaacttaagagactgattttttgtttcatctgcatttggtcttctctgttttgactctttcactgcagtaacctggctgtggctgctcaggttcccctcctcatgccccttggtacccttccctgtctgctctcccatgccatgtacacacccacaacccgtccttccacttggaatatttttaccacctatcctgatctttgaaggtagggttaggactacttaacctctattcccactcccctgcaaactgggggttgtgggaagtgagcagccatctccctgtgtgattttttttttttttccctctgattcactttgccatgtttccttcacatccagatccctgtcggtgttagttccactcttggtctttcacgctccccttgcctgtggaacattgtctggtcctagctgtggttcccattgttcccccttcacccttctctgttaaccttgtgcctgtctcctgtatgatcacatcaccaaaaagggggaggggggagaagactctttttttttggccattttgtaatcgtataaaaatagtagacaactgcttaatggttggggttttttcacaattttcaacattagtgatttttttttctgtttgcaagttaaagggtttgtcattgtttctttaaaaaaaaatacaataatgcaccatatccctatgcataaagtgcttcttctatttataaggttgaaaattctgaataacccttttagcattgaaaaaaaaaacaaaaacaaaaaatggaaaaaaaaaaccttgtattttgtaaatattttcttttcctgctttggagctgtgtaatggcagcgaaacatgtagctgtctttgttctatagaaatgcttttcttcagagaagctgatctttgttaatgtcttgattctgttcgcaaagcacagactagtgcttaaaaaaaaaaaagaaggaaaaattgaaaaaaataaaaaaaaaagttacagaa

SEQ ID NO: 10 - DNA, 129981 bp, Homo sapiens
  source 1..129981: mol_type = genomic DNA
cccgcggacaccaggcaggcccggccgggtgcgcggccaaggcccgctccccgcgtccccgggcgccgcccccgcccgcggctgggctccgagagacgagtgggagagcgagtgcagcgagggcgagaggcgagccgagcaggccgccctgcccgcggccctagcgccggcgcgaggagggggcgccgcggcccaccctccttcctgcctggccgcgggccggccgggccgccgcgccccgacccccatggccacccaggcctccgggccgcgaagtcgcagcgccagacccaaggcccccgagtgagcgcgggcgccgaggtgagcagcgagcgccggggcgcggggggcgcagtgtatcctgccccggggcgggggcggcgcgaggcgtcgggatcctaggccgggtgatgagccgaggcgggttcggacgccgagcgcgcgcgctgggtggagatgtggggtccgcggggtccttgctttgtgtggtgtggggggtgcgcgaggtcaccggatggacgtctggggagctgcagggtgggggcgccctgcgccgcggctgagggtcttctgggggatgtgcggccagctgaggtcgggtgggggcatgggggcgcgaggggcgagtgtggcaagggatctgcttgcgccgaggcgcggagtctttgcggagcgtggggtggggacgtggggtgcattcgcggggcgccgggggcggaggtgagctttgtgagtgcgtccgaggtgggggacggggagctgacttccccatgcgtgacccgggcccggcgtggccatcgcttgggagtcagggccggcgaaggccgtgcgtggcgagatgggtgctcgggctctctgcggtgtccctacccgggcagcggccccggggcctgtgcgcaggccccgaggccgggcaggaagcggcccccgcgacctggggagctctgtagcggccaggcccgggaggcacgggcccttcggggatgacgtcacgggcgggggccccggacacgcgagccttgcgccccacagacggcggcgcagcccgccgcccttttcgaggccggccccccctctcacgcgccttgaaggcagggaacccgggaggaggacatgggggccgagtgcggcggggacaaggggtggcaggacgcgagggtgacatttggagcctggtcgcgccaggggcctccgtggtggggcggaggggaagcgaaacaccagccaggccctaggccgtcgcggccccagcttcctggggcgcccgttttcccggctagcagttttctttcttggggctcttggtcgttatccagtccacgcaggggccggagtgcgggctgccgcggtgctctcctgcgcggagcccgggctggcgggggcgcggcgggcctcgggctctgaatggatgggagcgagtgtaacaatgcgccggtgggggctgggggaggggaggccgcgcgcctgaatggcggagccggccgggcgctgctccgcgcgccgcacactctcccgcgccgccttccccgcggtttcggcgggcccggattcagggacccactcgggatctgcacggttcctcccaccaatactgtcccccgccccccttttatgtctttccaatgcagtagtgtgttgagaattcaagggcattacatctggttgcaatccagtttcatgccgctgccgggctgttaagacctcgcgctgacgtcagagcaggggaattacttctttttattttatctttttttagttgtctgctgccctgggaggagaggcgggggtgggttaggctagctctgatgtggaggcgccagcgtgatgggagccccgagctgggggctctgcttctcttcctgcccctgcccccctccattctccatacagtcctcgctctgctcagggtcaggcccaccccaggtggggggcagccctcgctgcagactgaatggtggcccctccctgctgaccacacagctgggttttcagaggctttcctgggacgtggccctcgggatctagaaactggaaaggaatcttctagtttcccacccctccccctcttgacaggcaagccggtatattcggggcccaggagcaaggaaaagtggccttttgcgtgacacagaagtggacacatcattctgatctcagggcaggctcagccccataactctggcaaaagctctcacaagcaaaagccttggagaggaggagaatgtatcaaggtgagatccaggccccagaagccaactgtggagtgggcaaaataggacctttcccaccagcctagcatccctctggcttctgtggagataaagggaactcaggggtactggagctgcctttctcttccactagactgtggggctctcataggcagggaccctgtcttactcctctttgttttatttttgagacagggtcttgctgtgtggcccaggctggagtgccttggcacaaacacagctcacttcagcctcaacctccagggctcaagcgatcctccagcatcagtctcctgagtagctgggatcacaggcgcccgacaccacacgtagctaattttaaatttttttttttttctagagacaggggtcttgccatggctggtcttgaagtcctgggctcaagcgatcctccctctttggcctcccaaagtgctgggattacaggagtgagtcactgcacccagccttactcctctttagactcccaagcctagaccaattgctttcaaattcttgcccgtgacctatagtaagaaatacatcgtaggtaactacacaggtcacactgtatatagctgaaacaaaagtttactgaaataactcccttactgtgtctgctggtctgtaatcctttttgttcttgtgtatttgttttttttttaattactgattgctacccacgaaattaattttgcaatccactgatgggtcatacccagaatttgaaaaaaacaagcctaggaaatgaatttgccatctattcatgcaacaaatgttaattgcaaccctaataattcctctcatgttaaactactcaagtaacacttggatacttgggtgaaaaatgcaaataagccagaaatatatgtagtaaaagtaaaagttcccttggcaccctccctgcaggtaaccccagttaatagtttgaacgtatccttccagactttttgttactcacttaatgcatatatatatatatatatatatatatatatatatatgtatgtatgtatgtatattacatataccaatccatgcatagttttctttttccccaagtgaggacatactgtgggctcttcctcggcagcttcctttttcctctccgtttgtcttggagaggttggttgtgtggcgaagtccttcagggcaagttctgggttgactcctggctccaccacatactgaacaggccatttacctctctgtgcctcagtgtccccatctttacaatcaggagaataacagtacagacctcacggtactgaagtaaagatgcagtgagttaatccatatgaagtttagagcagtgcttttgccaataaatgctgattgctgccgtcattgttgtattgttattgctgttctatctccatggcagcccatgtttgaaatgcattgctttccacagctgcctgtggccatggcatgggtgtctttttcctcccctatccaacgtgtggctccacagggagggaggaggtgcaacagcaacggtgtgcgcagagcagcgtctctgcgggagaggcacctgggcactgggcccaagggaacagggattttccaaggacccactgtttccaaagttctgtgcttaatgtcggggtccaagcaggaagcatccctgcacttgaccacaagaaggtcacagcccagtgggtgattgggacccagctcatagccaaggcctcgaccagagctggaggcttcctggaggaggggcctttgagcaggtgcttcaggcacggcgaggtaagagtgagaggagcattcctggcagagggaacacagtgagcagagcgagtctttggaagctggaagggatgtggcctgtgtgctgtagccaaacaagaggggaggacttggctcagaaagaatggtggcggaagaggttgggctgttgctgggacctcctcactggcctccctgcctccatcctgtcccctcccaggtgctggccagcagcactgtcagagcgatcgttctaaacccagcagataacctccagtggctcctgctgccttatgaataaaggtcccatctgtagttcttcccatgctgtccagggccatttctggtgtcctctgcctgccctgtcctcattcagtcctgtcccctccagccacagctggcacctccttgttaaggtgcagccatgtgcatccttgcctctgtgcatcgggctgggctgttccttccacctgggatgcccctcaccttcctccctgccgccccagaccaaaacagacgtcctgtctcctcctcctctgacctccgaggcagaatgagtcatctccctttgtctatactcgtggcatagcgtttatcacggaattatcggcaattctgccagtgtctgtcctccccatgaggctgaagcatcgaggcctgaaagcacgtctccttgctctctccggcccagtgccaagggcgaggcctagaacacaggacgctcagaaatgcttcctggcaggagggccaggtgaggtggagagggtgagagccccaacattgtctcccgtgggcccctttgatctttagcaagggcatgctcaggtctgtgtggatcttgtgctgtcagcctttagatgagtggggtgaggggcttggtggggtcggggggcagggggaggtggcgggcagcttccccaggctgcttcctgagggggctgggagaaactggctcatcctgttccccagtgattgaggcagagctgtgccctgttcctggtgggtcactggggatctgagattggaatgtgacaccagggaaggggaggcagggtgggaggcagggcttggaggtacaggctggggcttggctggcaaaggacagatttcgctccactggttcttgaacccgtgtgtgtgtgtgtgtgtgtgtgtgtgtgtgtgtgtgtgtgcacgcgcgcgccggggaggggagagatggggaagagaaaaacatgagggcagagaggtggagtgggggtggaggacctggggagtggtgagcagggacagggagagatggaagtggggggacggcaaggagtgagggagaagttcctgctgctgctgctggagagtatgaagagtgtgcttagggccaggaaggaaagcagccaggcgcatcgtctcacaccaccatcagccatgccttccttcgtctgtccagcagacaaccctaagtgttctcttgcttggctccatgcttgcatggccccagacaggagcaagcctgtggtccaggcttcgcacccttgaagtctaggggccaggtgaacaatgagcatccggtttctttcttttttttgagatggagtcttgctctgtcgcccaggctggagtgcaatggtgcgatctcagctcactgcaacctctgcctcccgggttcaagcaattctctggctcagcctcccaagtagctgggattacaggcgcccaccaccacgcccggctagttgagcaacctctttctgcacaaagtgatcaggctgggggagagaaggtgcccagaatgctgtgcagaggcaggagaggagggtggagcaggcgagcatggggtagggggcagggaagccatgtgttaggcactatggtggggagccaggactgctggggagtcttcctttcctctctggcctcggtctcatctgtaaatgggggaagagtggactgctcttgcactgatggtctgtggacccaagtcacccactccttgggcatgagaaaccagggaccccgtggagacagctgatagaacagggacagcaggcatgctcagagcgtctgcaggcccatggtcagggggcttgagggagaacatgcagaatccagtggagcttgggttcgcctcctagagttcccttcttggagactgtgctcatctggaaggcgagatagggtcggggtaggggaaggagcactggattcggaatcaggaaaagtggttgagttttaactgcagcatccctcgggcaagtcactttccctctgtgagggtcagtttcctcttctgtcaaaaatgtgaacgggctttgttgtaagcattaaaggtgagctggggcgccgtggctcacgcttgtaatcccagcactttgggaggccgaggcaggcggatcacttgaggtcaggagtttgagactagcctgaccaacatggcaaaaccccatctccactaaaaatacaaaaattagccaggtgtggtggcccatgcctgtaattccagctacttgggaggctgaggcacgagaatcacttgaacccaggaaatggaggttgcagcgagccaagatagcaccactgcactccagcctgggtgaaggagactctgtctcaaaaaaaaaaaaaaaaaaaaagtgagtgttgctgtgttttgtcatctggaaagcaaggaggtcctatagcttggggccataaacaggctttggggtcacaccagcctgggttcaaatccaggtaccagctgctcactgtggggctccatttccctcccctttaaaatgaggataataggcagggcgcggtggcttacgtctataatcccagcactttgggaggccaaggcgggtggatcacttgaggtcaggagttcgagaccagcctggccaacatgatgaaacccatctctactaaaaatacaaaaattagtcaggcgtagtgtcacatgcctgtaatcccagctacttgggaggctgaggcaggaggatcacttgaaccccggggggtggaagttggaatgagccaagatcgtgcctctgcactccagcctgggtgacagagcaagattcagtctcaatgataaataaataaacaaaatgaggatagtaacaggcccctcctggttgctgctgcacagttcctcagctgggatatcattgctgggctgttaggcagttgttttttgttttgtttgtttgttttttgagatggagtctcgctctgtcgcccaggctggagttcagtggtgcgatcccggctcactgcaacctttgtctcctgagttcaagtgattgattctcctgcctcagcctcccgagtagctgggactacaggtgtgcgccaccatgcctggctaatgtttgtatttttagtagagacggggtttcaccatgctggtcaggctggtctcaaactcctgacctcatgatccgcctgcctcggcctcccaaagtgctgggattacaggcgtgagtcactgcgcccagccttgggcagttatttttattgctaaagtgctttgtatgtagaagagatcaccattatgattattattttttttttttgagccggagtgttgctctgtcgcccagactggagtgcagtggctcgacctcggctcactgcaacctctgccccctgggttcaagcatttctcctgcctcagcctccctagtagctgggattacaggtacgcactaccatgtctggctaatttttttttatttttagtagagatggtgtttcaccatgttggccaggcgggtctcaaactgctgacctcaggtgatccacccgcctcagcctcccaaagtgcagggattataggcgtgaggtgagccaccacgcccggccaattattcttcttccattcatgccaggtcacatctaacccttacctgtaataacattggccaaaatgaggagtttggtgcttatttcttttctagccaggtcaaggcagatggattgagtgggtctttttacacatggggcgggtgagaattactagttttctggccagagtttctgtatgtaaagggactttgccccagtggtgtaggtggaccccaggaaagcatccagcaacttgtgactttagtggcagtataaccacaaactctcattcattcgttcatttataaatcacgtgtagaacaccagggtactgagaaaacagccatgaatgagatgcagctctaatgtagcatagtgggtatgcatatgtattttggactttgcctgggttcagatccagggtctaccacttgcgaacttagccaagttatttatctcctttacttggttctgtcatctgtaaaatgggggaactgatagaatctacctcatagggtggtcgtttgttcaagtccagcatcaggtacatagaaagtgccagagcatggcccttcctccattgttgcttttatttctgccctgaaggatctcatggaccagcttggtgctggaggaggtcaccctggccaggcttctcagtgacggttggcatccagaaaggggtgccaaagccccccaactccttgaatcagacccttctatagtgatctaaagctgcttctctgcttgactgttggggcctgatgctggggaggtcctgtgaggccttattgacctgggaaagtccgcctttgtctggcgccaggtgtgcttgattttagaaggaatttcattcctagccgggcaccgtggctcacgcctgcaatcccagcattttgggaggccgaggtgagtggatcacctgagcccgggagttcgagaccagcctggccaaacatggtgaaaccccatctctactaaaaatacaaaaagatagctgggcgtggtggtgggcgcctgtaatcccagctactcaggaggctgaggcaggagaattgcctgaacctgggaggcagaggtggcagtgagccaagatgatcgtaccactgtactccagcctgggtgacagagcgagaccttgtctcaaaaaaaaaaaaaaaaggaatttcagtctcaagtatgaaagcagaaagtgtttcctgattgaggactcctcaccagccggaggcagcaggactgcctgcctctgtgtgtctttaggcaggttcctcaagctccctaagcccgtttcctccttcatcaaaggcgaaagtaatagtacctatttcatagttttgttaagaggatcaaatgagatagggcctctaaagcacttagccagtcctgggcacagaatagtgtgcttagtaaatattgtgcctattagtgataatcagaattctcagacaatgtaaagtaaaaaccacctgaaagatttcttaggagctacagcttcatagagatgtgaagttgtaaacctcccagagcccaagtggacaaagaattgttacagcagctggagagacaggagacccagagaagcttaactcctgtagcaaagtcacccagcattctggcttggggtgggcagggatggggaatcagagctggctttcagtctggtgctctctggtgctttgatagtgattccttcagcaaatagctatgggcaaacagcattgatgcacagctgaggtcatatgggcctgtcttctggaagcttctgttctgatagggaaaatgaaatttctacatgatcatgatgagaggtaaaataaaatcacatgttctattagaagggtaaagtcatcgggtattcactcattcaagggggctctgtgccaggctgtggagcagtgggtctcattcgggggcgatcttgtgtctcaggggacactgggccatgtcaggagacatttttggttgtctcagctggggaggtgctgctggcatctagtgggtaaaggccatggatgctgctaaacatcctaccgcacaaggcagcccccggaaccacacaccagctggcccctgatgtccatgtgccgagggttgagatccctgtcttgggaagcagcagtggccaagcagatggagcccctgcccgtttgaagcatagagcgtggtaggtgagcagacgttacagaaatgattgcctagatatggatttatttgtaatgtgagctatgaaggaaaaggtagcgggaagaaagagggatgcgagcccttctactcttttaagggagggcctttggggaggtctttccagctgagggcacagcccaggcaaaggctcagaggcagaaagtgcaggagtgtgttgtgggtggggaggctaccaggcacctggtgtgtgcccggggagaagtcagaaaaaggcctggcctcggggggcccaggaagtggcttccagaggtggggagaaggcaaaagagaggactaaaccctttagtctgtttgagggaactccagcccccagcatgttgctctctgggggatccagcagggccaggtgggcagtgggagcaccctagccccaggtgctaccttccagcctggggccaagccttttccctttctctcatttgcagctttctgataggtgggaaagagaagcaggaaaaaagagcagaggaaaaacaatattttcatttcaaacacagataggggtgagggaggcgggaagtaatctggtttatgatacctttgagacaagcacagaaaatccccaccgtggcccgaaatagcactaaaacagacgttttgccaaatcagacttaattgagtggctctcttcttgactccagcaggatgtggctggagctggctttgttcccttggggtgacactgtcccctggggcccctgccctggctaattaaacaaagaggacctggtctcctaggcaggacaggagcctggggagctgaacttgacagcccttggcctctgcctgagagggccagaaatggttacaggggttgggaaggtggggggttcctgacaggagggccaactgagtgaaagcattggtgggagaggcctggttcctctaatatgtgaatatctgtctctttggatgctgaaagggatggagaaaagccagcattgagtgcctactattgtgccaggcattgggtggtcctcgctaagtcttattaactgccctatatccattatcaaggaaactgaagcacagagaggttaagtgatctgcctgaggtcacacagcaaccaagtggcagagctaggattagaaatcacatccgcaggctccaaagccaggccctgcctgctgcttacccccttccccatgttagtcactcatccattcgggagctaattcctggctatgaaataatattgtgaccttgtgggaagtgaaggcttgcagtcagacagccatgagcttggcttctgaccaaagcagtttttcttttcatggttttctccctcagaacctcctctttcctcatctatcaagtgggcataatcatgcctttatcctggagttgctgtaagggttaaattcagcacagaaagggatggaaggggaaggaggaggtccttgggccacccagcttggcagggtgcaataaaagagtcctaggtagagggagccaggcaagattgcaatatctctgtgcctatcagtgttgggtttctttatttgaaaggggagagagggcagactccactctgcaggtagagaaggtggtgtggaatgcgggtatttatttttctttgcctgtgaaagccctgttttcgctcaggctgtgtagggcttcccgacactgccatgggtgcgcacatctgcacactctggggtgcctgccatgcagaggcatctgcccagggtgggcactgagggcatccaccatgtgacgcccccgtgcagcctgtaagctctcatcacagtgcctgggatacctgggagtccccagaaagagtgaggatgggtgagggccatgaaaccagggcatcattcctccacctcctctgatcaggccctcctggtcccattcatctccttatctcctggcagccagtgggttgctgggaaggcaggggcagccttcctgattgacaaacaaaacaagcttgatcacaaaaggagaggggagactggctgggcctctccagctcccctccccgtgccccaggcatctttcttgctccacccaactggcaccctacattctaagatgctgcgagggggctccaaagccattgtcgaaggtcaggccacccaggctaggagccccttgcactggggaggtggattcaaggagtgatggggttgccatgaggcggcgcttgctgcaatggccgcccctccttcccttcagctggctgggcaggcagcttggagaggaagccaggcggcaggtagctgagaaagacatcggatccagggggagcagcagagaaagcaaacaaacagggctttgtgtggctgcagattggcggctcagaagggaagccaggcctgtggtagggggaagggagaggaaggaacgggagaccaggccattgctctgggccagagatcggcggctggaccagcccgggctgggcggccgggaagtagcgagtgccactacgtgtggacaggcatctggagtcacagcctggccgagtcccagctctgccacttcactccttaacagatctgggcttgtttgcccacctaatctgggcagtcattcacacgtaggactcgctggcttaggaggagagtcacctgtcctggcccagtcagtgtctgctctcatcctacccttgtcccgtcattgctggcaggacacagaatcaaagggattcagggtctcctgggagctgctagccttgccgggtctcctgggagggcagcgacttctgcttagatctgtgggcactttggagtctttgaccggggaggcagccgtgctgaggggaaacgggttctctgcccaataacggatgcctggggtgtaggtgggcagaggctggcatcaggcctgaggaaccaaactgccccctcctcgtcgcggtggagacgcacgaggtgcggggaggaacatagccaggaagacgggccttcctgtggggagggaggggcatcttttctggggtgtgagtcacattctggatcccagcgagggcagcccccaacctggcccacctctcagagggctgggagggcccgggcctcgaggaaaggcataggtaggagctgtcaggccagacgcccgggcagctccacgctcgcctccgaggccatttcctttcctctctccccgacctcgagaaggggcggcgagagggcaaatgcccgcgcttcctgccggtcccgcccctccccgcccgcggcgcccaccatcttggccgcgccggagcctcctccgcggtggcgtcccacaggccgcggtcggggcccgcgacgccgacgccgggagggggcccgggaccttcggggcgctgaggccaggcggggggcgaggcggggcgggccgctcgcgtcgccatggcagcgcccggcccggcatgcttcgcggggccgcggggcggggcggggtgctgaggccccgccccctggcggatcccgggtctttttccgggaacgcgggggcttccagtcccagcgttgcggccggcgcttgcgggttaccgggccaggcggcgcgcatctctgggcctcgttctcccactccctggatgtttggggataatgaaagagagtctgtgcgggttagcctcgggacgggctctgcttaccgagcccggcaaccccacggcaggggcctcgggaagccgcttccgagggccaggataatggggagactggacccctaccgcttgggggctattaaaagtggaggccaggcggcctctcagctgcagtctctgggtctcgagctcttccccggaactgtccatgggtcagtgaggacctaccctttgccctagggcaggagaaagaagggggccgggactgcacacctcacccggtccaggcctggaccctgcaacctcggccggcctccctccagcccaggagcacaggcctcccctagttggcagtcgttggactgtctggctgggaggcacattcctacctcctgagctcgggcaccccgcctgccctgggggagcctcttccagaactttgctgccaacactgccctgtccccacccggccttctcgtgccctaagtccctagttactactccacagccgccttctttcccctggtctttctctctctctttttttttttttgagctagagtctccctttgtcgcccaggctgtagtgcagtggcgtaatctccgctcactgcaacctccggttcccaagttcaagcgattctcctgcctcagcctcccgagtagctgagattacaggcacttaccacggctaatttttttgtatttttagtagagacgaggtttcacctcgttggccaggctggttccaaactcctgacctcaagtaatcctcccaccttcgcctccctaagtactgggattgcaggtgtgagccactatgcccggcctcccctagtctcttaagaggcaccgattcagctaccctttgtcacctcctacctgtactgagtaggcagctaaattgaatgtcggcctttgggtctccgaagggaggctgtatgctggttgagaggctgtcctcgcgcctttctccctcctcacccagggcacatgcacaaagaggctgagaatcggctacagttgcagcagaagagactcagggttgccatcggaaagaacttcccagtcctaagcattttgttcttagtgaaattgtcagattattgatatgttggttgtagagatatccaaaaatacaagaaaaaagtaaaaactttataattccaccagcagtatataactactgtcaacatactttctgtagatgtatgataaaccacttatgatacatctacggagtcatgctgtatatttggttttgtaaggcacttggtggttttaatagcttttttctcactataaaaggaggacaggcttattatagacttttggaaaatatgacaaattaaaaaaaaattcacccgtactctcagtctccaaaggcagccacagttgtcttccctcaacccccccaccacccgttcatggggtttttcgctttgtgttttttgtctgtttaggtatgccatcattacttctgtatatagcagttgatattccgcttttcttacttaatgctgtttaagatgctcctgaaccacgttcttgggagaacttccgagatgaggcagacatttctgggggtgatttgttggactggctgttcactttctgagtttgtcctctccctacctgtagccccccgacagagcccttctccattgccagtaaccaatgatatgcagcttgggtcagggggtcctgcttgctgggggcccaggaggctgcctagtgtggacagggacatgcaagactcatggcccgatgctgagatctgggctccaatagtaaggggctttactctggcccagatatgccaggtttcagggaggtctcagaccttggcctcatcctcattcggggcctcctttgcctgggcacactcagacccgaggccccttgtcgatcctgtgacccaccttctgctttgacttcctaggagttggtttctgctgcccttggctcctcagcccctcttctctagcctctctctggaggcatgcaggcttggcaccagcacagcctccctctgcccagctgccccttggccctagctacaagctgcccttgccctgacctatccctactgccaggcctgtctcttctcccctattccagaacggttcaattctaacacatccaagccctgcgtgaaacaggccttgggaaatcacagttgccagggacggtttggcatttaaaaggcatccaaggctttggggaaaaagctgaagagacaagaggatgcagggccctgtatcagaacagcatctggatttactggatggaaaaatcacagaatgcccctttcctcgggaataacagtcctggccgaggggcagcgggtgtggcatgggcacgccatgccctgcctggccaccacctgccatcaccgctgtgtactctcagaaatgaaaagattagggaaaagattagggagggacattgtcagcctgcagccaacggcccgctctaacaggtttattcagttgtaaaatatttaagacctgtttcactttacctgtatccaggaggcagccaggctggggccgagattgatgtgctgaacatgatttatttatctggatttgctcttgtggtctgggtgttacctgggtgtggaatttaaccaaatgacaagatgggtttgcgtgtgttcctgagcttggggattgtgtgtgtgtaaaaagtgagttggggtttgtgtacatggcagggggttgctgttaggtggcttgtgtgtctgtttgtcactgggaccaacgtgtggttgtgtgtgtgtctgatttggggaaatgagctgagggtatgggtgcttacacaccaggcagtatccacagcaggtcacacgttctttgtgtgttgggggcacctctgtgtgtggccgagtagctgtttgtgtgcatgtcctgtggtgtgagacctggatctctctcacccacttttcatcagtggtggggcattgcgcactgactgagttgctggggcatctgcttttccatccggccctgggtgagcactgacaacacctgactgtcttccagtagaactgggccttcctgccctgcagtccagagactagagggagttcggtggtcaaggtggtccaggcccacagccatagccctaatgcaaagcatggctcctactccagtgcgctgctgtggggtgaccctgctcctcctccctggacctcagtttcctcttctgctgcagagggcaggcgcccaggtccctgtggctgctctcacacacgggcttctgggtggctcatggcaggcttagggcattgggctggggtttgtctcctgccactcaagagttgagtcccaccagtactcaagaacagcaaggaatgatgggaaaatccctgctttggggcccaactctggattctgggcgttgtctctgtcccccatctaggcccagccctggcccagtagtcaggaaagcggcagacaaccctgtaacagccctcggtctccccctccccccacacccctttatattgaatgtgtctgtcactactttcctaatgaggctgctgagggcccccctggggcagatacctttgcagaccggaggtgagggggtgggccagcctcagggtcaggacaggaaggggagctgagcccttcccctgcctgcacccccaggccagctcagctgtggaggcattgaggcccctctcagcccctgagccagctgtgagtgggcatgagagcttggggaggtaggaaagctcaccccaggcactgagttttctttggcgctgtgactctgtagtaataatacttccacctggtcgatatctatgtttggaggcctactgtgtgccaggcactgagatcagccatgatctggatggacacacaaaatccctgcccttgagggaggtgtggccaaaggaagaaagacattaatcaaagaatcaagtgatctgagtcgtgcattcatgcatgggaatgccggctgatcacaagccaagacagaggccaggcagagcttctctgatggagacagggagtcctgtgcttagactgggggctgatccaggcactgggtaaaggctcagccgggattgaaggaatcaggagacccagattcttgctgtgtggcctcaggcaactgcccaccttctctgggctcctagaggctggtggcttccttctggctcccgtcacctctgagtggaactcaggcagtatatgtctcctcttcagtgctttttgcgctccctgccagggccctcaagacatctgtcggcaacatccttgactttggaatgctggaggcactgccccaggggacgcctggagccaagcacagcaccgctgcctcaggccccacctgccagttcctctgggcccttttgctctcacagagccacctggatcgaagaaagcctggaaaacattaaattgaagaattagtcccctattttgccccaaaattgcagagaaaagcatttattcatgcattcactcattcatttgcttgactagtgtttcctgaacacctagtaattgctgggcacactgcactccatgttggactgagatggcaaagtggtggtcctcctgccacgtcctgaccacagacctgttttgaaagcccatccattgtcggggggccgggggggggggaatcaaatgaattgccagtgagtaatcgttgagtgacttcatttccaatttccagtttacatttcttctggattattctaccctgcttcccccggccacagttggtggagatggctactgtctgccgggtaggatggcccacccagcccaccagctggtcacggtcccatcccccaccactccaccccaccctgtgcctctcctggtcatgtcacacatgatagtgtggcttcctagttatgagcccagcctcaggagccagactgtcgaggttcaaagctcactgtggcttgtgggaccttgggtgtccccctccaagcctcagattcctcttgtgtaaaatgggatcacaagagcaagtatccactactcctggggctcttggggagattaagtgagaaaatttatgctaaatccttaaaactcacataagccttggctgctatcgttgttgaataaatgaaccacttgcaggctgagaccggggctgtgtgtcacatggcacctctaggcctcagtttcctcagctgcttctttgggaaagcacatctgctctctaggttgggcctcctccctcgtccttcaaagacctattcttggggcctgggccctgtgaaacctctggctctcggacgcagcctggaacccctgagacgaggtcaagctccgcggcccgcctcctgtcgcccggccccaggcgggactgccttggcaggactcgggccgcgagctggaggcgcggctcccggctcggggctccagcggccgcgccccgccgcccctcggcgttcgcgcgcagcccctgcgggggtggccgccatcaaagcgtcttctcgttcttatgctaatgagccccattaaagcttaatggctgcgaacgcgcgggtttaattgcacctgcccgggcctgaggcgcggccggccgcggaagcagctgcgcgccggccgggacggccttaattacctggaaaacgacgcccggcggggaggggaggggatgggagagaagaggagagcagcggggcctccgcgaggccgggcctcgtccgccgaggccgcagtccggcccctctcgtcctcggggcgcggcgcgttcgtttcattaatttatcgccctgcctcggcggagatccgctcgcccgctccccggcgttcaaccgcgccggcttcgtgctcccccgcgccgtcccccggccatcttgggcttggcattcaaggcccttcgggaccgctgctgccactgacccagtgccaccctgctctgcacgaacaataataatggtggttgcacattacgtgccaggcgctcttgagggttgaatgtgacctcgcagagaccccagatgcctcatctcggccttactcccctcgtctttagaagctggtacctctgcctgcaacaaagacccctctccctcctcgctcatcctccctgaaacccacccctgcgcctccaacaagatgagcccctgtcctcctgggatgggattggggatgggtctgggccctttgttgaggggtgggctagcccatggtgaaggttgtctgggtgtgtcctccctctggactgacatttcactgaggccagtctgcctgactgccctatctctgcatgcccctgccatctccctggggatggccctggggttgtgggggctgcactgctgccctgagccttctgcctaggcagggggctgtgagactgatgggaacctcagggaaaccttgagacctaatggtattctctgtgggacttccctgtgctcctccccaccccatcaagtgatcctgggataggcgcctgcccctcctctctccctcattcccttctctcactcttctctttttgcagagggaaggaaaacggaagagggaatagacagaccgctcatgcagtttttagatggtcccctttccctcccctctctcttccatgtccccttgtacccagcccctcttttttctttctttgaagaccgcatcttgctttgttgcccaggctggagtgcagtggtgcgatcatggctcactgtagccctcaacccgtgggctcaaacaaccctcccacctcagcctcccaagtagctgagactacaaggtgtgcaccaccatgcctggttgcccctcctttctgccccttccagtcccatccctcctccctttgtgcgtctcagagaccaaagcctgaagcattgcacagtgcccactgggaggccacccagccctggtcctgcctgtgtcaggcaatgctgagagcacagaggggagtcagacttgggctctgccctccaaggactccagtcggggaggcagcgctcgaaaggaatacttgtcctctaatggaaaaaggaccaatttaaaggaagcagagaacagtctttgagctcaaactgggaaggctgggagaggcttctaagctcagcctggaaggaaggataagtgtgagctaattggcaggaatagcattccaggtagggaaacaattggagttcagccctggctagggcagaacactggctgacatgaggggagagggagtaagggacaaccacagaaaaactgagctcactccaaagtgtggaggcatgaggctggagaggtgggcagagggtcctctgttgcctagcaaccttcactgcctccctattgccaagaggaccaaattcagacccttcagttggcacaaaagcttgtaccacccacctcatcccaggatgcagcctattatcttcagctgggttcctcactaccaggccaagcctcggatgatgattgtgagcctactgtatatgggaaggggggataagcagtgaccccatcagggctaatagcagtggggcctgctgcccaactccatgccccttctcccattcttgtccccagatgtccttgcagacaaaatggaggtgaatgggcaggctgccaggagcgtcaggtggcatcacagccgggtagacagtcgtcactgattaatgaggtggtagaaacctagagggaggtccctactggcatgcctcggggttctgcccttgctctggtcaaggcaaggaatgaggctcacaggggtttagcacctccctgccaggctatgtgaaactcttggtatccagtagtttatcaccagccatgaggtggcttctcttaatatctcattttgcagatgcagacactgaggccagtcggggtgaggagtgagctcaaagtcactcatctccgaggtggcaaaattaagcctcaaacccagggctgtgtgacttcaaagcctgtgtttgtaactgcggagctgtgcggcatcagtaatgcatctgctgctgctgccagacgtgaggaggtggggccctgcctttcaacttcatctctctgacagtggttagcactgtactttacgtgtagtaagtgctcaataaatgcttgtggactggatgattggggcagtaagcagtgagcagggctcagaagcagtggagaggctccatcactcttcctcccaacctgcacctccacccccaggagttggacagcggctgtaaggggacttggagactcaaggcttccaggcagggagtgggctcacaggaggctagggaggatccaacttcctgtccaggtcagggtcaggaggacagccgcgccccctactgccccgctgggaggccaggctgacgtaggaaggctgcactgcaagtcagaatcatcagcaaaacctggggaatagagcgtgtgagggtttccatgcagggtggggactgctttctgatcaagcccctaggccaaaaacctttggaagggactctctgagggcagtgcattcttgtagcgtcgggagcaggagttctcccataacctttttggggtggggacccacctgtggctctggaaaggtgttggctccggctctggggctcagggggagggggccattggtgggcaaaacaagcatagtgaaaactgaggctcatagaggttaaggtcacagagcagagctgggtctgttttctttttgtttctgttttagttgcaacaggggcttgctctgtttgccgaggctggagtgcagtggtatgatcataaatcactgtagcctcgatctcctgagctcaaacgatccttccgccttggcctcccaaagtgctaagattacaggcatgagccttcatgcctagctgggactgttttcaaactccaccaaccccttttcttttgttccattccactctgcccagaaccttcgtctggcttcccagagggcccaagtccttgtcttcagaggtcctggctggggagccttagagcatggtcttccctcactccaggcttctcgggtctccctattggggactgaccgtgggagcagtgagccactgtgcaccagggcagcccggctcctcggggggtggcccaagcagtcagggcggcaggcttgatgggccagggcctggggactctgccatggtggaccattgtgcccttgcctggcttgccaggaaagtggagtgcgtgtgctcacccttgcttctgaggggccttcctgaggcagaggctgtccctggacacccagtgctgttgaggcagctggggacactcagaccatggtggacaaagacttgaagtctcgtttcagccctgcacaaggtgtgaccttggctccagcactgctccctctgggcctgtctctttctcagcagaatctgggactggccacatcatctccaggggttctagcattggacgcctgaaagtggacaacatggcagtgtgagggggctctttgtggtggggtggtcagaatggccctccatgtggggggctctttgtctccccagggcagtccttaaccaccagccagcctccccaggcacccgtgccgggcagtggggtgtgtaaaggcctggcacacacagacaggagttccgatctcaactccatcctcatgagctctgtgaccttggtgagtcccttttctgtgtagcctttaactctcatctggaacgcaggatatgcatagtcctgacatcaggacgttaccatgagtagtaagtgaaactcccacttcaggtccttcgcctggtgtccagggcatgggaggagctaatacgtggcctctgctgcttgtgttgttattggtggtggtgtttgagatgtccttagagatgttggccaaagtttccagttccccaccctcccaagcccgtggggaaattgtgcttcctggtggtttttgggtgggggggccgggggagggtcatgtgaccagttatggcccgtgaggtgtgagcagaagtgacatgtcccttctaggccagagcctttcatggccatgaggatccacagaactcactttcctctggtagaccaaagtcaaggtggcaactgctcagtgagagggagcctccctgctaccccagtggatggtagtgtgaaggataaaccaacttttgttgttgtgagcccttgagatttgagagttttgttacagcaacatggctagcacatcctgactgattcttcatcatcatcatcatcatcactcaagcctgtcccccggccaggggtccatccaggagaacaacagccatggaggagacccgtcaaaaaatagaactttattaccaatctgtttctataattgtttgactcattttctcactcatttgtttgctttatcaccaatttctttacatcatttattccttcaaaaacatttcttggctgggtgcagtgggtcacgcctgtaatccgagcactctgggagcccaaggcaggcagatcacctgaggtcaggagtttgagaccagcctggccatcatatagtgaaaccccatctctactaaaaaatacaaaaattcggtgagctgagatcgtgccattgcactccagcctgggcaacaagaacgaaactccgtctcaaaaaacaaaaacaaaaacaaaaacaaaaacgagccaggtgtggtagcacacacttgcagtcccagctacttgcaaggctgaggcaggagaatcgcttatacccagcgggcagaggttgcagtgagctgagatcgcaccactctactctggcctgggcgacagtgcaagactccctctctcaaaaaacaaacaaaaaggctgggcacggtggctcacgcctgtaatcccagcactttgagaggccgaggtgggcagatcacgaggtcaagagatggagaccatcctggccaacatggtgaaaccccctctctactaaaaatacaaaaattagctgggcatggtggcgcgtgcctgtagtcccagctactcgggaggctgaggcaggagaatctcctgaatccgggaggcagaagttgcagtgagttgagatcgcaccactgcactccagcctggcaacagagcgagactctgtctcaaaaaaaaaaaaaaaaaaaaaaaaaggcaacaaaaaccaaacgccacttgaccacctgtttcataggccctgaggtagcgcacaggccagcagggagctatggatcattctgcagagccacggtgcttgcccagaggtcagcagccctatgggatgcttggggtggggcgtcagatttgcagagctggggcgagggaaggaatggcacttgggggagtgggtctgctggagaaaggcctacaggtaacaggaagcactaggcagttgggtccggccagcagggatgggaccgtgtagtggccaagctggagggggactttggtccctgggtcatggggtgtgcagtgctctgcactgaatgatgagagggcatgcataggtgaaacaagaggccagctgctgaagggaggaagaccaggtaggcagctgggccaaggatccaggtggacaagggctggcatgggtctgaagaggaagagcagggccagggaaagcccagggctggatggccagtggttgtgagctgcaccagcagccagagggagccggggactggatgggggtggccctgtgcagtgacggggaaagtttgagggatcagagtagagttggggcacccgagcggcatccaggggagatgtccaggatgtagggtggtgaatggacaggacattgaagtgagaatcacccctcctgcccatagacaaaccattggtttgagggtggggcctgccctgggagccgggaagcacacatttcttctctgtgtgggctcaggggaaaaaaagaattgaaactcccacaggggaaaagtttttaaagattccaccattggaatgctggtcttgtgtaacaggaatgttttaatccatgcatttgaaacacagttattgagatcctactgtgagctgggctctgccctaggtgcccatgggtgagcagacagacagcgatctctgccctggtgagctccttcctgtcttagtgggagacaggcagctaatgacgagcaatctggggcatgctccttagtcctaagctactcaggaggctgaggcaggcagatcgcttgagttcaggagttcgaggccagcctgggctacatagcagaaccccgcctctacaaaaaatacataaattagctgggcatggtggtgtgtacctgtattctcagctactcaggaggctgaggtgggaagatcgcttgagccccggagtttgaatccagcctgggtaacatagcaagaccttgtctctgaaaataactaaatacttttaaaaagaagatagatgtagtgagaaaaaaaagtaggtggggaaggggctcagggatgggggagatgcgtgcagttttaaattggagtgccaggaaaggcctccctgagaaggtgacaggtgagcaaagactcgagggaggtcagtgaaccttgcaatgtcaaagggaagggcattgcaggcagagggaatagcagtgcaaaggtcctgaggcaggaacgtgtttccatgttgcaagaacagcaggggagccactgtggctggaggggactgagagaggggagagggttcctggaagactgtttgtttatttgagacagggtctcactctgtcacccaggttggagtgcagtggcatgatctcagctcactgcaacctccacctcccaggctctagtggtcctcccacctcagcctcctgagtagctgggaccacagatgcgtgccaccatgccctactaattttttgtatttttggtagagacgggtttttgccatgttgcccaggctggtctcaaactcctaagctcaggcaatccacctgcctcagcttcccaaagtgctgggatcataggtgtgagccaccgtgcaggccagactctagctttcattctgagtgagctggagactgcaagaggcaggctccaagctgacttactatctcacaggctccctcaggagttgagggggccagacagagcttgaaggggagtagaaggctcctggaggctctggcagacctcagaagctgcagccacatcgaccaagctgaccccacccaccatctccaaggaatgggttaatgggcaccccaggcctctcaggtctctgcctctgccttgctcctcctccttcctcctgctgccaccctctgatggtgcttcagcctgtgccatttttctgggtcctctccaagtgtatattgaccctgaggtggcagcaggaggggaggcaggccccctccccaggaggagacccccttgatgaactctgagaagctggttgcttagcaagcccttttttctccaacaatacttgtgctaatcagcctagattgaatgagcaaggaattggcttttgcaccttcctgtcctctcttctcatatatatatatacacacacacacacacatatatatatatgtacatttttttcccttagagacagagtctcactatgttgcccaatctggattcaaagtcctaggctcaagcaatcctcctaccttagcttcctgagtagctggaactacaggtgtgtgctagagtgcctggctagggactccattctagaatcatggaatcttaggggtcccctgggttgcatcttgactcagtgagtgagtgggttactttttcacatccctccttgtacacctcctgtgactcctggcagctcactctctttctagcgactgagggcctctggacaaggtgagggggacagagcaatggtccagaagttagaagactgtggtcccagtcacaggctgggcaccataagtggacaccataactgacccatcctccttttgtgctcaaatgctgcagttcatccggaaacaaccaaaacattccagcttcacagctgccagggtttggagttgaaccctgtgtcccgtgctcctgccacccctgctccaggcacaaagggaacagttcgtcagtccaccacgggcctttcctatcctcagttgcagagtgggccaggacatgccgctttacagatgggaagactgaggcccagagagtggaagggaaggagaggagcccattccaggctcccggcctgggatttttcccatatgctccagcagccacccggggaccatcattatgacaatgatgactgatggagggcctagtgtgccgggcactgtgctgagagaccccaaggagggcgtagcatctgtgtccacaggaggaggctgtgaggctgagagtacctagggagagcagagctggagctggctgggctctggccatgcggctttgctgtttgctgtctgctgtttgccgtatcaaggggcgatactcaggcgggctcctctcagtctctcttctttggtctcacctctactcagaaaagccctttgctggcccccaaatactcctaccccgactctcttctccacccctccaggctcccaaggcccctgcctgcctcggcctccctgctgggttgaccacagtcagtcctggctggaagctgaccctctccacagctgccccaaaatacatgtcacagtggggcatttgcagttccagcctgggcagctgcccactaggtctctttccttcccttccctgggtctgcccccaggcccctggcctcattctggtcctgagctcccttctctgggccaaggagctgctgggcctcggggagggggaaccccagcactaggtccaaagtgatgtagcagggccactgtctgtgccggggcctggagctttcctctgaaccttaaggggcccccagatcagctccgtgcgggcctggggtgcagcttccagaatcttggaaacctgtttttcatggagccagatagaatgagcacccaggaggaggcagttccaagagctggtgcttcaggaggaaacctgcacagcagacaggcgtgcgcacattcctagatgctagccctgtggcggcgcacctcacgctcattcacagtacacggacatgctcacctgcccaccatgggtggtcaacccttggacacccacactcttctcacaccctcacacacacactctgcaccactcgcctagccccggccacgctcatgtcaggattctgaagacctcgagcacacacagacacgcacctggtcacgtgcactttcacacatacacttggcaccagggtggcagcagcggaggtgactgagaagcctgcttttcacagagaatcagaacccagcgggggctttagccacaaaaaaagagcatttcaaggagaagggctgcctgcatgccaagcacacgcccctcacctacccaggaccccttgtgggagctgagccccatggagaccccggggtacccatcccaccctccaacatccatccctacgtggatatacggccacagttgcagctgcggccatgaggaggggtttttgctcctttttagcagtgctccatcccccaccccagagtacagggggctgcccagagaccctcctggccctgggggcctgtgagtcagaggctgccagtggtggcctttcggctgttgctggggaaatggcagcacagtggccaccaagactaggactccctggggaggccctgctggccctggcactggtggcttggcctcacccagccccacctggcagatgtgccccttgtggctacccaaggactggccccctcctcatttcagaggtggagaaactgaggtaaaaaagtggagacagccagggcacccctcccacaaggccctgcctcatttgagacagagccctctgggaagcctgtgcattctgtaggtggggacctttggggccattttttccagaggcccagagagggccgtcttcttgcccaaggtcacacagcaagttcatggcataagctagccagcctcgtactccagagctctcctgagggcccccatgtgtctgtgcgggggtgttgatggggggcaggtgggagggaggaggtaaggctgatttgtttcccagcctcctccccctcccctgctcccttctctccctcacacggtttgtttggagaatgactcacaggaatgcagcaaaatcctgatggatgggaaggcagggccgcagtacccggaaaacctctccagggtagggaggcggggctgagccttggggcctgagaggctggtgataggggagccctgcatgcaggtggggcgactgaggccctggaagaactctggtcacgtcctggctgggggttgtccctcctcgacagaaacacacaggccctggctgccgcagcacccctggagcacccgtcccccatgatttccatctttgtgtccccgaggcatctggtgcactgtagctgacaaacacatgcattttggcactgagtgtgacccaagtcagaccctcctgtgtgtgccctgtcccccaggtcctcccagctccccggagttggggggcgggtgcttgccattcagtcctttcagaggcagccaagggcctacggcatgctggacactgccaggggctggggaggctgggatggagctggagggaagtgggaggtgtacacgggatggacacctcctgtgtatgttccaaatgtgctggaggcctcaacaggtcttggtacaaggtgaggcaaaccttagaggacctaggatgaagtttcacgtaaaggaacagtggctgtaagggctcccagaaagtgtagggaccctgggaaggtcccagtctttgaataaaggtgggtgggaccttattggtagcttggggcattagggcccagatatcaggcagcagcatgaggtgaggcccgggctctgtcccagggcaagccctcctcctgcgcaccacatctggggcctccgaggagggacaaagcattcaactcccgggacctgtgggtgggaatgtccccaggcccagccctttagtgcctgctgatggctgtcacgcggtgtccggccctgatgaccagatatgtgttttcaagagaagctggaatttggatttttatgtgaactctcctgattctcaaatgctggctccgttaacaaaaggcacagtgtggtttaaaccacacatgtccgcaggcagaggaccaccagtttctaatgtctgcgctgtggggcgcttgggtttttgcatttggttcttttacattccttattttattggaaacagcccaaatagtcactgagctgcaactctgtgctaggtgccggggctctatcagcgaataaaacaacatgtgacggagctgccattttagtgggagaagacagtgaataaacatatatcaggtgatatgtgttaggaagcaaatggaagcagggctccagaacagagagcggctgcaaggccaagcccacatttgggtggaaggggcagctagtgcaaaggccctgaggtggggctatgctaggtgtgttagaggcctgtgtggctgcagcgggagtgggtggggaagtgggaggaggtgaggtcagaaggtagcataggtcaaatggcataggagactgtgggctgtggtataagcttggttttaagtcttatgtgaggtgggagccatggaggattcctagggagggagggtcaggatcagacttggtttaacaggctctgtctgggtgttgtaatggctgagtggggcaaggatgggcctaggaggcccagaaggggctattgcacttgtctggctgagtgatgatgcggcctgaacaggaagggggtagtcaccagagggtgacctgaggaaactgtggtcaagcctctccatggtgtaaacagtaaacacgatactgattctaaggacttggtagtaacatggaaatggtgactgtgtataatgctatgtgaaaataggattagaaaattgtacattaaaaacacaccagcccagatgcaaaaggctgcagatcatatgattccattcatacgaaatgcccaggacaggcgaatccagagagacagacaggaggtgagcaattgccaggggctgggggtggggaaatggggggtgactgcctatgggaacaggtttctttttgggagggggatgaaaatgttctgaaattaggtagcagtgatagttgcacaacttcatgaatataccaaaaccctgagttgtcccctttaaaagggtgaattttatagtgagtgaattatacctcaaaaaaaaaattttttttaaggcatgtccagatttctaaccaaaattggatgcacatagaaaacattgcaaggagctgggcgtgatggtgcctgtggtccccactgcttgggaggccaaggcaggtgaatcacctaagcccaggagttcaagactagagcctgggtgatatagtgagatcctgtctctaaataataataataggccagctgcagtggctcatgcctgtaatcccagtactttgggaggccgaggtgcacggatcacctgaggtcaggggttcgagaccagcctggccaacatggtaaaaccccatctctactgaaaatacaaaaatttagctgggcgtggtgatacacgcctgtagtcccagctactcaagaggctgaggcaggagaatcgcttgaacccaggaggtggaggttgcagtgagccaagatcttgctactgtactgcagcctgggcaacgagagcaaaactccatctcaaaaaataaataaataataaaattttaaaaagattgtaaggaaatattcacagtaattgtcatagggtgaaggggattctggattttgtttgttttctgtgtacttttcaatttttaaaacttaaaagtaggcatttctctctaaaatcataaagactttgtgactagggccagagatgggggatccacttggaggggctcagcctctctctccagctcttgtggatccattcagctgcatggctttcacttgggaggttgggagcaggagcttgctctggtccgcgtctctgaccttctggaattccattcctgctcacatggccttggtcaagtcacaggaccagagatcccagcggccctcccctggagagtgtcccagccgcccacgatgcctccacccagaggctgccctgttctgcttgcatgccttcagccgcaggttgctcaccacctcccgagcagctccctccttccatttctgggcagccctgcctgctagcaagctcttccttatatggaggtgaaatctgtcttcctgttgcttcctcagctccctctctgaaccccagtttctgggtctgcagaagggggctcccaggcctctccctgcctaccttggccactgggaggttctgaagagactggaggaccagcagcccagagcctgtgtcggtggtcattcagctctcgggacaaagcgtgggtgggcctgtgccctggtggcataaccaagtaggatttccacattcagtgtctaggccatcgctgtgaaattggaatttgatactaatcctggagattgaaaactcaaacctctccataggccaggagggaatgataatcatcagtgctaacatttacggagggcttgtggcgtggccaactctgagtgacgtttatgcactcatttctatttatcaccagcaaatcccgggccctgctgttcttccccattttaaaggtgaaaaacctgaggctcagaaacgtaacgggaagcagctgggtgcgagcctcctggcacacattgtgggagtgctgtgggtcgaataaggaagctgagcagcaggcagcctctcccctgcagaagggcacagaagcaggactggaaggaaatcctggttgtgggctgagctcgggccatccacttgtcgtggtgggtgaagggtctggtccgcaggtctgctctccaagctgcctcgttgcaggtgctgactttgggaggattctccttgtctcggcctaggagctttcttgctcagcttggggagagaggtagtaatgtcgccttccacctcatggacttcccagtttagaatgctgcttcccatcccacccacatcaccctctgttaggtaagcaggagcagaaatgcagtccttcatctcagctctggaaacgggttcagagagggtgtagaactgcccaggggcacacagccaggacaggcccaagccaggaattgcactgggggtgagcaggggatggctttcctggcttaaggtatgtgggaggccaagagccatcatttttcccaatcctctcctggagagccaggggacatctgaagccaggggctctgcctgtttcctctgcactgtccctgtgctgggctgctctgagctgggcactggtgtggaaggtaaataagcagccccatgacaagctgtgagaccgggcagtggtttgggctccacccaggcccatgcctctctcttctgcttgcagagcctcagtgtctgcatctctcaaatgggctaaggacactcacctcagaggatggctgagaggattccatgtggggtgcttggcagagttagctccagctctgcatgccaccccctcccatggtgcagccacctgggttccaccagggcattctgggatgacaccagaccgggaggagaagtgcgaggagtggtgtggtcattggcgtctttcctctgcctctgcctcccccggccccttccattcacatggtagaaattcagatagcacagcagcaagtgtccctcccgctcctgaccttccagcagtttcttctccatccttccaggagtgatctccacagattcagatgccccccggaaagggctttccattcaaagtttcccctggactcattctggccccagagaggctgtgcccgatccgatcctcgcccctttgcgggtgtgaacttggaggctgtgagagggccaagttgcccctgggaatcgtacatattctgttccacatcctcctcctgttgtccgttccgtgccctcctatgtcaggagtggaggagtgctggaaggctgtgcaacacactgttacccattttgcagatgacaaactatggcggggggaatgggtttcccttagcagagagggaattgtccaagtcatgccaaagacttaagggcatgtcatagccagcttgagtccaggcaggagctgtagccaccagtcgggacaaagtcaggggacttgagaggtcttcacccagctgcggccaggagaaggcctggaaggagcatccctgctgccatcaagtccagggagggcagaagcccatggagctctgagctgagttgggaagtggctggaggggtcacttgtggggtggttaagccacccagagatacccatgagccctggggccagggaacaaaagatgtgtgaaggcaggtgactgacacttgggtgtgtgtggacttctacatagagaaatctccgtgttcttgcatgtgcatgtgtcatttatatgtatacatgtgtatatgtgtatacatctctgcatgtagctgtgtgtgtatgtctatatgattgcatgagtgtgtgtacacacagatgtatatgcccatgtttctggatgtgtgtgcccagcctgagggggggacagggttctgtacgtgtgtgtgtacacgtgtctgtgtgcatgtgtatgtggttttgtgtcttttcatgtgtgtggtgcctgtgtgtctgagtgcacattgtatggagggtctgggggctgcgtatgaggtaactgtgtgattctgtctgactctgggtgtgttttgtgttgggtgtgtctacgtgtgtgtctggcccacatgtgtctggcccacatatgctggcccagggcaggatggaggggcctcctgtgtggtgctgctggactctgttgtggtcaccacggccccgtgggcttagcgtggggcactggtggggctgatgttgccacttaacctcagggtgggatggcatggagcaggcccatcccgatgtccctgggtggcctggtggaatgtgcccacgggatgcccaccactgggggaccccaccagcgttggggctgaggcttaggctgtagcaggctaagaggtccgtctatagcagtggctagatgtctgtggctggggcctgtgcctgaggtcagaagtccatttgtggaagaggctgggagtcagtctgttgctgggattggggagggatcacagggaccagggtcaagagtcagaatgtggctgctgccatggctaagggtcagtctgtggctgcagttgcagatcagtctgtatggcacagaagacaggttaggcctcagccacaccactgtccccagccccttggtggcttcctggcccaggggtaagtttgagccctgggaacaaggggcagagagaagaaagcgcctgtgagtcctgctaccaagcaggcctgggcccagctgttcccatggccatggcagagaaccccagccagcccaacgtgtccagagtgtgtggcttcattgtagccaggaaccaagggtgcccaggaccgtgccagggtgagcagggcagtgcttcccaagtgagactgagagaagacccctgcctgcctctcagtgcatttcctcaggcaccctctggtgcctaaccctgtggctctataaccctccttctctcttctcctacccttctttcccctctcctttatctgctgtcatcctccccactccccaatctgtcttcctttgcagctgccctgtcctctctttcccccagccagcctcctgccccccacctgggccctctgaaccccagggccttgcctcttttaagttcagcagatttgacttcactcagacgctggcgctgaggaaggaagatgaatacccatagtctggatgccccaggagaaggaggctgcatggaggcccagtcacacgcctgcaggcgggggccgtcttcctggagcccatgtccagtgaagggtccacagcaggggtcaaggggggcttagactcggattctgccctgtttgagcctgaagctgcactgacctcatgggatggcctcctgcagtcaagtagggaaggatggacagacacacagatgacagggaaaactacagacagaaaagatcaaaggtcgttcagatcaaaagcaggcagaagacgcctcggtcttggcccagcaccagcattcctgtgcagaccccagcccagggcagagactgagatgtactccctctcccctctccccctgcttcccctggtcgggaggtggccaccaaggcaagccttctgccgtcactccagccagaacctgcatgggtcggggtgggtgggccagattagcctccatcctggaatcaggggagttgggacactgaggggacattcaaatgtttggaacatttgaaaatgttccaaaaatgtaagagaacttggatctctgtactcccgatgctctccacccccatcagctaaaatatcaagctctttgctttcaaagaaaagcattttctcgagtgttttgctctcagtttcacatggtagccccagcttgctcaggaagtgcttggcgttagagggttttgatggggagaaaagggaacagggctgtagttgttgaaggaccatgccagccccatgtgggcagggatgcctgttctgttccctgctgtcccacagtgccctgaacaacgcctggaacatggtgggttccataaacgtataccaaaggagatatgtgtgggcagttggtctgggagacaaaaccggatccatgggggcaggagggctggcagctgcagacctggatcaacatgctcataaaaaggggatattaaggctgggaaactgggaaggtgactggggtagatgaccccctgctgactcagacagggcacagctcctggtacagtcattaaaaatggggcctcttcagcagttttctaagctaccacattggcatgaagggcattaatgtgttggagcaggtacagtggaggctgaggaggggcagggttccttcctgaggcatttgctctcccaccagccccactagcatgaatggcagatcccagcagccgtatccatccttcttgcaagttgctcaggcaagatacatcagtgaatcctgctaaccctgccttcataataaatccaaaatccgaccccttctcatcggccccaccctggccaggcctcatcattgcccacctggactagtgtaggatgcaggcttctgtgctcctgccctggccccacatctgccctcttcacagggagaaactctgaccacccaagggaaagcgtgtcccatccctgctcaaaacactgcagaaatgcctcatctcgttcagtctaagagccaaagtccctacaatggtgtgtgtgcaagcccctgtaggtgtggccccccgtcctctctgcccacatctctttctgctcactcccctcaagccacactaacctcttggccattcctcaaaaatcccagcctggctgctgcctcagggtctttgcacttgttcttccttctgcctgcacagctttgcccccagacagctgcatgcctcactacctttgtctgtcaagtgtgttctcaaatgctcttaagtatgagctctgaccactcagtgtagaaaaacagcccctgcagatgctcccagcccgcttccttggctttatttatttttccatagcacgcttcacctaaggtaacatactacatcatttacttattcattctgtttcttgtctgtcaagactagaatgaaagctttgtctcattccttgctctgaatcctcaacacatagaatggagcctggcatctagtaggtgctcagtaaatatgtaccaagccaatggatgcatacttttgccaccttcaagttacgtgactgggagcaagtgcatttcctggacctcagtgatccagtctctcaaatgaggctgactgatggggcggggggagatacatagagatttgaagttgctgccccactactcaataaacatgtggaatagatgttaaaacctggcccacatctgacctcaggcctgcaggcttccagcgtgaggcttaccagaccagggctgagcttgaatgcgacttctgggtcttagtgtaccagcctggcctgatgggcctccccgtcccttgtttccacctgggtgtccctggtggcctgtcagtgagccttgtccttggctggctccactgcctgcattccctaggaccctgcttagagtccccagccctctacccaccctgcctctctggtcaacagctcctgtttactatttagctctggaatggcatctggacacacacttgcatgaaagcagctattgagatagtgcttggcaaacaaaagggctgacatgtccagacctaggttctccagaacacagcctcacctcaccaggaaggactgggccctttaaaacctgtgagcacccctaccatcccagcgaggagggaggatcctaattcccctggggcagactcttggtgaaaggtgaaatcagaacctagggagcaggaagcctgccagccaggcagcctcctctgctggtgttccagcaacatttgtgggtgctgggtgctggttgctggcaccatgatcccatggaatcctgccagtagggtctgatggagtaagcaaggctttggggtccatgcacacttaggtttgaattgtgaggttgccactccattctgctgcactgccacacgccatgcactgtgcttggtggaggtgagcaaagaatcttgaaattgagagtcggatgggatccgattgtgttgctgtggtcttggcaagttctttgcaggctctcagcctgggtttctcctctaggggatggtcagatcctgaccttggggtactgtcttgtgactctccatgataccacttgtggaagggccctggccaggtcagggtttccatcaccctctggcagatgtgaatggcagccctgctgaatcaagatccctccgtaccactgccccaggagctccagggagtccccagggagccagggaacaagagaggcccctggaacaaatgacaggctctgcccttttttgagataagccacccaccaccatcccatccctctacacccatccccagaatctggaatctgtgaagggtactcactgagcgacctggaatctgtgaagggtactcactgagcgacctggaatctgtgaagggtactcactgagcgacctcaggtgagtcttccgacatgtcctggccctgatgttctccatgctccaccccacccccattttatccaggggaactgttggctcaaagaagagaaaacttgggcttggtcaggcttatgggaggagggcttggtttaacttcattgttccatgcattcactcactcattcattgaacaagtgcttatggaatgtataccaggaaccattccaaatacggaagatacaccaaggaacaaacagacaaaaatacctaccagatacctaaatatgtaaattacatggtatattagaaggtagggaacagcattccaggcagatggatcaacaagtgcaaaggtcctaaggtgagagtgtgcctgctgaattcaggaactgcaaggggcaatgtgagtggggcaacaggctgggactgagggcaggagttggtggggacctgattgtgtgggctgtcatcaaccacctgggggactttctcctcctcatcactcagaaactgaggaggggagggaagacattccagccaggttggtgatccccagcgggcatttgggcttttccgttgccaccttaatggtatacacaatgcgcatctcctggttcactcagcagcctcaggactgagtgaccctggtccccaagacagatattgaagacagagactaagcagtctgacattttaaatatggggagccccgagtggggcggggctgcccaggaccttagggattcacttctggtagggagggctgctaccaggcttcagggaatgccagaaaaaaggtgcccgaggcccacctggcatgtaatgatgggcaggattggctgtaggatgtatagagactttagtatgggcagggttgggggttagtaggtggagaagggagattgggacatcattgagcagcaaaacccaagtgtgacaggtggtcggtgtgctcctgccagagcagaggggcctgagtaggaggaagtggaggtggaggccgaggagaatgagacagacagactcactggccagcgggagaaagtggtgggacgagccagggctgacacatctgtgtgatccctggtgcagtaactccggtagatggatggacacgtggatggatagaaaggtgggtggatgcagcgacggatggatggatgaatgaatgaatgaatgcatgcgtgggcggtgagcggccgggagaggggcgggccagctgagcgctcaatcacagccccggggctcggcgcccgccagctgcactcagaacccccctcaccgtggccctgccctgtggcgcctaattacgtgcccccagggctctggagcggctgctgggactgcagcgaagaggggcccgcgccacctccgccaggctccacgcgccggccttgagtgcgctcccctcggccgccgggaaacctagaggcgcggtttggccccaaggtccccggtcccgctcttctttgtctcggcctagttctcggctgtctccgggccgcgacccacctctcctggcggtccttgccgcatgcttctgtgctgcgccagaatcatcgagtctcagttctcgctgccttcccggccagtaggcgtctcccccagctggggagggtcccccaaaccctgtgcttctaggaccgcggggccggcaagcggcaggatctccaagctgcgtctctgatgcggctaggggaggcgcgcgatgaaggcccccctcttctccgccttctctctacgccccaccgctactacacgtcgcgctgcgccgcgaccccggcgctgcctgttggcgccttaagcggctcttctgccgcggtgcgatccccgacgccaggaggactaacccccacccgccaggcctcagaccccacgcagatccagccacacacgcaaccgcctgcagatacccaccacagccctttaagttaacccaaagccccgtacaggcgcactgcccctacatgcgcagccccacggccccacacacccaccagcccactcgcaaacaggcccacatggccacacaactgccctctggacactcagccccacgcaggcacaatcccatatacacacaaccgcacacaggcgcaatcccacccacgcagtacctcacggagtcacacaacccccctataaacaatcgcacagacacagccccacgcagcgccacatcattcagtcaaactgagacccagaaacacattcactagcttgtatccagacccccccccccaagccccgtgacattcactcgtaggacagaccagaaatatacagccacattgatacacacacggacctaaacgcacagccaagacctcacccgcaggctcgtaagtcactggaaaaatattaaagcgttccctccctcccctcctctatctttgacatacacacgcctgcgcgcgcgcgcactcttacactcacaccccccgtccctaagcgcgtcggagcctcgcagcgggtgaccccgaggccccgcggtgagagccaagggagcgtctccccggcgccccctcctcccgctcccttcccgagctcatctctcgcccccccgcccgcctcctccttccctgccccctcctcctcctcccttcccccgagtctggggcgcgggctgcgcgcagccaagccccctcatcgcgcgcccctccccgcgcgcgccccgcgccagcatcgcgcttaccgagtggatgcggccacggggccgtctctaattacctcctgacccccggcggcctgtgaataatggctactgagggcgctcgcaggggctgctaagaaggaaacgcggggcgcgagaggcgcggcgcgcgcgggagcgcgagggaaaggagcgagcctggggccgttgcaagcggctggcgagagaaaggattcgtgcgagcgctcacatttgtttctcccaaggatctcatctggccaccgcgttctggaagaggcgagagggagagcgtgcgcgagaggagagagacggcgggggaaagggagacggcgagacgcgcagcgccggcgcccgggagacccaggaggagcccgcaggtattgttggcggcggagctttgtgttttcggcgggctgctgtgggcgccagggctccccgagcccccggcccgccgccgcgcgcagacctgcccggagtccggggctgcaggctggggtcgccgcccgccgcggacacccctcccgcggcgccaggatcttggctggagttgcggatttgcatgtttgggggttttccacgctggttgagggaatcggtctcagaagaaggaatttctttctttcctttttttttttttttttttggccgcttttggccacagtttggttgtgctggggattcccccctcccctttcctccacaaagcattggtgagcggtcttgacgaatgtggtattggcggaaggcatggggctgagatggcggggctggtggccacggatggggaggcgagagatgccagagaaggaaggagttctgttcaagttcgcaatctgcgccccgaagctggtcggaccggggagggcgatccgcgcgtccgatcctgctccgggcaaccgatgggaaacttcccgagagcgcggcctccctggggactcggcgcccctgacgcctccaggcgcttcctcgggccgctgcggcccctcctcgccgcccgccagcgcttaaggtcgcgctctccccacccccgccttcctcccttcctcggcggcttccggatctggacagagctgcaggagtggcttcaaacacttcccctggagacccctccccactccccgcacgagagcctgcccagtggcccccctgccctgcgccccagtctcacgcgcggtcgagtggccaggctgacaatgaaatctcgcacctctgccggggggagtggggtggggaggaggtccctcctggggctgctgaccctgggcctcgggcagggggagggggctcctgggggaggggcttgttttggttagagacgtcgacctgggatggcgccggggcagggagggggctggggggtgggcgcggcgaaggcggcaggcttgggttcgcggccgggggtcgtggatggcagcccctcttgggcttggtgattggctggtgacttcaggcacgtcgagggcccctccaacctcagcctcctcccctctggtacaatgcgggctgaaagaggtgatcccgagggtgctgtgcttgtgtgacgaagtgtttgtctcctgcgatcctcagcagacgctgctccggtgacccggagatccggacgcctcgacccctccctcagggccgggaggagaggaggatgaagggggaggagagtggtgggaacttctcctttcccattgaggccatgggaagggaatgctagcccagaaaatttctggggaccgcagttctgaggcggggactcaatccaaggggggaccaccgggtcagaggcttcccggcacgcagaagcccccagattattttgctccatcgggggatgcagaggaaggggagaggtggaagagcgaagggctagctggactggcgttgcgggggtggagagcccgtggaaatcagccttaattggattcccaggcaagcagccaggctatcaaggtgccccctcccctttttcttcctggggtagagagccaggtccagagacaccaagctggcaacccaggcaggtgaaggcaattcctctccctacttaaaaagagaattcctgggggagaggggaggcaccttttgagagggaggggggcggctagactgtgttcaggctgttctgtctcttggtccaggaatagaaagagttaaccctcccccagaaatttgtcagcccccacacagcagggaaacattgttggaccctctgacatgctaacagtgtgacaccggctgactggagctagcagattctagaccctggactcccccttcaaagcccaacaggactcggctgggtggtgccttgttcagggaccttgtgggaggcggaaatgagagcccagagagggtcaggcagcaaagcagtggccttgtggcccggagggaagaggggttacaagccagggccatcggaaactggaagggaagtcgccatgggtctggggtagagggaagggagaggcccttctaccctttgcccagactcctgagcaaggctttgccctgctccccacccttcccacacacccactcagctgcaggcctggccattaaatgtgggtgtctgacccataggttggaccatgagaccctagtggctgagggaggcctgggtgaggctctgggaggcaggactgaaaccagcaagggattcactgctgctcatgccctatggcacaacccccttatttatggggctgccttcccttccccagacctcgagtttccgttttcaagaacctttttcttcctatcttccttagggcccccagggcctagcacacagcagtcactcacagtgtcctgtatttgtccagctaaatggagtgaatgaatcagtggtgaatgaatgaaaagggaaagtttctcaattggaagcatctagcccttgtggttttttttaaacctttttgaaatatatattgtaaaatagcattcacagaaaagctgaaaaaaaaagagaaaaataaggttattgacagtcttagagggctctgacaatgttagtattttgatgtagttcttcccagtccttttcgactcggtggttggtttgttttttaaagactttgtcgtcattctctatattcagatgtatatcctgcttgctttgccggcataatgtgagccttttcctgttttgtaaccaatgcttcataaacaccatggttaatgtcttcaggcttttccaatcaagtggatgtaccataatttacttaatattccccttttgtccaacattctggatgttcctgatgaatgatgtagtggatatattttgtatagcttttcttgatacttaaaatgatttgctcaaaatgccactgctgatgccgaaggctccgactgcctgcagtgggagaaacggcttctctagttttccttggataaatgggacactatttttccttccccacaatctagaaccttccatcagagccgaaaagagccttggcaatgaatcacctatctgacctccctcctttgacagaagaggaagccagagcccagagaggggaagcgagtcccaaggtcacacagcagttgctgggctatgcagcagcgaagacccagctactgatttgccatgttggttttcgcatctgaaaagattcctgaggtctttaaggctgaccctgcccatttcacagatggggggactgagaccccaagcttacccctggtgccgccagctggagccccagacaggcttctcggccctcctgggccacccccgactgggtgtgttcacgggatctggcggctacaggctccctgttgcccgccccacctgcccaccacagttccccttcctctttgccatcccattctccagacaaaaagctgaggatccaaagcagatgcagtgagggggtgggactgtaggtctctggggaccctagtggttgcgtccttgccccatgcctcagtttacttgtcagagacctaaccttggatctgttcaggagcagaggcagatgttggcacagatatgaggtatgaaggagtggtgtgggggatggggtgcaccttaaaatctctctctggcccgagattcaccccaggagaccccccggggagaagggaaggagagagagagggaagaaagagttgaagcagagacagtattccccatcagaggacagggactttctgccccctcccctgcagcacaccaaccatccgtgtgcctctgatcctgcttgtgtattgcttaaggggtttgtgtgccttccagcttgggcatgtgttgtgcatgcgtgcctctgtgtgtgtgtgtgtccgtccctgtgtgtgtcccctctgtggtgtcagtctctgatcccatttgtgcatttctggggggaagggagggtgcccccgagctcggtcttgtgtgtgcgcgtgcatgcatgtgtgcatgtctgtgtgtgagcacactgtttcctcctaatggccccaggagggatccaggcatcaggcttttgtgctgcttcaaggttgtggctgggtgggcgaagagagggaaggccttcgacagggaggggtggggttgagggaggcaaaagaaaatcttaaaagaccgtcttccctctggtctccaaggagatcaggctgtgaaatgatccgcacgttaattaaaaacgattatatcctgattgagccattcctgctcacatcccccagccagggagaggaagaggctgagagcagaggatgcaaaatggggtagggtccaatggcagggcatagccaggtggagccacagcccacggaggggagcacaggctgggggagtcaagtgggaaggtgttgaggggcacgtgcccaagtctgattggagcttctcctttgaattttagggactgtcttccagtggtggtctctgagatcccaggagtgggtggcagccacccagccccatggatctccactcatatgccaggcactgagcttgttgtttgcacagatcctgcaagtcagcgcttgtggttccagttttacagagaagtgacatgcttgaggtcatgcagccaggagttgggagccccagattggacccagtcctctgaccccgaggcccagatgcccttcatagctcctagctgcccccagattcccaccatgagcccctacctctgcaggacccctgggaggctggggcctaccatgacaagaacttctccatggcgcccctgaggtggttccttgctgaggtccgagcagcacagggctgggcggctgtgatgtccattcacgtggggagctgggtgactcactagcctggagcagccttgggctgactcaggtcacctttgccaacctgggcaaggcctgcctcgccccaccttgctcctccccaacactggctcatggttccacagcagaccagccacaggtgccccgtgaggctcaagacactgtatccacactgctgggtacctgtgccatgtcttttctggaaggagtctgggcctggtcacgctgggccttgcctggttatctgtctgctgtaagccttgtaaggactacggtggtagaaaagagtagtggtaacaataaaccagacgaccctccacctccaccccagcatcaggtgttgcggggttcacaagcgtggcagatctcagcatttgtgggacctgcctgctgccatacctctgcccactcccatccacccatgtgccacctctgtgttccctgagcccagcttctccgagaggaggagacccactgtggcttggccacacccagaagcaagtgagatcgctggccacgagtgggggctttttctgcttctctgagcctcagtttcccctttgtataatggggatgatagctttttccggagaggactgacaagagagtaaggaaaaccaggtcaagtttgttcaagtgcctggcagccctggaacgcacacagaggcccatttgtgcatttgtgcaactgtccatccgttcagggcacttgtgtgttgccacaggccttgggtttgctggcttctggggagggacacacactgtcacatttcagtgctttctaggagacagtctggggctcaggtgactgtcatctcagcatgagcctctagggggcaaagatgctcactggacccacctgaggctatgttagcaaaggtagagtgggagaagggagagatgtttctgctggggtaggtcctagtgagatttgctgaacctggtcccacatcttagcaggagccagaaacagtatcacgaggcatcagaggggcgggcagaacaggaagtcagcatccacctgttccccaaggcagaactgggagagaggcaggcagatgttcactcattccacaaaaagccctttgcactgaagcaggcagagagaccctgcctgcgctgggtcatccctgcaagatgccacctttcaggagaacagtttttgtgatgttggtatctgccttcctcctaaatatccccttcctgcccttcccagggcctgaaatgcttccgttagtcactgccgaggtcagagcatggaaggccctgattaaaatgcaaactgttacttggaggagtgatcagaagatgaactcatgtttgcataatgcagaggccacccacccctaggccccgcagggccgggcaggcagtgctgatggggttgtggtggctgcctggccctcatggggcgcggtagctcagctctgccagggcagcccatggggatgcagcccatggcgcctgttgcccactgtctcaggaacaggattagatgttgacatgacacttcctggtctgtatatgttgtcacctaattcagcagcacccctacgaccagatttagacctggggccactagtgcagcctcctggcttcaatgctgctgcccagtgatcactgtgaccatcctgcaatacaagtggggcagggacggcaaagctggggctcccagaggggagctcccctgcccaagtctaggccagtgaggccctgccagggctgaggtgtcatatgaggtgctgtcaccagactgggggaccgaggcacaagatgagactttgttggcccaggagggtaggctggaggaggcctttccaagtgtggcacggggcggagaggcagagaagctttgccggtgtcactcttctgtgggtgtcccagccacaggggccttacttcgggcccactcgcagcctgggaccttgggctagagtccctgagtggccgagagagagccctttctaggaagcagggcaggcgatgcccaaggaggcaggctctgcaggagctgggaactgccagagcatcaggcatggtgccagcctggtatgcttctcatacccacccagcccttggtagccctcctagaggtgaggacgtgggagcagaggggccacacacatagggtgtcgggaccagcctgaaccgggtcagcctgaccctgcacttggggtgcctggcggccaggcctgtcctgcacatctgattcatgcctcgtttacaggctgtgtttcattcccttcagtccttccacagtgtctgctgatggcgccaaggttctggcccagatgccctggcgaaggcacccaaagggacaggggctgggtctccaaggggaagcattttgctgcagaaggaagggtgttggctgcaggacacagcatgccagaggcctgggggtgtgggtggcgagcaggtgggattggggaggtggaggcagggactgaggccaaaaaggagtctgggccttgactgcttgaagggttttatcttgaaggcagtgggaaaagatgggtgctctgggcagtgagcaccgctggagcaaagtctcggcagtgggaacacacagggacaatgaggagaggcttaagaggatcagaagaggacccaggtggggcctcagtttcctccctgagaactcctgagtcctctggggtgtgggctggatgagagcagcctccctcctcctggagctgctgtgcaggcctagaatgctggtctagagggaagcagggacctgaccatctccccaacctcttgcctaagcccagagcagctcggcctagccctgcatcccctgtgagctgagcactgggagggactgttcagtctcggctgagaagtaggtgatggtcctgggggactgataattaaagctcagcagattataattccctgaaagaaagctcagcacagagagggaggaacagtgcccagagccttggcacaggctggaggaggattgctgggggaggtggtggtggggggaataagaatgatacctggaaccatcgtgttcagagcttcctctcggtgaggcctcctaggtgcccagccctgggcactttgctgtttccagtcttcagaccctccttgccaatgaaaggttcctgccatccccattttacagatgaagaaactgaggcttggaaaggtctggcaactgtggttcaaggcccatggctggtaagaagtgagcctgcggctaaaccctgggctgtgttgggagcgttggcctccttactgagaagaaggcactgcttaactcagagagaggctgtctgatggcagagtcctgggcaggccacaggcctgaagcaggaacaggttggagcagggaagacccctcaggacattccccatgtttgtggccttctgtctgggagagggggatgggatcaggggtcacactgtggtgactggatctgccattcacttagtcacctgttgtgtgatgccaggcaggtgacgtccttccttgggcatctcctctataaagggcttgtgttctcctggggtttgcaggcttctttaagaatctcttcctccctcattaatcctacaggtcccaactgagcctgttctcatgccaggagctcctggcacactcctttcatcacctgccggagctgggctctattatcatccctatttgacagaagagcacaccaaggcccagaggctactgctgcctggcggtcagccttctcctcaccagttaaacctgcttcgtgcagtcctgctgcccagcttgttgctcctgcctgtctccttggccctgcctggaagaccctcactttcccatgccctgtgcagagcctaccacctcctctgccatctcttccacagagaggccagggcttgagcacataggccagaggttgtcctctggcaatgcccccaggtgggcgctgtttggccagcccaggcttttaaaaataacattggatttcacataaaaattctacattttgcttccctgaaaaaaaaaatcaggtcggcattgcagggccacacacccacagggcactatcggcagagctaccatgggactgccaccttctgagtcacctggttccctgcagttcccactcatgtgccagctgggccctggcactctggagcttgccaccctgcttagacctgggttcctgccctggcatcctggctttccctgatccgaggcagattctatctttgaagctcatctagtaaatgtcaaaactgagaaactgattccaaactgggtcttagtgttttctgagaattctccaggccagaaagaaaaagaaagggtgcaccagatgcggggcactgcgtggggaaagataaggaggtgtgaaaggatgcagaatgcttggggaataataccatgttctccttgcctgttaagtacttggttggcaatgcctgaatactaacaccaatcagattctgcttgttctataagatgattcattcattccaggcattcagatgaccctcacagcatccctgatagagcaccattgtgggtgcttttattctcattttcagcagatgagaacactggatctcagggaagtgacatggcacgccccaggtcccagtaagggcaggaccctgacaagaattccgactcctgactcccagtccagtgctcgttctctctaagacactggaaaaattggctcttaggtgggcttctttctctggcacattttttaaatgctcctttagttaatatgcaggagggatttccatgttctcgtacataaccttttgctgaagtgacaacgtgcgataaaagggtcccaggagagccagtgtaatttgggctgtgagggacagagaataccaatgcagaagcctctgcagaaggcctggctgctcctgggggctgggagacccggggccccctcaccacccaatgcaaaggtctggccatcttgggccctgggaccacgtgtacgttctgattcgtcttccactgcttggtttatttttctcacgtttttgggtgaggatcttggttcctagaggagggaggtctaggcagagagaaaatgagcatccaggacagggggagagattgaggaggatgcctgaggcagacgttgaagccttgtttctagtcaagcactggctagttggggggtatcagacaaaggggtccacatagaaggcaaactgaagggcatgttcaagtgctgttcacgcctgcctttagcccccaacgaccaaaagggggcttggcatagcgagaccctctctctacaattttttttttttaatttagccaggcatggtggtgggtgcctgtggtcccagctactccagaagctgaggtgggaggaacacctgagcccgggaggtcaaggctgccatgagccaagattgtaccactgcactccagcctgggtgaaagagcgagaccttgtctcaaaaaaataaaaagttggggggatgttaaggaggttccagttaattgtggctgattctaaattgggaggcctaacaaatggtacttatcctcccgtgggagcagaccagggctaaccaaggccgctgggaatgggggtcatggagacagagccccttttccctcccacccacctgaaggctccaagaacttccactgcagaggtgtcagggacggacctggtgcagaccagtgggcccacacctgctttcctatgtgcgggtcagagcgtgtaggtgtattacatgcctgcctgtgtgtctgcgtgtgagctccttggacacacacaggggcacatatctgtgcttgcatgtttgtacatctaagtgtgtgcgtatctgtgtgttctgacaccagctcgcgacaccagctcgccctccacaaagctatttccaggccccattccccaagaacagccatctctctctcctttcccacctgacatggggcagggaggagagaatctgtttgaaatctcaacaggacatgggctttgcacctccagagagcaggacttgcttgtgtggacagaggtgacatagaaaggtttcagtttcatccaaatagaaacttactttttttttttttcgagacggagtcttgctctgttgcctaagctggagtgcaatggcatgatctcagctcactgcaacctctgcctcccgggttcaagcaattgtcctgcctcagcctcccaagtagctgggattacaggctcccaccaccacgcccagctaatattttgtatttttggtagagatggggtttcaccatgttggtcaggctggtcttgaactcctgtcctcaggtgatccacccgcctcggcctcccaaagtcctaggattacagatgtgagccacaatgcccagcctttttttttttttttttgagacggggtttcactcttgttacccaggctggagtgcagtggcgcgatcttggctcactgcaatctccgcctcccgggttcaagtgattctcctgcctcagccacccaagtagctgggactacaggcgtgcgccaccacgcccggctgattttttttgtatttttagtagagtcggggtttcaccatgttggtcaggctggtctcaaactcctgacctcaagtgatccacctgcctcagcctcccaaagtgctgggaatacaggcgtgagccaccgtgcccagcccaaagatgcacttcctctcattcagaagtgatttagaagtggcctgggctgctccaggaggtagtgagtgccccatcttaggtgggtaggtgtgcaagcagatgcccaacctgtgccttcctctcttttgtggtcccttctaagcgcaaagtgcctagggctgtgtatctcctggcggcagttctgaggtggccctattttgccaacccagcctggttggagggactgacagggcttctgcccctaggtgtcccctgaacttggcccacaaaaggcctgaggaatataggggactgtgattgtgtgtgtggtgtgtgatgtgtgacagtggacttgtttgtgtatctgtgttatgtgtgtgcatctgtgtatggtgtgtgtacttgtgcgggtggggcttcaagggttgagtgtggatatccatgttgtgagtgtgcattgcgcatggccctggaggatggggggacatttctgggctgtgtgggtattgactgtgaactgtgagtatgtgcacttgggccagtggaggtgtttgtggctagaacgtgtctggagggaactgtgctgagacccccaccgcctctgtcctggttcattccttcccaccccaggctcctctcatggcccctgcccccaggtcagacctgggaggctctcagtcatcccaaactctgaccattcatgctctccctcccagagaccttggcacctgccagcactgctcttgactttgtccttgctctgggataagagcaggcccagcagatggccgagaggtcccaaggaacagaggaacaggcggggaggaggcccagtcactgcttagcttctctgtaggagatgtagaaggaagtgggtctttgtgtttctgcagcatctggaccagatggagagacctttctggagatggcatgcacacttccagataggagctggaacatttccagaaatggaatgtttttagaaatgagacatggtgtttctggagacaggatgaggacgtttctagagaagagatgaaaagcatttctggaggaggggcatttctgaagatgaaatgagaacatttctggagatgggagagggcatttttgaggagtaaagatgaggcttttctggattctgagcattgctagagatggaacatttctggaaatggattctttctagagagaaactagaatacttctggaagtggtgtgtttttgaagatgatgctggagtatttctggaaataaaatagggcacttctgaagatgaggtatttttggagctgaaatgcaacatctctggagatgggatatggcatttctggaagtggaacattcttggagttagggtggagcctcagtagaccactggcatttctggagatggattacatttgaagatgacggggaatatttctggagataagatggagcatttctggaaatggaacattttggagctggggaatttctgggttaaaatgaagcatttctggggaagaaacaggtcattctcagagaagggacattttttggattgaggatgggacatttctagggaaggagttttctgaagatgagggggtcatagctcagcctggctgtttcaaggccacttgaggaggcaataggggagggtctcaggggcccagagaccccacctgtggtccttgttttgcacatggcccgagggagggtcttgcccagactcactcctgctgagctgcagagtgggcttctgaggaacctttccagaatgcagcctttgccaccccctggcccaaaaccctggcctgtgctggaatactaccagagggaggccagagctgcccagtcttactcttggggtccctacctgcttctggtggggtcctggcagcctctaggctcaccacagggataggcagtgactgaatggttaaatttaatttaattcaattttgtcaagccagctgaggcttgctccccagccccctctgccagaagcctgtacctttcctccagtcccccgccccatatccccctaccatggggatacctgagggtggccttattgcagcagacagatggaggggggctacaaggctgaacatgggcaagggtccagggcccttctcgggctcagcctgatttcagggcggggggccccagccacctccgcctactccagagaagcagatattgaggcctgtcaccacttgagcaggcctggagccccagagtaattatttctcttccttaattgaaatttcagcctcagtgatccagcctcagaagtgtaaggcaggcacagagaccctgcccctggtggggggagggggcgccccccaccctggccccagaaggagggaggcagtgccatcccaggggggcaggtggcttcacatgctggtgggtgggcatgaggtggacggctgctggtcaaggaggcagggtcaagggggccagtatggcatagtatggcctgagcactcagtatggcctgagtatggctcaggccagtatggcagctgccatgggaaggttgggcctctccctctgactcctgacagaggaaggtgagggggttgatctaggctaaggtagcatgagggagtgagtaccaggagactgctgcctcctcccacatctggcgggcactgaggggtgggctggggtgggtgaggggctatggtgtgagtggggcgggctggctggcggcaggcccagttcctggttcagggctgggtgaggcggctggcctggcggggcggggtggggtgggcaggagggtgcagctgaggagcctgttttcccggctgctgcggtcaggctgggaggagcctccgccacctgggtggtccctgctgccctacacggccttgggcctggcctgtctgcgggtgaaggcgggggcagaggactccagggaccagcaggaaactgggagaagccatgggcttgaaatgagcctggggtccacccctccgtgagcttctcaaggtggctctgaggtgctggggtaaacgtagcaactgccagcttgcagctgtgtgtgtctgagctcaggcaacccaggcaccacacaggaagctgctgtactcactggaccctgatgggctgcagagggccagagagtctacttgtgggcccttctgggtgtcagtcttctccatctggggaatgggttggcttggtgggagttttcaggcctgcattaccttcaaagggctcatgctgcaagcatgggctgtcctccctgtttttataagtacacgggccccagccttacccagacagcccagcacgctgcccgtagtatcctggggaagggcagcagctgtcatcagtgttatttctgaggtgtgttttcctggcaaccaggaaatttctgtcagtgggaacagcctgcccaaggcctcctccacccctggggaagacaagttgtatgacaagggagacagaggcaattcaaagtgaagaacgggagtgaggccgcctcctccgtgcatattgctcacacactggggcagccacgtgcccagtaaaggctctcttgaaaaccgtggagataggagccaagctctgcaaggccctgactagctcacctgacccctggcatctagaagctcacagcctattcttggtggaggtgtggctatggctgccctccaaggaggggaagacagagatggctggacaggatgggacaagccagcccccaggagctggggaagcgaaggtgggtgcaaatgaaaacgcagaatcccatttgcagtccatttgcttagcagccctgaccaggagggagagaaagaagagggcagagcagggagagatggggagggataaggatacagagagagaatctggcagccaggggtcagggagcctttggccgtaaggcctgggatgcctgctgcttactgaggctgtggcccctcctgccttccagagctaagaaagctttgctctgtctcagctccagacaccgcatccccaccacacattccagcacctgcctgcttcccctgacctctggctgccccacagaccccatccctacctccactccttggggattttgaggtcttatgccaccactccactctgagcaggctcagtctccctgtgttggtggtggtgcggggtggtgagagtggtcctggagcagtgggaactacccggaggccacctggggtgggtcccaggcaccagtccagctggccagtgggccacgggggctgaccttgtcaccttgggcccagatggagggcagcggtgctcggcccttcccccaagcacatacagccgctgagctaacatgactcaccgcgtggcagctccctctccccactgggagtggggatggaagcctccagatgctgcagccccaccctgagggaatcacaggccaggctgagcccttccaaagtggggatagctggggatcagacatcagcatccattgaagggggtgttcacccgcatggggtaagccctgtgcctgggactctgggcttagtgcccagctagggccttgggagacccttgggcttctctgtgctcagggggaaaggagctgtgcagcctctaggggtcctgcctgccccaagctgtgctggtggtccaggccccctttggggaggaccctggccaggggtccctagctcctcctctgtcatccagagaacccttaggtcccaggggctggtggtgttcctcttcctcagaaacactacctgcaagactggaaccctaacacagccacctctggagagttgggggtcacccatctcttctttgctccccacccaccctggtggaagtggttcatctgctctgagccctaaagaggaccaggtgggaaagaggcctgatgccgtgctgggggcttcgaataggtacaggcacttctctaaggttgctgtgtagggcaagaaaatcagctcagagagtgaatgaatttgccccaggccacgtggccatcaggtggcctggctggggtttgaacctgtcttctcagagcaaagctgacttggctgcacctccctggacttcagctttcagggagggaggtccaggcagcaggagcctgggggacaatgctatttttcatattgatttttgtattgacctgcatcctgttgcccaccccggcaagccccaggacagatcccgttttggttttcgccagaacaaagcaggctgtgctagacctgccaaagcagatacttcctcagagcaggtgaaaggaaactcaatcttgtcttttgttactcaaggagggagtgagggaatggctttgcccttgaacagggaggccgtgggcgggtgggaggggtgggtgaggcagtgtggggagagggcaggggcacacatacctgagccgagacaccacccccgcccgccgtcagagcatccggagtgtggtgaccatgttagtattcagcacaagcgcgcgcgcacacacacacacacacacactcgcgcacgcacacacgcacgctcacactcacacacttaagcgcacacgtacacgcacgcctttctttccgtctctccccaccaccctcctgagtcccctctaaaccaggaaggtagcatctgaccagcagagaaaaaaagagagagaaaggaaaagagaaaaagagagattagtgggaagaaaatccgattctggagttaccttagttaccagctcctaatgactcgcagggcgggctcggccaccttcctgagcagggggaccctccctcccgggcccctccatcaccccattaataagacggggcccttgttcatgagttctgccacagaaagggaagaatcaaggacttttcaataagagagaactccctgggtggttttgaatagttgctttttgtgtggcagtgcgggactcgtcctcggctctctgccctggccgcctccctcagctggctctgtctggaactgcctgctcctgggtctccagatggatgagcttgtttctccgggagctcaatcctttattgttcctgcctttcccctcctgacaccctcagcttagcagaggccacaggcagcctttgcgtctcaggaaagcaagagaatccccgaggtggttctaaaaaggcttaaagcccgggagtggggctcagcatgaaggaaacaaaagcacactccccacatccagggtgctgggcctgtcggccagggccaagctcacggccgttgcttcggtgccagtggaaggggaatgaatggaggagagactgggtgagggagatgacgatagaacaggagggagatgggtaaatccgttttatcagacgctgcatatcttaggaaagcacatttcagctcttttggcttttggcaagctggtcctaccctttaattttctaataaaaaggaattacgtttgctgaaaaggcagtaaccagcttcatgtcagtgtctcttgtggagaccataattcccgtcttgggtgcctgccggctctggggtgggaggtgggcttctgtggccacgggtgatgatattcaggagtcaaggggcagggacgtcagggcccacagcagatgccaggcagtgccacatggctttgccctgcttgccccaccctggcctgtccactcccagcccagcctctgatcatggttccaggctcaccacagacagggctggcagaggctcccaagactcacaatagacacttaatgaatatttgtggaatgaatgaaggaattcttactgccgaggcctgaggtagcaggcaagttgctcagagggtcagatcttggtttgaatgaatgaatgaatgaatgaatgaacgagtgaatgaatgaatgaataaaggaatgaatgttctccagagtctgaaactatctatctggaaggactaacctccaaccaaccccactctccctaagctctggcactgaattcactggaaactttgccaaaaataatatcccctctgcttttaacaaataatatgcactcgttttaaaagagagagagagagagaagtgtgtgaagtcgcaagttcatgtccatgctgtcccacacctgagtcccccagagccaagggtgggcacccttagaaggtcctttagaccttcctccaggctctgggaatcccctgcatttcttatctggtttgggggtccttgcacacgcactgttctacaaccctatggggcccctcggccatccctgtccccagtgagatctggatgtggttcagacctccctgggctgcagagtgtcccttcctgctctccaacctgggaacaggagccaggtatttatgtaagtctctgtggggtgaatgtaggaaaacatttttgctattacaactcccttcattccagtccctgatttattgatttttgagacagggtctccctctgcagcccaggctggagtgcagtgacatgatcacagctcaccatagcctcaacctcccaggctcaaaccatccttccaccttagcctcccgagtagttgggacttacagtcacatgccaacatacccggctaatttttaattttttggtagaggtgggatctcactatgttgcccaggctggtctccaactcctgggttcatgtgatcctcttgccttggcctcccagagtgcctcccaatgggctcacaccccagccccagttttaaacaagatcctgaaggcagaacactcaccatgggtaggcacttgataaatggtagcctttgtgatttgggaggaatctgtacccagtgctatgcttggttccacatcctaagcattgcttgtgccatactatatgccaggcccccagggcgcaggaacacacggttccagaggggtgtggaggcccctgagtggcagcgtccaggagcccagtcgctgcccctgcccgcagcagcccatcactgctggtatccagcctccttcagactggtgtatgccactggaaactccaggacatgtgcgcagcagaccccacacacgtggtttctctggggctgcctcctgaccccaatgggcaggcaccaggtctctgaagctcagctggcaaatgtaggagcagcccaggatttggctggttgggcacatgcacggctcccgtcctaggacctgacttaatctcaatccttagaggtggcctgggaatctgaattgttactagcctcttggctgccatggatcccttccaggatcaggaactggcatgaggcataggagggccaaggacatcttttaggctgcatggagcccggatccactctgcagcccctggctgggccgtaggagagcgggcaggctcagggcagggaggggagctaaaagggaatggaggggagaccagcaggagctctgtctgcccgattctggtttgggctgtgagacagtcattgcatttttttgcacagttctggccacacagtatttaagaggctttgcctacagacctgagtgactgtgtgaatggtggcactggtgcatacggggacgcctgaggaggaacagatttgggacttgtccacctaggactccctgtgggattgccagtatcacccctcttcgtcattaattcccagcttgcctgggggaggccagggggtagcatggggttcgggttcccctagggttcaaacaccagcccatctgccctgggtggcccttccctgctaagagcctcagtctgctgttctgtaaagtgggtccagccatttctgtaccctcagggtggccatgagggtcagtagccagaaaggcaaggccccacacagaactggttcacagaaatagcaggcagtttgtcaggggcagccttggcgtggttttcattcaaaatcattttttaattccaaaagaaaggaaatggttgtaaataaagaagggaaggccgggcacggtgggtggctcacgcctgtaattccagcactttgggaggccgaggcggacagatcacgaggtcaggagttcgagaccagcctgaccaacatggtgaaaccctgtcttactaaaaatacaaaaattagccgggcgtgatggtgcgcacctgtaatcccagctactcaggaggctgaggcaggagaatctcttgaacgcaggaggtggaggttgcagtgagccgagattgtgccactgcactccagcctgggtgacaggttgagactccgtctcaaaaaaaaaaaaaaaaaaaaaaaaggaaaactgtagaggcacataaacaggtcagagttcctgtctaggcttccctagaggtctttacttttactagtgtaatctgagtctttgactctgtttgtgggcatttacatacacaattaaatctttactgtgtacctactgtgtgctgaaccccgaggatttcagaccttgagccctgctgttaggggctctcacagtcctggtggggagactgacccctaagctgataaatgacccctccatggggagtgggcctgtaaagtgatgatggaagagggtccacaaaggagggaactaactgtgggttggcaggacagggaatggggatcggggaaccttgaagggacatggagtgtgaactgggactccacagagatcacaagtttttaggtagaagaaaggagagggaaaagcttggaagagcatattctaaggaaagggaggtatttgggatgtgctgactttggagtccctgtgggatggccatgatcaacccactgtagggagccaccaaggggttctggatcttggatgccaggccatggagtttctgttttattctctaagtcagggagccattgaaggcttttgtgtgtgtgtgtgtgtgtgtgtgtttgtttttgtttttgttttttttgagacagggtctgttgcccaggctggagtgcagtggcacgatctcggctcaccgcaacctcagcctcctgagtagctgggattacaggcacgtgccaccacgcctggctatttttgtattttttggtaaagacagggtttcaccatgttggccaggctggtctcaaactcctgacctcaggtgatccacccgccttggcctcccagagtgctggattataggcatgaccaaccacacccagccctgaaggcttttaagcagggaggtaagtgagctggtccagcatgtgtttttaaaaactctttctccagcagagcttacagaagggtgagcagggtgtacccggggggcttgtgtggagtccaggccaggcagggacggtggccagcgggtggaggaagccgtgaggatgtggccggaggagaggggcaggcttgggccctgcgaggtgggtgctgccctgggccatgattgggcatgagtggggagccgagccataccatggccggggacagggactgggtgcgttgttcccacatgagcgttgtggagttggcatgcattgggaggcatccctctgggctcagcccctgcctaccaggccaccattgcccctttcttggccagcagatcctccaccagcacctgtcagccccgagcactggaaacggcagccggcggggcctttgtgcttcaggattccttctccagggacacgggtgatagccaagcccggcagatgcccccgggggtgccaccgtgcccccactcgccatctccgatgctcagctgctccccagaatgaaagaccttgtcacaaagggaggcagggagaggatgcgcttccgtgccgcagcccatctgggagccaacgttattttcctgattgaaggaaacatctgttcagtcctctttcagagcgaggcaggcagcggactgggtcggtctggctctgggcaggaggtagagaacctgggctgagcccagagcccctgccctaaggggtttaagaggagctaccaccgttctctgtccctccctaaactgggagttcaggagctcctgccatccccttaagaagcctcggtcactgcctcccccaaggatgggggctgctggggcaaaagccatcgcctgtcccagagcaccatatgtgttttctttttttttcttttcttttcttttttttttttttttttgagatggagtttcgcttttgttgcccaggctggagtgcaatggtgctatctcggctcaccacaacctccgcctcccaggttcaagcaattctcctgcctcagcctcccaagtagctgggattacaggcatgcaccaccacgcccggctaattttgtatttttagtagagaaggggtttctccatgttggtcaggctggtcttgaactcccgaccttgggtgatccgcctgcctcggcctcccaaagtgctgggattacaggcatgagccaccacgcccagccccatgtgttttctgaggactccttcattatttcacacacacactagagccatgtttttgaaagatacggctgccaaacaaactgcatttattacataatgattaattcatcgcccccatttcttattaatcaaagacatccataactgcctatctgagctttgagttggggagagaaccagcggggcctcaagctgacagccttcccacccagatcaggggcactggtagatttgtgtcagtggagcctcatttggggtaaatgcacagtacccctgaggtttctagaagaaatggagacagctcacagacccccacacgtcacctccccaaacccctggggctgcctgggatgttttataaccccttctccagccagccctgagctcaggctggctgcttggcacttagccactggctgactagtggcctgtcagaggatgtggaagatggggtgggccagtccctgttgctggaggctgcaattagtggcagcctgggaaggagactgaagcctgggctgaggtcaggaccactgggcagagcttgaggtgagggcaaccgacatagggctgtcctggcagcccatcctgggctgagaacgaattctagggttccaggggcatttgacacgaggccggccacactctgaggttaggggctttttcaaagatagtttggtggcaggggcctagagtatggggagtgccgactgattgggttggagctgccctcttgtgcttagtcgcttctagatggaggccacaggagtgcttggtaggtccaggtggagccatcaattgtcagacatgcaaaaaacttgaaaagatatctcaaaagggccagtctggctgggcacagtggtgcatgtctataatcccagtgctttgggaggtagaagcaggaggatctttgagcccaggagtttgagaccatcctgggcaacacagtgagaccccatctctacaaaaaatttaaaaaattagctgagcatggtggagtgtgcctgtggtcccagctacttggaggctaaggctggaagatcacttgagcctgggaggtcgaggctacagtgagctgtgatcgtgcgactgcactccagcctgggcgacagagcaagaccagttctacctggctagggtggccccagagtcatggcggaaggcgaaaggcatgtcttacatggtggcaggcaaagaatgaggacacccaatcttctttactcattcatctaacactgactgtgtggcctggcacccaccaggaatgtccctgccctcaaagtctttacaggctgttggagatggggcagatgcccaaataagtcattgttgtcccaggtagtgccatgccaggggccatccagggagctgagggcccagtaaaaaggcacttaaactcaaatgcatggagaaggggacagccagggtgtgattagggaagacttcctgaaggaggtgctgctccgagaaggttgattgggtggtttttgtaggggttttcttgtttccactttttaaataactacttcatgccacatgctattaggtgcttttcacatacatcgtcatgtttaatttgtaccaacaaccctgtgagataggaaatagcttccgtatgttagcagtgagtaagctaaggatcagagaggggaggttgcttggacaactggcttagccatgattagaactccaataggttcttaaatgatgatagaaaaggtgtaggaggatgggagccgaggctggcatacctggcagaagaaacagtgtacgcacgcgtatgtcggtggggcactgtggtgtggagggctgcagggcttggtagcactggagtgagcagaggcgagcctgaaagctggcggcagggacctcaggggccatgacaggtatgtgagtcaagggagtgatgtggtcccgctacaaatcactgggggcttcagcccctaatgggacctcctctagctgcacccccctccctgcctgtgccctttttggcacctggtggcaggcacacctcaaagaactgctgcatctgttcctgcttctgacctcaggagacagcagcagggctggcatggagcatcagggaaatgcacaacaacacatcagcccctgggggcctcctggatctccccacgaatcctgcaatacccttcacaaccatccccgtccagaaagaggctgaatggcggccagcatctgcccgtcagcagagagttcccgctcttagcaccagctcgcctgagctgcctccagggacagtcctgcccgcctccccagagagccagtgcttccgctgccgcctaatagctctcccggctggagacgactcttgatatttagcctgcgtggcaggagccttaatagcagcaactctccctccctgctcctgcctcctgagccccagagacagctctgctcacctcctagccggcatcctccacgcactgcctaggcatcaggcggaggtctttctgcccactcttggtaacatcaaggaatgaatgagcatccaggagcacttcgagtgtgctattttctcctctgagattcagagatgccctttgagaggctattagcatggccacaatttaaatatgaggaaactgaaattcagagaggggatgtgatggagatggctcactttcgcttcatcttccccccctcttggtaccaggaagtggaccatgctccttcaggcctcaggatctttgcctctgctggtctttcttgcctggaactctctctcctccttctctctcatagatctcatctcagagaagccttcctgccctggtttatttactaaggttggtccttcttgccatactgtaagctccatgaaagtggggagttcccctaccttctgttgctcccctctgtatccccagcacccagcatagggcatgtagctccactagggcctcattaagtatttattgaatgagcaaatgagtgaatggataagcacatgcctgtactagttagggtaagatcagctgcagcaacaaaccaacctagcatttctagatggaggtttgtatttccggaggatggtgagtatttctggtgggtggaggtttcctccacatggcaatgtggccggggcatggtctgcatcaagctggcttagtgtggagggtccaccctggaaggagatatcacttgcattcacattccattggctggagcacagtcatgtgaccatgcccagctgcaaggaaggctgggaaatgtagtccagctgtggctccaaggacggagaacaggttttcgtgactccaaatcttcccataggttgctgtattggtctctctaatcagcagagccaaccgttaccgagtccttgtcactataccctgttgtaagcccttttctcaaattagtccattttattcttacaacagccctacaggagggtattataattagcccagtttactgatgagcaggcaggggctcaaatgacatgttaaggggaaaatacccattagaaacatgatgggccgggcacggtggctcatgcctgtaatcccagcactttgggaggccgaggcgggtggatcacctgaggtcgagagtttgagaccagcctaaccaacatggagaaaccttgtctctactaaaaatacaaaattagccgggcatggtggtgcgtgcctgtaatcccagcaacttgggaggctgaggcaggagaatcgcttgaacctgggaggcggaggtgagctgagattgcaccattgtactccgtctcaaaaaaaaaaaaaaaaaaaaaaaagaaaagaaacacatgatgggtgtctggagatgcagcagccaaaggctgagaccctcacccctgactccaccaaacattacagatattcaaatagacaggccagtgtccagaagaaatttatgcgggctgagccacagttgctggcctttgttttctctggttttgtgcttgtccaagggtggggaggtggttgagtacatctctctgagggtctgggccagggctcagcacttcatcatttcagctgtccatatttggagggcatctgtttccttccgccttccacagaggaggaagatgggtacacatgtggctagtaaccattagccgtcgacttccggttttgtctttctggctctttatgattgacaagtgctggcatgttggcctttctgccccttagcagccctccatgcaggaaagcgggagggaggggtgtgtggccagtgctaggatggggtctgtatggaagagtagctccaggaagtggagcctcatcaaggcaggtagcccacgcttcccgaggaggtgacatttggtcgggctttgaaggctaaggtgggagtctgtcagactgaaaaggaaaggcatgccaggcagaggggcctgtgcaaaggctaagagagcctggcttctcggctcctgtgtctgctttgcccctagagcttgcccagaacagtgacctaagtctgagatccttccgacccacactgcagagggaatgtctcctaaaactactgtttatctcacctcaagctggtgttttccccttgtccgtagagaaggaaagggtagcaaaaaaagaaggaaggtgaggagggaaagtgaacagagagcgactggactgagcacctgctggcttgctctgctgtgtcactgccataactcttccctagctatgcaccgtggccccttgctctcctgcgggcacactactgccttgggcctttgcacgcactggccgcctgtcctgcctgcagtgctcttcctggagagccacagggccgattcctccttctccttagagtcttctctcaaattacctctcttgatgaggcctgccagaccaccttatttaaaactacgaacctagtacccgttccccttagcgaatgtttcccccagagcactcagtcgcggtgtaacgccctgtacaatttactgatttatgttgctgcttattggctgcctcccttccgtgcgtctccccaactcctcccatagaagccaccaagggcagagtttttttttattttttgtttttttaatctcttatagtggtggatctcaagcacccgaacatagtaggcactcaataaatgtttgttgaagtatgagtgaattcagccctgggcaaaacgtgaccccatttcacagactaggaagtggaggcccagggtcttgcagccctgtggggagagggctgcccagcgccccgcaggagcctcccgcccggcatacccacgggccagtgccgggactgggcgcggggcggcgcgcgggcgcaggtagccatggtgacagcgccccagactactcgtatttcctgccttttgtgttcgcacatgccccagcccccagcccgggcagacgcccctgattggccgtcacactgcggaggggcggggcggggtgagcggaaaggggcggggctgacctgtgggcggggcccccggggcgaggctggtcttgtactggcgcgcgctgcctgtgattaacaggcgggcgcggccgcgcgcggctggaaaggggcggggcttccggaacagccgccccgggagcctgggataggggtgagtgctccttgatggcggccccgaacaaaggacgcctccagacccgggcttcctgtccgtagtttttcttggcccttggagtctgagagtgagaggcctgctaggccagcgccccctaatcctcatccggccgtgggtggccaggcactgcagacgtgtccccgggggccgaccaccttacttgccacgctggcccctccctctcctcaccaccacagggcctttgcacgtcattcctggacactcttaaagtccttctttccggccgattcctcaccccctcaggaggctctccacacagaccgtgacctgccctgcctggcactcctctgcccagcgtttatatctctttttgtgcactctccgccctcatcacacgtgtgcctcagggcagggccctgtctgtggcctggcacacagtaggtgctcggtttgtgttgttgaatgcctccattcatcaggttgcctgaggcttccttggtgggtggtgccggctgtactggcccgggacttgggaggaagggagacagatgtgccttcagacccagacacagaagagtttgtctccaaagccagggcactgggtcagtgtctggcctggaccccaggcccgaggagcctggtttggtgtgtgcccttggtgaatggcctactgtgctggccagacaggagccccaggggctggccctgcctcaggaggaaggcagggtcacagacacaggctggaggggcctggagtgagggctgctcaggacccctgccgaccagacctgggagccccagcatctgactcttcgtttgtgtattacttgctgtgccttgtcctggcttgacagggttggagtgggggttggagtggtagagcagcgagaaaatctccacaccccttacccccatggcactcccacaaaacaaaagggagctaaactcatgaaatcggcttcacggttatacatggatagccttttgggagttgggtgatctctggggtatatacattgtttcctcaccaacaccaaaagaaaatgcaatttgagccaagctaataacaatgtattaaatcagagcttcctgagctttgctgggtgctataaaccaccccgaagtttgtactaggagcagattcctgggctcaggccaccctcaaatcacagattttaaggggtggggctcaggaatgcccttttattcaaactgcctgtgtgtggttttgatactcagtcttaagtccatcatttgagaaatggaatgacagatatctgtgtctcagaacacatttgaactcctctccaggctctagaaagtctaccgttctctgccccagaccctggctccagattcaagtctagactggaggaactgtggatcctttgggatttggaaaaaagttctagaccctcttcagaaaaatgtgcttgtccacacacacttcaactttgcattggatctcaaggtctcatacctgggctgggtggtctgtaaagcaggggagacctatttggggaaaggcctccatgctgacactcacctgaacctagggccaaagtgtatggttgtacaagttgtacattgtacaaggatccctggaagaaatcgagccactggccagctgtgcagcctggcacctggggtgtcttcctgttttgtacaaaggcattttatgccattcgcctaacccaatcttttttttttttttttttttttttttttttgagacagagtttcgctcttgctgcccaggctagagtgcaatggcgcgatctcggctcaccgcaacctccgcctcctgggttcaagcagttctcctgcctcagccccccgggttcaagcaactctcctgcctcagcctcccgagtagctgggattacaggcatgcgccaccacacctggctaattttgtatttttagtagagacggggtttctccatgttggtcaggctggtctctatctcccgacttcgggtgatccgcctgcctcggcctcccaaagtgctgggattataggcatgagccactgcgcccagcctccctaacctgatctttaattcccctcctgcctcccatgacaactcaagttagtggcactagtaaagttacagaaattatgtgccttagccatgggaaaccggccctctgtaaactgttattaaagccataacaaataatatccgacagcctgtacctactagtgttcagttcctggtactccagagccctaagcgtttttgggcagtggttggggggctgccaccaggcctcaacttgggttaggaagatagggcaagggtgcaaggcccgtctctgcacagagggtgggagagaggagtaactacatagtaggtgcttggtaagcactttcccagtctacattcattgggtccattttatagatcaggaaaactgaggctctgagagggctggtaatttggattagagaaggcccacctgtctggagcggctttatgaacacaggctttggagtgcgacagcggggaggtcaggagaggagaggaaatagccatagctgtacccccacaacattcacaccatgcctccccctgaaggctttgcctgacgtttggactgtttagagggctcctctgagctcccacagcctgagccttcctgtcacggtgctgccaccctggtttagcaggcctgtttacacactgtcaccccaagagcctggcagcaccccagtgctggactgtgagccctccacacagggcccagcgcatggtgtgtaatacagctctatggaatgctgagtggctgattaagtgggctctagcttctggcagctttgctccctgggtggatggggcgggagtgatgcagaaaggagaggtgtaggcctagagttaggagggcagggagagcactgggcactggaaccacttggcagggtgagttggcattccctgtttgccacgaccttggggtcaccctcaccaacttgccccagctgggcctgactgaagggcagggggcctggacattggagcccagggagggcagagggtggtagactcaggagagagctctttgtttgggggcatttctccagcagagacccttagtccctccaaggagcatgtcctcctccatcagtcagtgtcctagccagcaggggtgcgtccccccagatccttccctgcttatcctatcctgggcccagccatgctttctcccatggggtcatgtcatcctgaccctcagatttggctgggtcgccccagggctctctgacaaagcccagctcctcccctggcacccagcatccctcagacccggcctacaccctgtcaagcccgccttctcttcaccccaaggcctgccgtgcctcacagcttgggcagggctgtaccctctgcacacatcacccttccctatccccaaccctctccctttagtgataaatccagctggccgctctttgcagctcaccagggaccagtgtccccagtgcggccctcggtgcacccagtccttacgtgagccctagccaccatggaaagccaggagggcctggccagcctccatgtggggtctggttggttattgcagggcctgttgggactgcctgtgtccctgttcccctgggacaggagttctggagcctgcgaaacttaagcatccatcatgggacctggcacgggggtgcctggccacagcaggagtgaatgaattttttttttttttttggagacagagttttgctcttgttgcccaggctggagtgcaatggtgtgatctcggctcaccgcaacctctgcctcccaggttcaagtgattctcctgcctcagcctcccaggttgctgggattacaggtgcctgccaccatgcctggctaattttgtatttttattagagacagggtttctccatgttggtcaggctggtctggacctcctgacctcaggtgatccacctgcctctgcctcccaaagtgctgggattacaggtgtgagcactgcacctggcatgaatgaatttttttatttttggaaactcctttgaaatagtgtgtttgctttccactgtcttgttcttcacctttacctcccttacgtataaaggtagatgcagtcaagtaaagtgtgctagcttcaaatcagaaaatctccatagagtcttccgcaaatccttgagcgcctactacgtgctaatctgtcccaggtgctcaggacacagtgtgaacaaaatagaccaaaaatcctcttagtgaagcagacgcttgagtcgggggcactggagaaagcaaatcagttcgtcggtaacgaggcagggaagtggacggggaggaagaggggcttctgtgaaggtgtgcttggccaggcctcaggcttcccacctgttcactggggtgatgtgcttgcccggtgggaacggtattctgttcatgactgttgccattgttattaaccgcatgcccattgcctttcagagtttgtgggccctctcgggcagcccccagagggtgctgaatgccgggccctgtgtacacttcaccctatctccgcggggtcaggctggccacctccatttacagaggagcagatggaggcccagggagggatagggtggtgtcacatgcttggagcggggtccagggagagctcttggctccctgaggcagggagaccctgagcccagacacaccccagtttataagtggggacagctgtggaggtgttgggtgctcagccctgggcctggcttctctggcctgaagacggcagctcatctggctgcagagtcaggaaagatttcctgagcctggactgagaggccaaggtgggtttgcggaggcaggagagagctccagatcaggaggcagtgtgggccaagccggggggcggcaggatgtgagcacagagagggcagcaacccttctacagaccagttcaattccagtaaccccagcctgccgtaggggtgggggacagcctggctgcagcggggcccacctgccagtgtgtgccttgcctgcgctccaccttccccctcgggcactgcggctttcttgggacagcaggaccccagttaaacagccctgtttcctgcccagccgtggctgccgcctcttctcggaggatttttttttcccacaactcaacaaccactaccacttgcagctaagcagaagggaagttaggactcgcattttgcctctgtagcgcctgtaatcagccccacacagcccccgccgcaggcgcccatcagtgccacttccggagactacttgagatacacctgctcacgctaaaaggagaagcagtaatccatcaaaacaaccccaggcgccggggcgggagaggctgagactcagtttcccctcccatggaacagggcagtgttgggcatctgaagtccccacgggtcctggcattctggaagaacacgactcagtagctttccccttctgggcctcggtttccctgtctgccaaaggtgcagggagatgagctcccagctcatgcctctgggcctcctacctcgcccccaccctcatctctccctttccagagacattataaatcaaacggcttagaacgtaaggcatcagaaattctgaaaccttcatctattattaacgctgacagtaaattccccctccgagcgttttacatagcaactgttaccaagactcggtggtggagctgctgctccagcggccgcatcccagcagctccgggcaggatggcagggccgccacaagccctaccaacccggccaccacctgggcactcagcaaaccctctccaggggatgggcggggagggagcctttggcagaggaaatgggtggcttacagctgaaaggaggtcccagctgcttttggtgagccctgaagaccccagctcctgcctaggtgaagacaaggggccctgaagctcccaggccttcagaggcagcacctatggacagggacgggctccgggagcctcccttccttgctgccctggttagaggaagcttgtgagatggaggacaggaaaaggcttcgtaaactggaaagggctgtgcagatgttgtttaccgactcacccacctgtcagctagacgttcctgagtgcctgtttctctgcaggcagtatctgggcaccagagatttaaaacaaagacaaaaggcccaatccctgtcgcatctggcttggtaggagacagacgcgccaacccctaattgcagttgtgcaatgatcaacgtatgtacgaggagcatactcagggcggtgaggatatcgcagagggcccttcacgggggctgatgctgggcagggttttgaaggatgaacaggggagggtctgtgtgttctggacagagggactggtgtatgcaaaggcccaggggtatgaagctgcccagctgacaggtggattacaggctgacctgttttggtggggaggggggctggtagagggagcaggggtcagagggtgcaggaccttgaatgcaagcaagagagtttttacttagaggttctggtcgccatggaaggttttcagctgaggaggaacaaagatttgggtttggggagtatcaccctaattgcgcagataaggataccaaggcctgcgcaggtgagaacacctgcccaggcaggaagcaggggaggctggctgctctctgcaagctgttaagatgcacctgctgtatgtccatccccacatggggaagggtggtgtgacctcagaccctgggacagcatgcctagagaagaagaagcgggcagggagcttgtgggctcttgccaggtcagagtggccaactacgaggagttgtctcactctttgcatctccagaaatcaggacacaagttgagacacagacttcagcccagctatggatgcgtccgttggcagtctctccacctagtgacaaataatatatatgttcattgcagaacattcagcaaatagaagtctcaagaaaataatgtttccctgcagtctcaccccaccacccccaccctctgatggccaggtcacattttgggcccagttgctccagaaccaggtacagatacacattttttaaaacagaagttgcatcatgttctttctgcataccctcagtgacctgcttttcgcccttcatacgctggaatagttccccatgtctgcacatatttcggggtgaggtttgccaagagccacgctagccagaggggacccagctgacctagaatgttcggtgcttgtcttcaagggcagaggccgtgcctggcctgcccactgctgcactcagcaccaagcatggagacaggcccccagtggatgctgaatgcagagctgtgaaaagaagtggaagctgtgtccgtgaagctgagtacaagttggacagagcccactaggatgctgtaatcttgatctggggctaaattgagtcttggggtaagatttgtgcttattaagggctctggatgcttggggtaatagatggaagtttttcagggagggcttcctggaggagatgggctgtagaataaagcagaagggaaataaatgcataactgtccattcactcatctaacagacatccccagagggctccctcctggtcagagccctgtgctggacaggactaggcacccagacagagtactgcccccacctgctgccagccctgggggaaagacagacaagtgcccaggtcactgtggctgtgtgctcgagcagtgctgtaatggtggaagggtagacagtgaggggccaactttactgatagcccccactttactgatatcccccacctcctagccaaagaagttggggattgatttatgggagggagcagtttggcatcaaggtgtgcctgtagatgatggacttagagggctcaggagggaagcccatacatcctgcatactcgggatgggcttggcatcagggtcaaggtcacccagactgtacccagaagtttggctcagcccagtgtccctggcctgggaactcctggatgccgagggtttatggcagctcagttagtggcctagccctgggtccccgccatggagaggggcccctgacgtccaacgtccactcccagagtcccacaccaaggaggcccccagccccacccagaagtcaaagggtgtatctttccagagtctagaagctggagctgctgtggggcctgggccttggtctcctcggctgtcaaatggtggcaccaccctgcagggaacgtgtggagctaaaataaaatgtgttccaggtgctggtgccacagggcttagggccacactgcagaaaacccttcctcctgcttggtcctagctgcccagggccaggccaagaaaggcttcaggaagaagcccccacctcctagccaaagaagttggggattgatttatgggagggagaagtttggcatcaaggcgtgcctataggtgatgggcgtagagggctcaggagggaagccccgcagattacccccttgccaagaacctcctagaactgcatactcaggggataggcagctcattcacagtgaaagtgttttggagtcaaacagacctgggttcaagccccagctcattcacttcccagctgtgtgaccttaggctagttccttgtcctctctgtgctcagagtcctcatctttacagtggaaatgataatgatagaccagtattgtcctgagggttgaaagaggcgacccatatgtgagtgcctcagcacagggactggcacatagtaagtgcttggcaaatgaaaatggttcttctaaggctttttttttttttttaactagtgcccaaggaagtgggggtggcagattcctcactggtctcttaggttcctggcacacatgcagccaccagattgagcctctggaatcgtaccaatccatttaccagcccacgtcattagctttttctgagcacctactctgtgccaggcacaggggcaccatggtggaactggaagcagcaggctcgctgggaggctgacagctgtggatcctgacctgtggagtggccagtgccccgggggatggtggaaggggaagagggtatctagggcaggcatcagttggaaagtcacagtgagatttgagaggaggtgatccctgaactagtgacaaggcctactagcattttgccaggcaaactaggagcaggtggaaaggttgggaggcacaaaaggttgggagactcccagagggtgccagtagctccttgtaagtcattgttgctgggcatgaaatttgggagctggggaggtgggtgggaatcccctgtgaatgccaggccaaggaggcagggacagtgtctgattggtgactggggcctgggcagcatctgagcagggaacacagttgagtgggagaaaggtggtggtcactgaggagcgagggcaggtggggggatggaaaggtctcaggacagggggcccagcagggagggaggcatgggagggaggtctcagggcatccaagggacttttggttgaaccagaagttcctgagtgtgagcgcggcccagaaacagccacaggcctcatccctgcactgggctcgaggctggagtgccaccagcagctacccatccattgggcatgcgtgtgtctgctgtatgccctgacaagacagatggactctgccctcacggagcttaccagtgcagagagaaaagagagtgaataaatatacgagggaggtgattttggagagtggtaagagctagggactaggggagttcccttaggcagggcagtcagggagggcttctcagatgaggtgactgggctcattggagaagacccaggaggatggcgtcccaggcggagggaacagcatgtgcaaaggcctgggggtcaggggcatggcatgtgtgaggagccagtgggagccagtgtggttggagtgtgcatgggagcggggtgggaaatgaagctggggaggagtacccctaaccttagacagctaagaggttcaaatttagttgagggaaagttctgactctacccccagcagcaagggagcttccccaccaaagcaggagatctggctctcagcattcactttactttcctgtgtgaccttgagcaagtggcccaccctctctgggcttccagagtctgtggcaacacagaggaaagtgaggtgcttgctcagagactcgccagctgtgactggccaggggtttgatcccagtcatttctgctctgtggtgggggacttgtcgggaggggcaggtagaggtgagctcagtagaaccaagagcccccaggacacagggcatccaggaggcctgtgcttccacagcctgttcactccttcatgcacccgcctccccctccccactgcactcctgcccacactgcccactccccaaccccctcctctctctagggctgaaagcaagaggctcccatgggggctggcccgatgattggcagagtcgataaaggccacttggaaaccctcctgctccaggtggttccccgctggcatttgtagctgggattccgaggccagagctgaacccagagatcatttatcacacagcctcaaatggaggcttttctggaaaaaaaaaaaaaaagttctttctctgagattccaacttgcattgtctaaaacaggttaattggcaacaccgtttcccccagatccttccctgcatccccccgctttcctggggtgggaatggcagcccctggaagtagagaagggggacaggtttaagacacgccgcattttcagagcttgctagccatgtggagactgccagaggaatcctagagatccacccagtgaccacggctgctgggctgcacttagctttgtgatccagaccgggagctgcctgtgaagtccctccccaaggagctggaggtcaggagcctgtgtgtctcactcccttccttgcttgttcctatgggaaatgacaattgaccactgatacacgcccgccctcaaggagctgctggcagcagcaagaggggtgagctgtgctggggcagagggggcaccgagggaccctgggagccaaaagacggggccagcccactctgccggagtggccaaggagcaaaagcagtctgcctggaaggcaggcagggagaagtgtgctgggcacaggtacgggggcccaggtcataaaagaacctggtgcatttgaaaagctgtgagatcccagcatgcctggagtgtagaatccacgggactcatagtcagaatgtttctgtttcacaaagccagagaggttgggagggtccaggccacaaaaagcctagaatgcctggttgtactcctcaagataggctgggcgtgctgcataacaaatatccccaaatatcagccccttcaaacagggtttgaccctcactcatgccaggtctctgaccagacagctgggaaactgctcactgatgtcactcaggacctgggcagacagaacaacagccattagggctattttcgtggcacagagggagagagacaggtgtacagatgcatggagcttcctaaagcagcatgtggcacttccacttgaatttcactgcaaagtgggccacatggccatcctccggacatctttatgggctagtgacacgcttgctgcctttggctgaggaggacaggaaatatttggtggtggtgccgacactgaccacaaagaccaagaaggttcagcactttaccctgagcaaggtgaggagccttgggagggattgagtagagtaggctgcagcctcatttagttttactttttaactttttattgacttgcatacagagaagagcacgaatcataggtggacagctgatgaatttctgcaaaccaaacacactcgggtataactgaagttcagatcaagaaaaagaacatcaccagcccccagatgtcccttatccccctcatcaggcatttcctgcccaagagtacttttgtctgcctttgagtttcacagacatgaaaccttttctgtccaacttcttttcctcttttttttttttttttttgagacaaaatcttgctctgtcacccaggctggagtgcagtggtgcgatctcgcctcactacaacctccgtctcccgagttcaagcaattctcgtgcctcggcctcacaagtagctgggattacaggtgcctgccaccacgcctaactaatttttgtatttttagggttttgccatgttggccaggctggtcctgaactcctggcctcaagatatctgcttacctcggcctcccaagtagctgggattacaggtgcctgccaccacgcctaactaatttttgtatttttagggttttgccatgttggccaggctggtcctgaactcctggcctcaagctatctgcttacctcggcctcccaaagtgctgggattataggcatgagccaccgcgcctggcctcctcttcttttactatttatgagacctatctgtgctgtgtgtggcagtggtttttcattattgtgtagtattctattgtgtgcatatgccacagcttatttctccctcctacttttgatgaacacttggattgtttataatcggaggatcttcggtggcttgcgcctgtattcccagcactttgggaggctgagacgggaggagagtttgagaccagcccaggcaacatagcaagacctcatctctcaaacatttttttgaaaactaaaatagttggaggatcttgtgaatatacctgccgtgaacattctccaacacattgtttggttcctgtatgtggagttcccattcaatgtgtgccttggaagtggaactgccatggtctcatttgcatttaagaagcctctactggacacacagaagagaccgaggtacagtccaggcaggaggtggaggggaaggtatgtgggcccagccctagggctcctccacctcagaatccagaaacatccccagcgtggacttgtcttccaggcgacttgggggtctgtattgtacacacaagatgaaaatcgtgtaaagcaaggcccagacacatgaggctgagtgtgcagccccaaacggcaagacgtaggccttactgtgtgagtcacacggtggtgttatagcacattctagtacacaggcaagaatagttgtataatatttgaatgcactgaactcacttccaccaggtacacgtgtgaggaatctccctgcaagtcacccgtttcacaagagggaagacggcccatcttttaagtcaggggaggggaccacttgccctggggcctcgggctggggttcagcctgcctctgttccccactcttggacacacaggatgaagggccccagtgctgatcgctcacaggggtggtaagacttaccctgttaccctcttggggtgtggcatttcttagaagccaagcatgggtaatcctttgcctggaatgaagccaggagaatggtggggcttcaggctctggttctagaagacagggcttcttgggagctgcccctggagcctcccagcctgagcggtaggtgctggagctggtgcctttgaacttggattcatcacagggaagacctggggtccaggcctggttccgaggtgcccaggccagcccctgagcagccaggcggccttcttgtgaactcacattgtagtgtcccgtgcagctgtcctggtcctgcaggatgcattccccacccccaagcccttaagggctgttgggttttgtttttaagaaacatatggcctagttgttactttggctggcctccccaagcctcatgtctctgagacccccactcctaaggaagggggccaggcattgatgggggtgtctgggaagccgagggaggatgcctgccagttatgagaaagatgcatctttgtcgcagacacatgtggggcgctctatgtaaattgtttcagcgcctaacaggaagaagaaaaatgaggctttgatgcgagccaccacctctcagccaggcgtggtgtcactcaggcgcgtccgaggcctgcttctattaaggagctgtaagctcttctcaggccagagacccagggtgctctctgggcaggaggtggctctgctctgtctgccgaactctgggcgtcagcactggggcgtgctggggcctcaacccagccccacctccaaggcaggcggagagcactgctgatggattccccagcactgcactgtgcgaggcccagggcggggaccccagcaggcagcgtggtagggtttgctggggatgacaggcaggcgcacaggcggcggcactgttaggccccatgtgatggccacagcctggcacaggaatcggtgctccaggcagcagacagcaaaggtgtggaggcaggaaaggagccactgtctctgaggcctgggagagcactgcgggtgctggagatagatggtggcaggggccagctcaggggagggcaggaatctggtcttgtggctttggaagcccatgggttgcgagcaggagagggtggggtggtgtgagtctgagggaggtctcagatgggaggggagggcggagtggggcagggaccagtgagggccagagtggagactgggcaggagggcatagcacacacatggacatgcttcccaatgagccctggcccagtcaactcccagctccaggaaccccccacagccctttgctggggtgcacaccgtccagagcactgacttccccaacgagccaggtggaaatgtcccagggaggaccccggggcctgaggagcctactgaatcctcaacaaagaagggaagagaggcctaggccacagcaggcccagaattattgtgttatgctctggatcttggggaatgtgtaatccccacaccgtatctatggcaactctccattaaccagaatttggttctacaaattcctgttcccattcattctagaaaactcagagctgttggtctttttaaaaaaactcgctgaaaaaaaaaaaaagatactaaagaatgtaaagaagaaaatgaagtcagctccagcccctctgctgagaacacactgatgttagtactttcgtgcatttccacccagtttgtttaagaaaattgggattgtgttgaatgcctgcttttgcatcctgccttttccattgtgcttcagatcatgagcatttggcaggtcagaaaaaaaatgtctttggaagctgggctgtggggactggggtttggaaggcttgctgtgtgctgtgatccttcaggggtcatcgccctccctaagcctcagcctttgcctctctgcagggagagactgaaggacatttctcaggctcccgccaagagtctcagtgttttccttgcaatggtggccttgttattccagccttgctactcacaggtgggcctggtgatgtttgtggcagggtgggcacagggctggcactgccaccaagtacgtagttgagccggtaagctcagaaacgtgggctcactccagccttgagcactttcccatctcgtgatcctgggcaaatgactttgcctctctgaacccctatctcttaagctccagaaccgggtggttgtgatggttcattggcttaatgtaagtggaactcttagcatataataagtgctcagtaaagaggaactgttgctaccctgaggattgctggtatctgtgatgtcacaggtgtaatatgaggattaaatcatgaccttcttgcagcattcagcagaatgcctgggacgtaggggacactgtcagggggtggcacctggtcccatggtctagccaggactatctttgtggcccttaacttgtgcagctgcccagggctggcgctcagaaatggcctgtgcttggtgcatgctgctctgctgttgctatcttgagtttttattactttgtgagcaagaggccctacattttcattttgcactgagccccacaaattctgaggccactcttaacaagaggattaatccctagggcagactggcagggcaccccacacatccacggtgctcaatagctatttggagggtgaaggcaggactgaatgggccttggttcagaggagaacagtaccccagcgaggccaggtggcttgcccagtttacacgccagacatagggccaggcagtgctctgaccatcacgtgaggggctgtcagggcgacggtgtgtctgtcaagggcaggaagtgggctgtgtggagtgccagccaggatgggcagggtagcctgcgccctgctgacctgcagccagacacactggggagacacaagacgactcaggttggaatcgattgaaaccaagccaagagcttgggccttggagtgcatgggagggggaggaggttcagacccaaggtggcggctgcggctggtgttagcacttcttcccggcagggtgggcagggccccattaggggaggcaggcctggatgccccccagcaccctttcatgagggggagagaggagaggagcaaggcccaggccacctggtattcagaaggctgaagtgacagtgtcaggcagtttggggggcagatgaagccgtggcaaagggtggccaggaggccagagcagcactcacagatgaggtgggattggggccacctgcatgtgtggggaaggagcccccaggactcggtgtgtgggcctctggctgacaaaggccactctgcagaaaggaaattagaaagaagaaatgatttcttggctcatgtcttcacgaacaagggagaaagttgctggcgtggtctcctcacagaagagccagggtatctgaggggagccctttctctgccagctgggtcaccctcagggctggaggtgctggatgccagagtagaagtggatggatgggggtgtccccccaaaaggagagggagacaaggtgaggctgtgccttttaagccttctgcgcaggcctccttgggacagcccgggtcggatctcagactgcagcatgtggggctgggagccagctcccccgaggcacgggggctcaagaggtctgagcagcatgctgaggtcagggctggaggagcagaaagtagtagggagccactgatggcgtcataatgaaggagcgacatgacaagcttgtgaggggccacacagggcagaggctagggacgaggagatcccgctggcagctgggcatggaatttctggtgggtagtgaaacagccagacctaggacctgtggcagtgaggatggggagggggccagatgggcacacttcaggcaggggaaccccaggacttgggggcctcctcagagaggccttacagaaggactggggcagcaagcaaggcctgtggggcgaggaggcctaaggacaccatggatgcactggagccaagccattaaggaccctgcaccccggccagaggcctcactcaggatggctgcagtggagactgaagagatgggtcgggtggagggaaatgggctttgccctcaggaggtggttgtgggaggagatgcggtcacccgggaagagaggccagaggatgggaccgaggagcagcgacacgggaggacggcagggcgggtgagcgggggggccctgcccagggtgacagggctttgctgggccctccaggaccctaggcagggtctcccctggaaccaggcggtacaaggcctgtgatgggaggggcgggaggatgagggattgctggcaggagggcctgggaccagaagtctccactgcagccatcctgagtgaggcctctggccggggtgcaggatccttgtctacctgcggggtagggagacagcctgtctcccaaagggcggtggggtggctgagcctcaaggacaaaggcaggcgggggcaggggaaggagcctgtggctgggagcttaatggccccgaaaaaaaaacataaaaccagagaattatggggagacataaacagagctgtcaggcattagctgcagggagacggctcagcctgggtaagagatgctggcggctgagctgggatccttgcgtgtgcataaaaaagacagaagttataaaaggagggagattaagaagatactgcctcttccatgattgggctccccggccaattcctttctcacgccccggctgaggccccagtcgcacactgaccctaggggcctggcctgcgaggcctggccaggtcaggggccagggcctgccagcggccagggaggtccatgggggtgggtgggggtgggtagcgacttggcccaagctagtggaggggccggggagccaggcccaaggacgcaggcggcgccagccccagcaatttatgggtgctcacacaccctgccgtcttcattttccccgttgctgctgctgtcattagccaagcactaatgggcttaaatttcaccttaaaccatccccactgtcctcagcagatgacaaacgccctactctcgccggctgcaaagctgctgggcggcctccaagcaggcatgtgccctccctctgcccgtgtcctctggccctcaataaggaggctcctaaggacccagggcctgggatactcacaggccgggagaattcctgggggtgtctgggagcccaaggaagggcagggctcaggaaagggggcttcagggggatctttggagaccctgggatgataatggatggggagacaggagcccagggtccaggggcaccccactgtttggccttggcagggccatgcccctgaccctgcccaggtgtcatgaagaagggccctaggagctacccgccatgtttttaaaagccttagggaaatcatattttgcttaggctaacaaaaatagcagtggctttgcttggggttagaattccatccatccatccatccatccatcaaattcgttcactcattcattcagcaaatgtggcccatgagcccctggcctgagcaggtccatgaaaggcccgactagctgttcatttgaggcccatgagagggaacaagtgggtgatctctaaatgcagttcgtttgggagacaaaatcctttagcagtggctctgaggatgggaggggaagtgaccaaggggctctagaggctgtggggacagagtgcatcaacctggggtgcatccagtccatgaggcgggtgtttgcccgaaaaggagacaggaatagagatggagctatggcagagatgcagggattgctgggggctccctgctcatgtgtgcacatagccatggccaccgcctcccgcctttgtttcccagcaaggggcaggtgcccgaggagctgctggggttgatccaccatcaaagccggcctgtcgggggctggtatgcagagtcatccctttcccatgggaatctcgctcccttccaagcccccagcacccgcctttcatccctgtgctgagagccagtactcccactgacacccaaacagtgatgccaaggaggcactgccagagggaggccaccaccatacaggcctggaatgtcacactctctgtccccaccaccccccacctgcagtgagcctaggggaaagaacaggctggcacaggcattaactggagatggagggtggtgcatggctctgggccaccatgctgtgtgtccccttgtcctctctgggcctcagacatgcaatctgtcacctaagggtattgaccctgccaggctctggcacaccaggaaatgtaagccagactcaagggttggcaatatgtacgggaggttgggtgaggcatcttctccagtccaggaggaagggattcctaactggtgcttaggaccatggactttggagaaatctattcctccccaccagtatctagaattggctgtggagtcctgccaatgctctgttcctgacatttctagaatttctccctgcatttccagcccctgccaccactttggtctggccccattattgctctctgggggacagtcccagcttcctgttcactggcctcctggcctcccctctcacccccatcaccaatccatcctgcctcactgcagccactgcagactccccaacacacatgtgtgatgctcactgttgctcactctctggggctccccgtggccctcaccacaacatctgtgctctccactgtggcccagagggccacacaccacgtggaccctgcccatctctcatttcttgcctctcacttccactcgagagccagcctgcattctcactactatctctcactctctcctgccttccaggcttttcctctttcccttgctaactccggcacatcccctaggtctcaggtgaagtgtcactcccctgggaagcccctctgccctcctgttcccactcaggtatgacgtagggccctttcccatgcgctggcacttacttgccttctccacgaggctctgagcccacagctgtctctgggtgctcagtctctagcaggtgtatggcatacagtaagcacttagtaactgcttctgagatggacagatgggtatgtgcaagggtggatgggcaggtgggtatgtgtgcatggatgcatggatagaaagaaggtaggctggtgagtggatggatgggtgggtgattgtgaggtatacaggtgagtgagtggatgggtggatggatagatgggtgtgtgtgcatggatgcatggatagactgatgggtgggtgggtgggtggatggatggatggatggatgggtgggtgggtaggtgaataatagatgggtggactgttgtgtgggtggatggagaggccaggtggtctatgaggtgagtccagaggcattagaaaatggagttctaagcctttggctttccatgggccccaatttctctgtctgtaaaatggtcagctcagctcctgtgcccagcgtggaggctcaggatgagctggagagaaggtggaggcttcagcaggcagcacatcaggcgctccacagacagtgcatgggacagaacaaggttgcttggcgtccctgcagcccaagggctcccttcttcagggggacaccgatgccctcctccatccctgcttgctcccaggatccttgcccaggtagcagactgggaaccagacccatagagttcaaatctaaacgttgctgctcaccaggaaattccctttgcctcctaggccttaatggcacatctataaaatgggggtgctcgtgtattcatgttctttgcagtttctctggggatcaaaacaatgtgacgaagggaggcagagagaaaaaatgcaatgtgacagggaagatggcacctctcctgatgcccagcacacagagggtacccaggaaatatggggcttagaatctcaacacctgaaagagcagcttctgctgcagcccctgccacaggcgccacactggccacagtgctccctcctagcccttcttcccctggccaaagctacctctggaaactgagttcgaagtttccaaaccttatcccagaccccatagccatgagttataataggcacataattaataatcacgtaattataatgtctatattatttataatttgtatatttatatataatttatttaactgcatctataatctataatttaaaattacatcaggtaagtaattacttacctactatagtgcttctgccacttacaagctgtgtgactttggataagtgccctaacctctctgtgcctctgctgcctcctctatgagttaaaatgtgtagactgcttctcagaacagggcccaacacatgtctggtaggtgtgggaattagccccgaggatgctgatgacaaagcatttctgtatctgttttgctcatgggttctttgctcaaccctgcaaggtgggcatttaatcactatccctattttatgggtgaggaagcggaagcccagcaagttggggtgactcacctgaggtcacacagcgagtcagcagtgggcgtcaggtactcggtgttctttccaaagactcctgaggccctggtctggaaaaagccagctctggaccaggccggaacacaggggcctttctgaaccttcctttcaggggcctggggccgcaggggcctccggcccgtcagccaagtcttttcctcccaacatgccagccagggaacacagacagccggaccccgctctggccactgccccgccaggcccctgtgccaggacagcgtgtccgcccacccgggcagtgaccagctgttcctgaggctgtgggctggagccaggtttctgtcacttcaaggagctcctgtcttcccggccgcacctccacagccagcaaggaccagtcagggattttcctgaactttccctctgttataaaagagtatataaacatttaccttttaaaagtaacagctaacttagttgcgccctcctctgcccagcattggtctggcagctgcatgtacgttgtctcctggcatctgcgcaccatcgtctgaggtgcataatcttgtgcctgtttgcagatgaggaaactgaggcacagggaacttgagttgcctgcccaagcccccacagcaaggcagtgtctgggtggggatttggacctagacagggagcctccctaccaatcaggccttcagggcagagtcttggggcccagaaaagcccagcccagcttctggttttaaattttataacgtgttcctttgttcagatgattgaaggaaagcatattgcaggtagaaatagaatgaaaacattgtaacacatgaaaccaggagtgcctttgtgtgcagctgacccttgaacaatgtgggggttagggacgctgacccccacacagctgaaaattcatgtgtaattttttttttttttttttttgagacagggtcttgctctattgcctgagttggagtgcggtggcacaatctctgctcactgcagcctggacctcccaggctcaggtgatcctcccagctcagcctcccaagtagctgagactacaggcatgcatcaccatgcccagctaatttttgtatttttagtagaaatggggtctcatcatgtcacccaggctagtcacaaactcctgggctcatgcagtctgcccgcctccacctcccaaagtgctggaattataggtgtgagccaccatgcctggcctcatgtgtaactttcgactccccagtcaattaacacacattttgcatgttatatgtattatttactgtagtcttacaatacagtaaactaaagaaaagaaaatgttattaaaatcctaaggaggagacaatcgaatctatttactagtcatgaagtaaaagcggatcatcgtgaaggtcttcatcctcgccgtctttgtattgagtagactggggccaggagaaagggagggtcttgctgtctcgggtggtggagggggaggcaggagaggcaggcacactcggtgtaaccttttgaaaaaactatcttgggatcttggctcagttattccgatgctgagtatgctaatcacatctaattttcattgattctgagaaaaacatccacatataagtagactgtgttgttcaagggtcagtcatacctggccctggcagcagcaggtccccacacagcttagcgcttgagccagtcctggctgctgcgtcccccaaagctgtgtacccactgaggaggacgcagcctgtacaggaattcaggtttggttctccttcccctcttgggggctgtttcctcatccgtaaaatgggaggctgatccctatcttgcgcattgcaggacgcaggggagctgactcctcttggcagctgggtcttgtcccatcctactgagggggaaactgaggtcaacccaccagcctagagtcaaacagctggaaagtggcagtgccagatttgagcctgaaaccaggttattttttcagtcaccttgcctagccattcatagaagtttttaaatcttttaggagttatcacatgctcatggtagaaaaattcaaatgcaatttcctttttatacaaatgttttgtacacacttttttttttgagacaaagtctcactctgttgcccaggctggagtccagtggcgcgatctcagcttactgcagcctccacctcctgagttccagcgattcttgtgcctcagcctcctgagtagctgggattacaggtgtgtatcaccatgcccagttaatttttgtatttttatacagatggagttccaccatgttggccatcctggcctcaagtgatcatcccaccttggcctcccaaagtgctgggattataggcatgagccaccgtgcctggctcactttttttttttttttttttttttttttgagagagggtcttgctctgtcgcccagactgtgcagtggtgcagtcacagctcactgcagcctgacttcatgggctcaagcaatcctcctacctcagcttcccaagtagctgggaccgcaggcaaacaccacctcacctgcctagttcattttttttcttgtagaggtaggatctccccatgttacccaggctggtctcaaactcctatgctcaagcaatcctcctgccttagcctcccaaagtgctggcattacagtgtgagccactgcacccggccctgtacacactttctacactgcactttttttcaccaacttgaagactgctccaattaatccatgtggtgcttccattctctgagtactcagccaatagaacctcccagatgtatctccctcatcccccttggatggacagctaggggatcccgtgttttgctgctgcaaaggacattgcagttggtagccttgtgcagatgacttcgggcccaggttagagggcacatgtaatttgcatttgggtccatattgccagaaagctctccaaagaggtagtaccattttaccctcccatccccaactagattgggcacctctttccccatgccctcaccagctaggcagatgctctgtgccaagaaaaccaaacagctgcttcccttacaaatactcaagggcctgggcatgtgtgggggcctgagtccagcctgcacccgttaccaactgcaagatctcaggcaataggcttcaccccgtggggctcagtttcctcatctgtaaaacagtggtgattggattatggtgagaagtttgtagatgcaaatgcctaggacagtgcctggaacatcgaggccccaggtcagaagtggctgttcttacgagtctgcatgagtcttgtaccccatgactgcagtcatggggatgggggcccagcccctaggatggatgctcaggcctcagacctgtgttttgggaagggatgaagggaagggaagagcaatgtggggaattaccaaggggaaagggtgggattagcttatcccagcttcccactgtgccagtggggaaactgaggcccagaggggcccaggccttgaagtgattgcaagttcagcagcatgaaactgctctttatccgtgcactgctgtcaggaacaaatgctgaatggagagtccggagggttgcccaggccactgcaggacccaagctctgagactgagggcttggggacacagagccagagccttgtcctgaaatcctggagggtgctccttggacaggacaaaacttgtattctctctctgagcccagcctcagcagaacccagagtcttccagggctgagatcttgccgtaccagctgcggtcacagacctgccacactggcttgacctgggagttccttacagctgcagaacccctgtcccacctgacccgctgcatcaaaatctgcgtctcaccaggatgtacactttaatgtttgaggagcactgagactcagccaggatgatactctacctgcctgcaggtacaggccgctgctctatgggcagacctcaaccctcagccccagaatgtcctccccagctctgtcgcagacatacgtggctccctgggaggcatagaaagtacaagacttggacctggctccccatgaactggtggccctggaagttgctaccttttattgagcccctgccagctaccaagcacattatcccatttcgtcccacaacagcactgaaagtttgctgtttaatttagagtatcttgcagcttaggcacacaaagcacagagaggttaagtaaactgcccaaggtcacccagcatatacatatgcaggagctgggatatgaatccagagctgaccccggcaccagagtctagccatttacaatcagagtgggcatgggggcagatggtggctcctctcacccctgaaaccggagccccagcccctatgagccctcacagttcattggtctggctgtggtgaatctgacctctcaaaagcctccctttccggagcagaggcctgcgattctccatgctggagagcccgccaagagggattctcctacaactttccagaacacagcagttctggggccaggccaagctagctatgtacagctggaagaggctctctcccccagatgctgagtgactagaagccaagagggagggagttctggaatggtctgcagcagctggaggtgaggcctgagggggctggggcggggcctgggaagaggggccagtgcacagagtattctgaaccgcagaaagtattctgttcactctgggagaaaaacaagagtgttgttcaaaacagctggacgccaggcccagttgccctcgcctggtttttactcttaaacaccttcgcatttcatggctgttccaaagagagagaaatcagccagttgtccattcagacacaagacaaggcatcagccgacaaccaaaggcaaatattttccgtggtgaggaaagcctcccgggtggccccaggcctgcctctggagcagtggctggctggtggctggctctccccgaaggtcgctgcttctggtcagcagactgcgtgtctgggggactggccaggatccgcacccacccagggagcgctgggggcagcggggcggccatcctaggcccgtagtaaatggaagctcccttcctggcatgagagcagccaggcctccagggaggccaggacagcgtgggccccacagttccctgtcttgaaaccccagcccttgatatcaaaatgggacctgttagtctgttgtcggggagggggatttaactgcccaaagctcttaggccctgagtgaatttttttcagcacaacagtagctacacacagttgaagagtgtggcacatggctacatagggtttgtatttggtctacagatgaaggaacaagacccatgtggacttaggcctcattatcataattctgcagccccaggagccaaatccccacatggaaacccttagtaggtagcctggccaagtgggtagcgggaaatcagtgatggtaggccctgggacttctctctagtcccctccccaccctttttttttttttttttttttaatagacggagtctcgcccttgcccaggctggagtgcagtggcgcgatcttggctcactgcaggctccgccccccggggttcacgccattctcctgcctcagcctcctgcatagctgggactgcaggcacccgccacctcgcccggctaattttttgtatttttagtagagacggggtttcaccgtgttagccaggatggtctcgatctcctgacctcatgatccgcctgcctcggcctcccaaagtgctcggattacaggagtgagccactccacccaggcttttttttaagacaagagttttactcttgtccccaggctggagtgcaatggcgcaatcttggctcactgcaacctccgcctcccaggttcaagcaattctcatgcctcagcctcccgagtagctggaattacaggcgcatgctaccatgtcaagttaatttttatatttttagtagagacggggtttcaacatgtttgccaggctggtctcaaactcctgacttcaagtgatccacccaccttggcctcccaaagtgctaggattacaggcgtgaggcatcgcacccggccacccaccctttttttctcccaagaaaaccagttttctgaaattttcagggggaaccaggacctcctcgcccatgtctttcacccctgggtgcctgtatcctgtattcaccaaagccccacgggcatctccccgattgaggtcccacccctcagggcctaggacagggggaccagggagggcccccagaggctggagtttggaatacccccttctcttctctggagctcagtttgcatgtctgtgaaatgacaggtgatgtcacctcccagaagggcagtttgagagaagtaaaatctattgaggcaccttggacacaggagggggtcagacggcatcagcctttgagggtgctgcagttacacggctccagcagtctgagccttatcaagacctttccagatatgagggaagtccatgcccagtgtctagctggctgggggagaagccccttgagaacccccactctgtaatgctaggctctgcatttgcttaggaggctgtgtccctgtctctccccttctgggccagccttgctttctgggcaggcccaggagtgtcccgggcccagcactcagagtcagcgctgtctttaatctgtattccacaggcatcctcaccccctcccctcccaggagctaggaacctgccaggcttcttacctctctgctggaatctccaccccccaccagaggctgccctcttggggaaggggcccagcccttgaggcctgtctcctccagactagctaaaccacagagagaactccatctcaggttcccaaataggcggtattcttccccgccaccaagctaggcagctcctggcggctggaatgccctgctcctttctcagcccaccacttcctccaaccttccgtcctctgtgctgcagcagggagtcttaccccacctccttcaggagggaggtgctcacgggttcctatgcctgtgggtctccaggattgggcacggagcagtctgcaaaatgtcaagtgagggagagatccagtcaaagccccaggggggcctctgagctcagtcagctcctctgctgctccccacctcttgggggaaggacaggctggggtttgcatgggtggccttttggagagcagagtaatgggagcctacttgaacttcctgcggcctcattccctgactgggggcggagggtagtctgagctgctggcctggggtgcttggccgcaggggaaggggctgggagggaggggtctgggtgagtctaagggagggtgagcctgaaaaggggacggcagcactaaactgccttcggggagtccccactgtgcgcccctggcactttcccagtcccctggcgcggtcgcaggcacgggtggggtctgcctcaaagttgttggtacggccagcccgctgctgtttaaatggtgtgtttgtttagagcggcttagggagggaactggaaatggggggcgggggcagcgccccacttggcgccaccgctgccggagggtctgcgtgttagaagccccagcttcgtaaatgaccgaagaagggtgggcgttgaggagggaaggccgaaaaccaacggagggctcggggccccgggccggccgccccctttttgcggggggagagcaggagccgcctctcgcagccactctgcgcgcggggtgggagggagagagggaggcgaagggacgacagcgccgggctccccgcccccatcccacccggttccaatatttcgcagaaaggcacgcggctcctaatcggtcttttccaggctgagatttagccgtgcgatgcccgcgcaggggcgggggccgcgggccaggggaggcgctcagagtccggagccgccgagcgaggtgaggagcccgcgtcctcggctggtggagcgggcgggcgggcgcgcaaacccgagaggcagatatagaaaggggggcaggttaaaaataaccctctccggctgggaagctcgcgcgcgctctctcgcctcgttcggtgccagaggactccaggggaggtggcgttggggagggcagagcgggattccccctcctccgccgggcggggtgcccgcctgcgcgccgcggttgcacgtgtgcggggccgcgcgcccgggccccctctgcacccggtcggtgggtgccccctccccaggaccgggcgcatctggcagtggccccccgcccgcagccttgcgcggctggagggaagcgctccattattcattatttacgagcgttaataggtttgagccacgggggcggggggttgggggggcgacgaggacccagtggggaccgaagcattagaagaagggatagggagggagggggaagggcgggggcggggctgtgccgcggcctggaggaagaggtctcggcctggggcccggcgagccgggcgcacctctccgtcaggtttctccacaccgccggccgtcgaggctgctcagggcgccaagagggcagcacgggccttagattttgctctcggcctctgtccttcgcgtcctcgcccttaccgaggcgtggggagggagctgcggaggccgtacgccccgccctgcgcgccccttgccgccgccgcgtccccgcggcagccccggcctcatttatcatcatctttggtcaagtggagtgtgcaaggaacagctgcttcactcggctgacttcgagggcggctacgggagaatcagggagatgaatgatgggggctggtggcagccccccgcggtccccgcgcaggcgagagggaggcggggacgtccagggccgcctccgcctcatggcgagtgcagcgcccccttcctctctcctggcgcctgcagcgaccggggaccgggggaccggggcaccgaggaccgggcccgccccgggaggggactgggcgcggggacgggggggcgcccttcgccggcggagaactggcgggcgcgctgccggcagagcccgaggttgccgtgaccttgctggggtcagcgggctgggctgcggaggcggcggcgcggcgtctttggtgcgctttccggattggcgcagaggccgggaaacaaggcgggggcgggcgggggaacacaaatagaaggtgaaattttacctgcccctgagggagtcctgcggattttctccggcagcagcaggcgctctgcctttgtcttacacggctgaaacatctgttgcagaggggcggagaggccgcaacaacccccacacaccctgcgctgctccccgtccccctctgccccagccgggctgcaggactccaggcgccgcgttaaccctgctcgcgctggggcgcgcgcccgcactcgctgccgcagtccagcgcctcgcgtggggctcctcgcccccgccccggatctggtcctggccggggcgcccggtgacccccctccacctcgatggggtgctgaggtgtaggcggggggcgggggcggaaagggttaatggcctagtcgcagaccctaattgtcagagccggccccgcttcgtttcaattaccctaagtagagactgaatgcgcaattaacgaagtcagcttgccaactggaaagccggccccgctttcacgttgagcagaatactccaccagctgacttggacgaagcaatttcctcctctctctctccccttttttctctccttctctcttccaatccccctccctctttttctctctccttaataataaaattataccaagcagtttgcggtgtggcaggcggccagaaaagcgtttctttaaacgccgccgtctcacaattaggcagcaagaggatttgacacgccgtggcggcctgacaggcggcttcctcccctggggactggggggagggagggggtgccaattccccgctcccccaggtggaacggggactgggaggggctggcctgctgtgcctccccggctgtcagaatggctgcagcgagggggtgtcaaaggcagggaagcgaggggcggttccgcctaggctggggaaggcggaaggcagcggcacattccacgactcctctgggaagctggcgtatccaggagggagaccttgttcccctttctgtttgacagacaggcactctggggcatagagctgtagacggatctcagccctgctgggcgtcctgcacaagccactggcccactctgggcttcttccattaatccctcggcaaaatgagggggagatttgacctagaatgtgctctgcaaaaagtgtcttcccgtggctcgttgcccttaacagctggtcttgtaggccaggagagggggggtgtaggcagcaccacgtagaagcaagccggagacccctatgccgtttgggtggcagacccatgggcctcaaggcacacaggagggtggctcggcggggagccatgatgcaggcagctaatagatggggtgactttgcaggattgccagggattggtgccatgaggacagaggatactgaacactagctgcagcagccgggccacttgagctcggggaaggcccagagaatttggcagaggtgggaggtaactgcaggggtccccatttgctctttgcagccccccagtcccacccaggctgctgcttacatggggtgccttcatccttccccacatagttaagcccttcttccagccttccctgatcacctcctctccccacccccatgggcccctgggtgtcactacatctcaacaccaccagggcagttgtatgtgtgtctgcctgcctctggagagcaagggccatgtgctgtttcctgtgtgtctccggcacccagctcggcccacatccagactgtaagctgagcagaaatgtgctccacaggtgaaccagtgcaggcactaggggctctggaggagacagcacacactttgtctctccttcctgattggctgttgcatgcatcctggcctccaggcccctcatcctcaaacctgtctctgggtatcatccctttggtctgtgttgggggttaaatgcactcaacacagaacccagcaccccaatccatctcatctgtttatttatccaagtaatactgaagggacatcgactctggggccagtttctgggtttggagcttagggtcaaacagaggaagtctctgccctcctcaggctacgttctagtgagggaggcacatgtgaaacagctcattgtaccatcaattatgtaattaccgctgccatgagagccaccaaggagcctggcgggggacccaggagagttggggtggcgcctcgcccggtgtctggtgtggaatgccacagaggttctcaccgcctctggaagcctccagcctttccagtccccctcctctctgcacctcctttccaaggccgctgagtgcacctcctgcacgggtctgccctgcctcccccctgagcccagggcactcgcctttctgctctcctgcgttgctctgcttatctgtgctggtcccagagcttctgctgggcccgtgagcactgttcctcctgctctgggtgccatcgagcccatgcagatcccctttgcatcggttctgtcagcatttgaccccaggagcttgtgatcaaattcaggccacagacagtgtctcttgaattctcaagtatgaaagaaaaaactttgtacttggttgataatattttcttaaatgagagctgtccctttttgtaaaatcctgatttctgtctttttcaagggaaaagctcagaagctttggcaccctggcctcccactcccaagtggccgcagtccgctggtgctgagaggggctgctgctgcccctccccccccactttatttgggagcaggatcgccagtttgtctccatacccacctgcccacttccctgccaggcctcgggaagatgttctttgtcaaatgaagcaaagcagtggccacccctgatctcccgctgcctggcccacccacatgtgctctgtgtcgccactccactgctctttctggatattttcacagagttactgtgacattttgtgcattattgattcagtaaatatttattgttctggacaatggggagtagctgtgaacaaaacaggcagaaatccttgctctcatggaacttttgttctaaagaggagaccaataataaagcaagtcaagtttgattacaacaaggtcagtcgtgggggtgcaaggggtgctgtttcaaacagtggtcagggaaggcttattgagaaggtgacagaggtgacagaggagccaagacttggagccagggtagaagctgtgtagttatctgggagtggtatttccagaggtaaaaggcttgcccaaggtcacacagtcagccagcagtcagacaaacctgcagacacttgacacctctgtgtttccacttccccagggaagtaagtcatggaccctctgggcatgtggggtagggaggacaaggctggggccagacagtcctgtgccttcccttagcagccaggccaggagtggtggctcacgcctgtaatcccagcactttgggaggctgaggtgggcggatcacctgaggtcgggagctcgagaccagcctgaccaatatggagaaaccctgtctctactaaaaatacaaaattagctgggcgttgtggcacatgcctgtaatcccagctacccgggaggcggaggttgtggtgagcccagatcgcgccattacactctagcctaggcaacaggagggaaactctgtctcaaaaaaacaaacaaacaaacaaaaaaactagcagtcacacctagcctatctcatccttatcatgcagcctcctacaagggcaggcactcctggggcttggggtggggagaatggagctggctgggagcacctctgtgggtcccatctgacccctgtgccagggtctgggccagccccttggtcttgctaggcccaggactgattgtgtctgatggcatcagcctggcctcgtgggggaaggacaggggctgtgtcccccagcaggacccagacaactgcctgggccaccagacccttgccctgttaactgtctgcgacccagcaatcagcaccccccaccctttttcccttttcttcattttgacagagacacagagaggtggtgacgctttttgttcagtggtgaataaagtgatctaaaaaaaaaattattgtccacaagagactgatcagtacagaactgataataggtgagctcctcccggcagccttccctggggggcctaggaatgcctgcagctgctgtggaatcccatgttgctcccccacacctcacagtggaggtgggactgctggccatctgcccctcgtccctggactgtgggccctgcggcccaggtctcccggcctcttgatagctgtatcccaggaatcggcaccaaggatcggtggggtgggagtggagagcagggcacagctttagagttaggggacctgggcacctaggcagggggcctggctgtgcccatgaacagcaggtggggccaggccagcgggtgggcgtggttaggccctgcagggatcccattcagctggcttagcaggtctcagctgtccccacagctgggtccctggaggagatggtgttgggggctgtgaggggaggctcctcaaacatctggagagtccagatacctctgcactctgaagggcccagagcccccagccacaccagggctcccccaacctcaactgagcctggctagggctgcccttctgcttctcaccccatcactggcatcctgatatttgggacccccagaccctatagagagggtatgttggtcaccccgtgggattcttccttgagcatgggggggccatgaatgaggagggatgcatatccaagcgttgcccacagggagtggtctggaggggctgcctggtcctctggggttcctgatgtcctaggagggtcctccatctgcccgaagcaggcctctcagcccgtggaccctaacctgtcccagaagcctatgggcacccaacctcttgtcttgtgggctccttggaaactcgcccccttcctcccattcaagccaggcccctaggatatggaattgagcccatacgatagcagtgaatctggcgaacgatttctcattttcaccaagtctcctgtattgattattcatcacccacaacagatggggaggcctgaggagttccaccttctccacccctgcctggactcctcctctgccctgtcctcagcttctggagccctggtacactgctccttcattctcaggttcccaggccttgagtgggttgggtttttaaatttttttcttgcagctacaaatcatgaaaacaggtcataaaaccaccttgggtaagtaggtgggatggaaccagtggcctcagagctgctgctggggatcaggaagcccccagtccgtttctttctccctctctccctgcctcccctcagcctccctctctccctttctcttaggaaaaaattccagccaccacctcccagctgggctccctcaggagccacagcagctctggcctacactgtgcccatttcgctgactggggcctcaagcctggggtctgaggaggctttaggcctagtgacctctccctgaggctgcccaggggacagtagttgccttggtgacagtgggtggctggtgaccatcactgcccattagtggacccacccgaggtgggtctggctgcttaaagatgaggacagaataaaaaagtgaggaccctggcctgaggctcaggctgtcacaggctgcagctcagccccttgccccacagcagctttggcttgcatcctgctccaagagactgttcctccaaagtgggagcccctcacgggggctcaggacaggggtgtccacccgtggtccagtcactgccgctgctgctgagggcgtcctgcataggagcttccctgcgggtgggctctgctctggggtcctaagcagggcacttgtcctgaacctcacttttttctgtaaagggggaggagagattaatcaaaccgttgttcaagaaagccgcacagagtaggtgttctgcagccgccttgctcccgcctcagcagtcctatagatttctggagggaaagggctgaggtctttgcctaaaagaagggctgtgccccaggtgtgtgccacactgccgaaggcctgtgagagccgctggccttgcaccgtagggtagctggggtttcgttgtgcccccactatgttcatggcttggagtgaggacacccattgctgtgtcaaggggaatcctgatgccctgggtgctatgtgattccagctcatgctccctgctgtgcctggcctgcctcctctgtccagcgctgagaagactaagttccaggatctgattctaagggtgaagtgttcatgtatctggtgcttagaggatgcactagactccgctcctcctgccttctagtttcagcaagaactttggagataaggcctggaccaagtgtctgagaggagaggcaggttggggagaaacggatggatgggaatgagtggggaccgtccgggcagtgtggttgagctggaccatgaggagtgagcccagtgggtggggggtgccctcccttgtcccctctcaccaccccttctccctccagcccaagccacaggccaaacccacaatctgcctgctaggccacttcttccctgcccccaggttcaaaggtcaccatcgttctgccggggccagggaggggggtgctctttctgccccctcctctcctgaggcctgcccagcccaacccaacccagcccagccctgctgcctgcctcgccttctgtgtcctgtcctagtgctcttgaaaagtaatcataatcataataattaataacaacagagcccatagcaggcctgaggcagcccttaaagaggcagtgcccccttttctcccagcagagctggcagtgggacctggctggcactgagaggcggcctgtgcctttgttcccatccctccctttgccttgggttccagggtggtgttggggcgagcatttttgcctgcattctccatcagcactgggcttctcgtgttttaattgaactgtcttttcttagcaatagatgctttcaccgcatccagctgctcgtgtgtattgggaaacctgcctgtaatacagctcggctaaattaaaagacacagcagctggaccaattaaacagggagggaggaatgcagacggacaggcagggagggggtactggtaatagcaccccctcactgtctctgtctctctttaaataatgtttctggtaatgcattttggagaatgtgaaaaaaaataaaaaataaagccgtagaaatgttaatgatatccacaggacactcagcaggaaatgagagtgatctgggactaataaaagccgaaatgtaatttgtgcagatatacgaggcgcagccttcagagtggtcctgggtttgcacattctgggctcataaacatgcgcctggggagggcagggagcgggcgctgtgccctcggcctgggcacaggcccgcctgggctgccctgtggcagtctggccagggcaggagcgtgaggctgcccacctggcagggagctgccagaccagaaccaagtgccgtccccagctcctctgggttggcgcgtcgcagcaggaacctcctgtaatgttttatccaagctgccaggggtaggattgaagtgggtcagaagggtgggcacgctgcttgttagggatgcctgcgacaaatccagggagaggagctggagcagagggaaagcggctttgataagccggtgggcaggggctcgcctcgtgggaaagtggccggcccccacactgggctgactctcctgcatttgtgggccagggcaagctgactccagagagcaggagaggtggtcccaggactgggctgacgggcttctgggggccatctggctgccctgggcttgccctgctctcaggcagatggaggccctctgtcgccttccctgcatccatccccagacactaaatgaggaaggcacttgtggtggggtccgggccaaggaagaagggtaaatggagcagcacccccagctctcccccactccccacctttctgcctcttccctgtgcccctccccgactctgcgtgcctctccctctctgtgcccctctccccctctctttgtcccttcctgaccccttcaacaacctggaatctttgtagcctgaggcaagccaccccttccttttggagcatttgggaaccagcactggaaagtcccctatcccctcctgggggcctgggccacacaggccgagctgagcccctttcttcctgcctccgggccagcatggttctgggtaaatcccaaaccctctgggactcggccaatggccagcccctccatgcacttcctccaaaacctggggcattcctctttcttccatccctctttgaggggtcttctggttggccaggccagcgagtcagctggaggaacctttaccctggatgctgggctgtcagatgctctgctctgagaggctcccgcaacccaccctgggtcctttcctgacccaggattctgctctgcaggcaggggcaggttagacccctgcctgagccccatcccctaaaatcataaccagatgggctcttgagtgttgcctgccccagccctcacctgctgaggtggggaggaactggccaggaggggacagggctgtgtcgccccatgtgggtggggctgggctgtgcccttccgtggccgtggccctgggactgcatctctactcccattagtatgcactccctcactctgggccacgtaatctgtttatgcacgtatgatatcaaaaacaggaggcaggtgctgccgtcttgcgttcctgggagtcagaggaggggacattttatgtctacagtggcttggcagcccctaatcgatgtctgctagaaggaacagacagattccagatggcgtggcagtgatagaggaggtgtgtgtgtgcatgcgtgtgtgtgtgtgtgcgcgcgtgtgtgtgtgagcatacatatgcttgtgtgcacgcatgtgcgtggggacaggggcagaccctcctcagtccccagcatggctgggtcatgcttgaacacggtcgcgaagggactaaattacaggatccagcaggccccaggggatgagggagcgggaattgctctgctaaatgcttttgagctgtcaggaagggctgggagtgatgggtgggggacattggggaggagctggcaatgggcggggggggggcgggtagctccccagtgacctggcgctgggcagccggttttgcctcccgcatcagtggccgtccttggcaagactcagctgcaggcgatgtgggagcgggaattacagagcacacctccctgacacagaagttgtcaatatgcgcacagctggtggggaggctcaggcgaaggggggactattaagagctgcgcgggggagcaggcagggtggggaggtgggtgggagggtgctttctgaggcaaaaggaagtggcccgtctgaatcgctcatcctctgccccctccctgcccatcctcccctccctccttccctccctccctcccttcctttttcttttcacagataaccagcccgagtcatgcagtcttttcgagaaaggtgtggtttccatggcaaacaacagaactaccagcagacctcgcaggaaacatcacgcctagagaattacaggcagccgagtcaggccgggctaagctgcgaccggcagcggctgctcgccaaggactattataacccgcagccttacccgagctatgagggtggcgctggcacgccctctggcactgcagccgcggtggccgccgacaagtaccaccgaggcagcaaggccctgcccacacagcaaggcctgcaggggaggccggctttccctggctacggcgtccaggacagcagcccctacccaggccgctatgctggtgaggagagccttcaggcttggggggccccacagccaccacccccacagccgcagccactacctgcaggggtggccaagtatgatgagaacttgatgaaaaagacagcagtgccccccagcaggcagtatgcagagcagggcgcccaggtgccctttcggactcactccctgcacgtccagcagccaccgccgccccagcagcccctggcataccccaagctccaaaggcagaagctgcagaacgacattgcctcccctctgcccttcccccagggtacccactttcctcagcattcccagtccttccccacctcctccacctactcctcctctgtccagggtggtgggcagggggcccactcctataagagttgcacagcaccgactgcccagccccatgacaggccgctgactgccagctccagcctggccccggggcagcgggtccagaatcttcatgcctaccagtcgggccgcctcagctatgaccagcagcagcagcagcagcagcagcagcagcagcagcagcaagcccttcagagccggcaccatgcccaggaaaccctccattaccaaaacctcgccaagtatcagcactacgggcagcaaggccagggctactgccagccggacgcagccgtccggaccccagagcagtactaccagaccttcagccccagctccagccactcacccgcccgctccgtgggccgctcaccttcctacagttccacaccgtcgccgctgatgccaaacctggagaactttccctacagccagcagccgctcagcaccggggccttccccgcagggatcactgaccacagccacttcatgcccctgctcaatccctccccaacggatgccaccagctctgtggacacccaggctggcaactgcaagccccttcagaaggacaagctccctgagaacctgctgtcggatctcagcctgcagagcctcacggcgctgacctcacaggtggagaacatctccaacaccgtccagcagctgctgctctccaaggctgctgtgccgcagaagaaaggtgtcaagaacctcgtgtccaggaccccagagcagcataaaagccagcactgcagccccgaagggagcggctactcagccgagcccgcaggcacaccgctgtcagagccgccgagcagcacgccacagtccacgcatgcggagccgcaggaggccgactacctgagcggctccgaggacccactggagcgcagcttcctctactgcaaccaggcccgtggcagccctgccagggtcaacagcaactcgaaggccaagcccgagtccgtgtccacctgttctgtgacctctcctgacgacatgtccaccaaatctgacgactccttccagagcctacacggcagtctgccgctcgacagcttctccaagttcgtggcgggtgagcgggactgtccgcggctgctgctcagcgccctggcacaggaggacctggcctccgagatcctggggctgcaggaagccatcggtgagaaggccgacaaagcttgggctgaagcacccagcctggtcaaggacagcagcaagccacccttctcgctggagaaccacagcgcctgcctggactctgtggccaagagtgcgtggccccggcctggggagccggaggccctgcccgactccttgcagctggacaagggcggcaatgccaaggacttcagcccagggctgtttgaagacccttccgtggccttcgctacgcctgaccccaaaaagacaactggtcctctctcctttggtaccaagcccacccttggggttcctgctccagaccccactacagcagcttttgactgtttcccggacacaaccgctgccagctcagcggacagcgccaacccctttgcctggccagaggaaaacctgggggatgcttgtcccaggtggggattgcaccctggcgagcttaccaagggcctggagcagggtgggaaggcctcagatggcatcagcaaaggggacacccatgaggcttcggcctgcctgggcttccaggaggaggacccccctggggagaaggtggcctcgttgcccggggacttcaagcaggaggaggtgggtggggtgaaggaggaggcaggtgggctgctgcagtgccccgaggtggccaaggctgaccggtggctggaggacagccggcactgctgttccaccgccgacttcggggacctcccactgctgccacccaccagcaggaaggaggacctggaagctgaggaggagtactcctccctatgtgagctcctgggcagccccgagcagaggcctggcatgcaggacccgctgtcacccaaggccccactcatctgcaccaaggaggaggtggaggaggtgctggactccaaggccggctggggctctccgtgccacctctcaggggagtccgtcatcctgctgggccctacagtgggcaccgagtcaaaggtccagagctggtttgagtcctctctgtcacacatgaagccaggtgaagaggggcctgatggggagcgagctccaggggattccaccacctcggacgcctctctggcccagaagcccaacaagcctgctgtgcccgaggcgcccatcgcaaagaaagagcctgtgccacggggcaaaagcttacggagccgtcgggtgcaccgggggctgcccgaggccgaggactccccatgcagggcaccagtgctgcccaaagacctcttgctccctgaatcctgcacagggcccccccagggacagatggaaggggctggagccccaggccggggggcctcggaagggctccccaggatgtgtactcgttctctcacggccctgagtgagccccgcacgcccggacccccaggcctgaccaccacccctgcacccccagacaaactggggggcaagcagcgagccgccttcaagtcgggcaagcgggtggggaagccctcacccaaggctgcctccagccccagcaacccggccgccctgcctgtggcctccgacagcagcccgatgggctccaagaccaaggagacagactcacccagcacgcctggcaaggaccagcgctccatgatccttcggtcacgcaccaaaacccaggagatcttccactccaagcggcggaggccctctgagggccggctccccaactgccgtgccaccaagaagctcctcgacaacagccacttgcccgccacattcaaggtctccagcagcccccagaaggagggcagggtgagccagcgggcaagggtccccaaacctggtgcaggcagcaagctctctgaccggcccctccatgcgctcaaaaggaagtcggccttcatggcgccggtccccaccaagaagcggaacctggtcttgcggagccgcagcagcagcagcagcaacgccagtggcaatgggggagatgggaaggaggagaggcctgagggttcccccaccctcttcaagaggatgtcttctcccaagaaagccaagcccaccaagggcaatggcgagcctgccacaaagctcccacccccggagacccccgatgcctgcctcaagctcgcctctcgggcagccttccagggggccatgaagaccaaggtgctgccaccccggaagggccggggcctgaagctggaagccatcgtgcagaagatcacctcgcccagcctcaagaagttcgcatgtaaagcgccaggggcctctcctggtaatcctctgagcccatccctttccgacaaagaccgtgggctcaagggtgctgggggcagcccagtgggggtggaagaaggcctggtaaatgtgggcaccgggcagaagctcccaacttctggggctgatccgttatgcagaaatccaaccaacagatccttaaaaggcaaactcatgaacagtaagaaactgtcttctactgactgtttcaaaaccgaggccttcacatccccggaggccctgcagcctggggggactgccctggcgcctaagaagaggagccggaaaggccgggcaggggcccatggactctccaaaggcccgctggagaagcggccctatcttggcccggctctgctcctgactccccgagacagggccagtggcacacaaggggccagtgaggacaactctggtggaggaggcaagaagccaaagatggaggagctgggcctggcctcccagcccccggagggcaggccctgccagccccagacaagggcacagaaacagccaggccacaccaactacagcagctattccaagcggaagcgcctcactcggggccgggccaagaacaccacctcttcaccctgtaaggggcgtgccaagcgacgacgacagcagcaggtgctgcccctggatcccgcagagcctgaaatccgcctcaagtacatttcctcttgcaagcggctgaggtcagacagccggacccccgccttctcacccttcgtgcgggtggagaagcgagacgcgttcaccaccatatgcactgttgtcaactcccctggagatgcgcccaagccccacaggaagccttcctcctctgcctcctcttcctcatcctcgtcctcgttctccttggatgcagccggggcctccctggccacactccctggaggctccatcctgcagccgcggccctccttgcccctctcctccacgatgcacttggggcctgtggtttccaaggccctgagtacctcttgccttgtttgctgcctctgccaaaacccggccaacttcaaggaccttggggacctctgtgggccctactaccctgaacactgcctccccaaaaagaagccaaaactcaaggagaaggtgcggccagaaggcacctgtgaggaggcctcgctgccgcttgagagaacactcaaaggtcccgagtgtgcagctgccgccactgccgggaagccccccaggcctgacggcccagctgacccggccaagcagggcccactgcgcaccagtgcccggggcctgtcccggaggctgcagagctgctactgctgtgatggccgggaggatgggggcgaggaggcagccccagccgacaagggtcgcaaacatgagtgcagcaaggaggctccggcagagcccggcggggaggcccaggagcactgggtgcatgaggcctgtgccgtgtggaccggcggcgtctacctggtggccgggaagctctttgggctgcaggaggccatgaaggtggccgtggacatggtaagaggccagcccagccagggtggggagtgtggggttccaaaggacaggcaggcaggcagtcggggagccccttgtttctagtgctacagtgtgggccaaatgtgtctgcagtctcgggacaatctgcagagtcctgagcctctctggggtgtgtgggggaagtggaggcacccatctggctaaggcaggtcacactcacctaccctgtcccaggagacttcccgccggggcccgtatgcccagccaccgccactctcccactcacctggcatcttcaggctccagccccacccagaatccactgggcccctccccatgctgtcaccggagatgccaaggcccagagaacacgaggactcccaagattgaacatcagggctgccccgggcggtgcaagagcaagttgcccaccctctgttcctgtctccattgcctctgggatgaagctaagggctcaggaagaccctctctggcgacacaggcttggtgcatggacccagtcacagggttcctccctctgcaggacagtccatggggtcacacagtcacaacaggcagggcggggcagatccagaccctctcaccattggctctgagaccagctttggaagccatagtcactgagcaccaacatgagagagggaactctggggctgtgccgccatgcacctttggggctgtgacctgccctctctgtgcctccgtcccctcgcccctaacgtgggtatgagggtgcccatggaggaggggtcgggagggttaaaaggtgggcacctctgagcccaccgagcacagcagccctgtgatagtcagtgcagaggggcctggtggctctggtgacagcagggtgacgttcttcgtggtgtcaccacttccccagtaccatagagtacctctgtgcccttctgagggaggggtcagtgggggcggtggggtgcacctctcccccggggccatgcttctgcccccacattcaaccccgactccactgcctcatccagacttccgtggagtgacgctcccggctctcagcgctgtgtggtggctctcagtggggacgcctgcagccttctctggcccctgccctgagtcccatcccctccactccttccttcaacccactatgtgcggctgaggtcacaggggagccagaggggcttggcaggggtctccagaggccctggacaaacactgcctgcatctgagtgattcagtgacccagcacagtggccccagccggtggcttcgcccctccccctgcccagcctcctcccccgtcgctgcactgcccacctgctcctcgcagtacacccctgcagcccctctgagcagcccctgctcctgacagttgccgtggcattgcctggccaaaccaaggtcccggtgggggcccactgtgtttgccacccacgcctcctagtgtgtgtcttgggcacctgcttcccactgcccatggggatggctggagaccttctccacgcccagacgccctgcccacctcactccaccctccacctcagaggaaggctggccccgacaggactcctgcaggttcctggtgccgcgggccttgcttacccagcagatggtggccttgggcctcttccctctccccttcccagttagtgattttttgcctctctcctgctttctgtctctctctgtctctctctctctctctctctctctctctctctctctctctctctctcattactggctccttcccagcgccttgaaacaggttcaagtctctcccgtcatcaaaaaataataaccctcagatcaccagccccagctggctgccacctcccctgcttcacagccccattcctgaaagccttgtccccacggcatcctcggtcccgcagcctcaccaggggctccccgacactcacgtcccaccaggctgagatcaggtcgtctccacatcccctgcagccagcactggccggccgaagggaggaggggtcagccccgagcaccgaccaccccatcctgtccctggcccatgggtgtcttaaccgcccatgcacacacaaggtcctgctggactgaggagacagtgtgtgttggagaggcgctagcttccctacaccacgcgggggctggaacttgccagcccagcccatgcctgtctgctgtgccatgctccagaaatggcctgacagcctgcgcaactagggctgccccgggaaggtcggaaccaggaacaccctgccagacagatgggacatcctgggagaatgggcagagtctggggcttcccagggtcacttttggctcaccaccccttcctgcctcagtggcttgggggcgccatgctccttggagtgagaccctggttcaaatcccagctctgccgagggctggttccatagctccaggcgagtcacgcatgctctgagaactccacaatgtcaaaccccgttagcaggattgtggggttctgtggatcatgtgggacctgcctggcatgtggaaggggcttggggtgcagctgtgtccctggccccagcactgccacacccctcggtaccttgacctcacttttgcgctctggagggcagaacctctgagccagctctcagggataccttttttcctcgatggccttttctgggaactgccctcgcctgctatctctgagccctgcctgcccttcccccaaagccatcatagacccctacctcctatccagatggagcctggccatggaatgcttggggtgagagggacccatagcgggctccgggcattgttagggggctaggtggtgtctgcagaggccccacctgtggcagggtttacatgccgccacccctgccctcctcttgggtagctggggtcagaagggcctgaggcctcactctctctgcatcttagtttcttcacatctaaaatgctattcatatgcctgcctgagggtggttggggcctccgtgcagtaagtggagagaagccttcagccagaggacccccatatgcttaaacatccagacaccaagggccactcacagacagcagccggcttgtgtttcgtcatcccttttgggtcaggaactggggacgctggactccagatctccaggaggccatcccagactaggcgggaaggaggcctcagccctgagctgaaaacctgaaattctagaataaaccccaggccccactcccagcatgggcagcggggaggggagtgttctgacatttctcagctgctgtggttgggatggtgcgcccaccctgagcatgtggggtcctgtgggcccctactccagcctggaggcagctgcaggggtcagagaccagcctggagccctcgggcaggttactcagcctcagctctcattggtaacccaggtaaaataacagtaatcccatcataaggttgctgtgggcatgaggcttccagccatgcctggcacataggaagctattgtcgtttgtttcactggcttcgcacttgggcagaggccgccgccctctctgctgccttctctacctcaccccccgcccccagcacggtggcactgtggctctggcgcctggtgacttctccctccccggcctcaggtttgcttcactcttccaagggccttcttggtgtgactgtcctgtcctggccacgtccactccaagcagctggtccaggtgtggggcagcccccaagctcagcagaggacagttttgagacttagaggaggacggcatcagatttacatgaagtcagccatctcaagggattaccacgtcaccgcctcctctcacaggtctgagagctggtcccctggagggtgcaggtctcatcctaggtagaacagtcccagcctagcttcaaagtgctcctgctgccagaaagggtagaaaaccatgctgaatgccttcactgttgcctggaatgggagcctcagtttcaccatctgtaaagtgagattaatgaaagggacccacagagggctgttagagccagtaggcggccaggcgcggtggctcacgcctgtaatcccagcactttgggaggctgaggtgggcggatcacgaggtcaggagatcgagaccatcctggctaacacggagaaaccccgtctctactaaaaatacaaaaaattagcctggcgtggtggcgggcacctgtagtcccagctactggggaggctgaggcaggagaatggcgtgaacccgggaggcggagcttgcagtgagccaagattgtgccactgctctctagcctgggcaacagagcaagactccatctcaaaagcaaaagaaaaaagagccagtaggccaggcgctatgtcttacacctgtaatcccagcactttgggaggcctaggcaggcagatcacctgaggtcgggagttcgagaccagcctggccgacacagtgaaactccgtctctactaaaaatacaaaaattagctgggcatggcagcacatgcctgtaatcccagctactcgggaggctaaggcaggagaatcacttgaacacaggaggcagcggttgccgtgagcggagatcacaccattgcactccagccccggggggacagagtgaaattctgtctcaaaaaaaaaaaaaaaaaaaaaaagcaagccagtgggcaaggacacacaccacgcccagcacaccagaagcatgcagcagatgctggctggtagccacagccatggtagtaactggcatcactggcccaagggggtctccctacccaatgtaccagcccagagggtgctaaatgacccatgtttgtgggcatgtgtaccccagtgctgaacctccttctggtagattttcaagcaccattttggagaagggaggcagggaccacagggggccagccagcctgtacaggttttttgtgttttttttgtttgtttgtttgtttgttttttgaggcagggtctcactcttgcccaggctggagtacaggcagtggcgtcatctcggctcactgcagcctcaacctcccaggctgcagcaatcctcccacctcaccttcctgagtagctgggactacaggcacacaccaccaaccctcactattttttgtagagacagtttcaccatgttgcccaggctggtatcaaactcctggactcaggcgatcctcccaccttggcctcccagagtgctgggattacaggcatgagccactgcacctggcctaccagcctgtaaagcttgagggctgggctccaactggagactcacctgcctttcctttctcttcatcagatgtgttccagctgccaagaagccggggccaccattgggtgctgccacaaaggatgcctccacacctaccactacccgtgtgccagcgatgcaggtacgagcccgcccaggaacaggagggcattggagcccatccaagcagtccagggggaccctccctgggcacagctccccaaacccaggccccatctcactcttcagtttccctcctctcttgccccagcaattcttttatccttctgtctgcctagacctctgctgggcaatgccagggacatggaaatgaggcattccccaggcacctgcttgaggagtgcccagagcagtgagggaagatagaagcataaattacaatgtggaatgctgtctgcggagccatcattgccaaggggcagggaggatctcaggcctcagagagaaaggggtattggaggttgggcctttgaaggataaataggagttcactcagcagagacaaggggaaaggcactactacaacagcaaaaaccaactgagttgggggtgatgaggttcaaaacagactgagacccatggagcaattgtggaagttttgaagcagggtaatggggtatggaggtaggcccaggctccccgcatcctctccccggtccttcctctcactcatgtattcatttgttccgcaagcatttgttgagcccctaccatcactgggcacacagaatgaccgtgcatgggctggagccacccaagagcccttacctttatcgaccaggtggggaaactgaggctcagagacattccttatttcatccagagaaagcaattgcttatggtacaatattagtcattggggacaacaatattttgggagatatggggccaactttggcctggattcaaaccctagtggtggggggtggggtggttttcgttcttgtttgagacagagttttgctctgtcacccaagctagagtgcaggggtgcagtcgtggctcactgcagccttaacctcctgggctcaatcatcctcccacctcagcctcctgagcagctgagaccacagatgtgcgcagccatgctggctcctagtagtgtttttatttttatttatttatttatttatttatttatttatttatttttgagacggagtctcactctgtcaccaggctggagtgcagtggtgcgatcttggctcactgcaacctccgcctcccgagttcaagcgattctcctgcctcagcctctcaagtagctgggactacaggcgtgcaccaccacgctcagctaatttttgtattttttgtagagatggggtttcactgctttggacaggatggtctccatctcttgacctcgtgatccgcccgcctcagctgcctaaagtgctgggattacaggcgtgagccactgtgcccggcccctagtagcgtttttaatgtgtggtcttgagcaagttggttgatacctctgcacacagtttccctacctgtatgatggagatgataatagccccttctctgcagagctgctgggaggagagtgaaataatgaacactacccacacggtgctgcctcagtcctattttgggtccagcctctgtgacctctccccacacggtgctgcctcagtcctattttgggtccagcctctgtgacctctccccgtcaccctcaatccctcccaactctggcctggaaagaggcgaagtcataacccacctcccagtggacagagtccaggcccccccaggctcccgtcgctctcctagcagccccagctactgcctcccgtcctcacctgatgccctgctggctttgcctggacaggggaccacagcctgtaccccacctgcctggtgggtccccagccagtgtcagcccagccaagctgccccagggaggacacagaggactctgagtgctgacagttgcttggcaggggctgagctgccgggacccagcggggaaggggcttgctggagcagggacgtggaggattctcactggcttcacgctcccactctgagcagtgtgagccagagtttaacatggaccctgccacttgcccaggcatgtggccgcactccccataatagctgccacgagtcacattcctccttccacagtgattaacttagcgcccgctccactcccagccctgctacagaaccatgttgtttccagccatcttcacagattggctgcctcacccacagcacacagcatggcgtggacagtcccaggacttaatgccttggctttcttgctccatgtcctatgttctttctcctaccccagcactgcccagccccccaaggggctcacccttgagtgggacggacagcaaaactgtggttcttggccacagttagggagaccagacgggaaggagagagtatgcactgtggaagaggttcatcctgtctgaacaagggagaaatctaggaagacttccaggaggaggtgacatttaagccaggcctcaaaagatcgggggagctttgtagcaactgtttagtggtgggacttgtatactaggctttgagcaagagaacttttatttcagataaaatcctagaaggattcctcatataacagggatccctgtagcaccgtgaagattgaggcaggaaagggactgggaatgctgcaaatggagacatacacctcagagactgagttggcacagaatccatgggacttgatgatgagggagagggaggtgacaagcctgatgcccagcttccccatgaaggggagaagtagggtgtggacgtgcaaatggagtattagctgctgctgcagagctactggcccttccaggcccagcttcatgtctccagcaccagcccttcattagttctcaaaagggcgtgagttggctgcaggctctgctgggagcaggatgatctagggtggccccagctgtgccagcttgtctttgctccatcaatctctcatcctccagcaggctggcctgggtgcgtcctcatggcagccccagggctttgagagagtggaggtcacagggccactcacagcctaggtcctggactttaccacgttctgttagccaaagcaggtcccaagtccagcacagagaagtgcaggccacctggggtgagctgcagagccacaccacaaaggacctgggtgcggggaggggactgggctgctctgccaggccatctacacacacggcagttccctttggccacacggcagtagaggcagctgtggacatacaaagtgtagatagctgggctcaggatcgagtctcgcccaccatcagcaggcgagggctcatcagagccctggaagggacaaaatagcagggttgtgttcaccatggaacagctggctgaggaggagggtggacccctgggaaactgaggaacagctgccagagaaggcgagggagaacaagtgagctcgagagtgaaggcggggaggacgggcgcttggggtgcagggagggcccccagcgtgactctgccagccaggcggtggggggggcgggggggtgggagtgagagggcactgagggagtgggctggtcaggctgatctgatgtctggccagggaggagccccaggcctctgtgtcaggcactgggactgcagggcaccagggctgcccactggctgccagcctctgccctgcactgcgctgtcctggcctactcatcctgcccccttccaattcttgttaaggaacccactttggagacaagcagtgactgaagagcaggcagaggctgctacaccacagtgtcctgtctcaacctttccccactcaggccctggggccaacctgtcagtgagtgcccaggttccccaggtgcaggcaccaggtcaggagccagatcactgaggactggccttgcccagtgactcccgccccgtgccccatgtggggtggtgctggggcagtgctgagggagccagtttggaagtggcgacctcctaccctcaacttcccttggtgggagtgcccgcagctacccaggcgtgccaggggcaggcctgggattttagcctagtgtctttggaatatctagttcagccccagaaccacatctggcttgcctgagccaagggaaggggaacagccgtggcacatctctagctgctggccctgaatggcagtttccaggtccgtggcactccagcttctggagacaagggcagatcgcctcagagaggcctgctaccacccagccctgccctcagggctgcagagctgtccctgccctgccttctggccaccaccctgtcatgatgccattgcacagagccacctccagtgtgaacaggaagattgtgttggagagagcaccagcctccagctacttttgggtctggggtttgttcagaacagtggctggtgaggctttgggggaggggagccgagaaggggactagagactggggggtccctgggggaaaagccagcttctccctaggtggcagtaggcaggggagtggagactccctgagatagcaacacctcctgggcctaggtgggcataagcactggccatgcttggttgtcctctctgcccctgcctcctgcgcccactgcatgccacacatgtgcagggtggtttatttttaaattttattttattttatattttattttattattttattttattttattttattttattattttattttattttattttattttattttattttattttatttcatctcagacagggcctggctgtgttgcccaggcaggggtgcagtggtacaatcacagctcactgcaacctccgcctcccaggctcaagtgatcctcccgccccagcctctcgagtagctgggactacaggcatgcgccaccatgctggctaatttttgtatttttgatagagatgaggttttgccatgttgcccaggctggtcttgaactcctgggctcaagcgattcattcacctcatcctcccaaagtgctgggattacagacatgagccactgctgctgccaagatggtttctatacactcccatcctcaatctccatgataggcatacagtaggtggcataatgcccattttacagatgtggagactgaggctcagagaagtagcagatgctcaaatccaggcttgcaacaccactaccagtccgtccacaggggttcatgacatgctcactggaagttagtgagctcttccaggggctgggcatacatccagggaagaagacagagctggtgccctctgggagcttgcctgccagtggggaagaaacaaggagcaagacaagatcacacaggccagtctcttaggaggcagtgacaagtgtggctggcagagtaaggcgggagggagggagggactgagggactgcctcaagtgaggaggggcggcacgtggaactcagggggaaaagctctccgcggaggaggtgaggtgagtcaagactgccaggccaggggccgcacccgcgccgtggagtggagtggagtgtggagggttttgtgcagaatctgattaactctttgaaaagagcccctgcagtctggagcctcgcgggcagtgcggctcccctcctggctgcagacaaaaccccacagctgtggggcccccaccctgtcctaaccaccgaaacttctctttggtcacaggttgcatattcatcgaagagaacttttctttgaaatgtcccaaacataaggtaggggaccacagtgttttgtagggcgaggggtgtcaagcgggagaggagccccacctcgcacctccttcacagtcccctgggcccccttggctgcgcagccccgcagggcccagccctaggggagggagctctccccgcccacccccaggagcccccgccgccgtccagctcaggtccctgtccacttgcgcgccgccgccgccgaaaacccgcaggcgtcggggcatgggcagccaggggctggagggcgtccctgggacggcctccctgcagctccccaagataggtgacagagtggggcaggcgggggcgcgggacggtggcacggagctgaaggcgaaggtgaaggtgaagctggacggggtggggccagaaggggtggtgccgacggcctcgggcggagaccccagccgcgctctggggtcgcctgggtctggggcttaggcggggggcccacactgggggcggggcctatggactgtgaagtccgaggtcgtcggtaactggcgggcgggcgtcttttgcagaggctgccgtagtaatccaccccaacggccggaggagccgccggagcccgcctgcccgcccgccgccgaaggagaggagccgcctgcgcagcccccgggcctttgagctgctcccagcgctggtccagagccgatccttgatccgggtcccggatcgtggatccggccgcctagggctcagacttgcggccccgggttgggaggaaaacccgttccggagccgcctgctcccggaaccggacggcacagggcgttcttgcccaccccaggggccaggcttgcggagggggagcccgcggagcggccagactccccggggcgctcagcctccggcgagggtgggagacggctttgtcctggggacactttccctctggaatctcaagacgacgtggcacacattccacgtgggtgctgccgccaccccagtcggtcgtggcgtgcagctgggagccctgggcttgggggtgggggtcgaaacagtactggaagaggcggagggcggctcctagctccgtggactaggcgggggagaaaggaagcctttctgagagcgggctaggccggcactggagaggccggagcctttggaacaaaccgtgcggaacgcgtccaggggccttcccgcccagcctttgccagatctctcgtgcggttcgggcaaagccggggtagacctgggctatgctcagttaggggttgcgggatccccgagtgtgggcgggactgggacaccctttggcctctgtttgtcccctttccagtcctccaccccacccctggagcccagcctgggagcgcaaaacccaagaagcggccagaacgcacctccggctccggcggacgcgcgaccgttgtgcaccaccagggaccgccgcgcctactctgcacgggagcagggacagcgctagatttcgtgtacaaaacctgtgtacccctctatatatatgttacatagaatgtatatatgttgggaacatgctcgcttctcccgtgtgtcgccgccgtgcgtcgtgcgcccgcaacagagccccaaccgggcctttgccgggtaaggggctaccgcgacgccacttgtccacgcagccaccaccggcccgggccagtccctgccagtccgtccgcctgtccgtccgtgtcctcagctctgtccacgcttcgataggcctgacgcagcccccagcccagggccgccctagcaacttcctgtacatatgactgtaaaatggtaaacgtgtgtattatatctggcctcgttatatagtgtatatatatgtatacatatacatatatataatatatatgaagactgtaaatgttaagacgactagtgttcttattagtatattgcttcacactgaagattgtgtgtatcgagctgtttctaaaagatgtttattttccttaagagtaaaaaacagtcattgcattcagaaaaaaaaaaaaaaaaaagtcaataaagatacaacgattgttttggaaaa

SEQ ID NO: 11 - DNA, 32769 bp, Homo sapiens
  source 1..32769: mol_type = genomic DNA
agattggaggggcggctgcgcgaggctgcagactggtgcagcgcactgtgctggcggctgggcctcctccacctcctcgtctttctcccgggaaccttgacgacgccttccgcttggccctgccttctgccgcatccccgccgccgcggcgccttgaggagcaggagaagacgcagccgggccgccgccgttagaggggttcccggccgccgctcgccccgtcggccgccaccgcctccggggtcagccctctctctgggtctccgctttctcctgccgccagcgcccgctcatcgccgcgatggggctcctggactcggagccgggtagtgtcctaaacgtagtgtccacggcactcaacgacacggtagagttctaccgctggacctggtccatcgcaggtaaagccgctgacttccccatcctcgctcggtcccccgcggggggtcaccggcccctggtctcgcagctcccgggcccggccccacaggcccccgcgccctgcggctttcggatgctgcggatcagcggaggggccggcgcgggcactgcggttgagcactggttaatctgatccgaatgttaaggcctcccctcccccgacactcgcagggttttcttctgagctccctccatctctcatcagctctcggatgcgggagctgacatatcagatggagcctgtgcagccaggagctcctcgcaggagccgccccaccctgtgctcccacatctcccgagctcgcctccctcttccccgtgcacaggattccttttaacatttagtcctattttgtatggagagcgggctggggaggaaggagggcttcaggggcagctgaaggtacaggaggtttcttcagcctcctggtcgctttgacagaaccctgctaatcttttcttctatctagctccttcatctatagtataattcggactgaaaagtaaaataatattgtttggctccttgaaccttgaagaatgttagtttccgaggcattttcaacagcaaatatgtttgaagtgattgtctataatggctttgcgcactgcagtgcagtcagggggagggggaggccaaaacaccggggaagaaatcagtctttaggaagggggtctctacagcaacacctagaggttgtcccagatgcctacatatatacagttcttaaatcagcaaacttttctttagctgttgcagttaatttggcagggctgtcaattgtttgatttatgcagctttcctagcgtccaactgtgatattatatttttacattgtactgtttatttcttcatttgcttcgctgcttttgattttaaagcatttaaaagtctttgaaatctaaaataaggtttaaaggatttcagaaatgattttacgaggtcaatttttctggtccttttgcagtatcacactgcatcctatcagtgaaggatattaacgttccatcttatgactctgccttccctacttcgaaatgaaaatgtactcctgtagtttttgtgttcattgttgttagaggaaattagacagtggttacagcatgaatgtagtccgatacatagggcttatgttttgggaaaaacgtatgctggaattatttttgtgagagacaaaatgattatttggcattaatactgcattcacttctttagaaaagtatgttctttttcagaagatctcaactttgacactgggaaataagctatttaataagccattacagctgaaaatggttaaaaggcagttttcaatggagtgtttcttcagtttttttttttgtttctatgcgctattacactgatgttacactgtacctgcaaaaactgggaaagatgtgcccttcccttcacgtctgtgatttcggttctttaaacgttgcatcagggcttcccattacacaattgtatagagctgaacatcagacaagttctttagcaggtaattgcacttcgcacacctaggagtcagacactgttgagatactccagtctccatatagccagagccacacccaggagttctcggtcctgtcattcctatcctatcccggagctttcccatctcttgagtctcagaaggaaaaattgagggcaaaggtagaatacacctttctgtgatggtgaattccttcctgatgatgtttgtgtaaaagaaaccacacacacacaaatgaaacaggaaattttgtgcagttgccgcatgtgaaagcttgctactaggcttcgaagggcatataaaataatataatattgtgggccaagcctgagaagtgagagtagccttagaacacaagtgacctctcactagcaggccgaaggaaggtatttgcctatgctttgactatccacttacgaaacctgagactgcttccttgctttctgtaatgagctaccttatgtaggcagatggtatttcttaaccaacagagaggcttagtggatatagtctgttctgctgtactgctgtgtgaggaggagtatttttcaggtccaggccgaatagacctgaagtctgtggtgtcccatttacgtttactctccctcattctatgcccctcgtgttccttttttttttttttttttttttttggactcattcactctgctctgattccacctctcagcataatttgatgaaaatctgggtgggggatatcaaaatagaaaagtagcttataagatgaggttaaacaaaagttggtgagtcaaatgtttggaaagaaggggaaacagaaatgggcgggatagaaagatggtcttgagaaatagtgatgagtgtggtgaaaggatgcaaattattgagggagagcaagaaatgaggtaggctccttgtccttggctgctctcattcctagtgctgtagttacatgcttctttcattcttttattaattcattaaatgccattttgtgctattatatcaaatggtgctttaaatatccaaacatatccaaagcaatgtctgaaaactgggcttttcagaggcacatatgtagcaaatacaaaatatggtccataataatgttaacaacaaaaatgttacttttactacagtattaacactttgtacattggaattgaaagtttgaaagagctatacttttagaaaaacaacaaaaataatttttatttctctgtatttgtagacattttgaacgaggaaattagcgttggtttatgttaaagtataggctggtgtaggactttatactagttgttagtattagagtaggtattccatgtcatcatgttagtttttttcttctattctttcacttcatgagtacatttaaattattaggattggagtcctaggctcaacgtatacatctaataaaagttgtatatacattttttaaactgatgaatctaaatattccccaatctatgaatacccaacttatctacattattcatttattcatgcttttaataaatgtttaatagcttttttgcatacctgacatttagcatataaacaccctagagagttagtaggatgcttacggtaaagccaggtgtctcctgtgaggccatgtatcttctgaccatttgtttctaaatagctgttgttcacagggtatgggtgctgtctgttggttgggggtggtaatgattggcattggccctcttttcgcagatatagtaccctgcattttggtgaaaaaaattgtctacttggtagttgcagttagaacataacttgctgggtccttgaattaactttggaggggtcagaaagaagggatgagtggtacaggaagagggaggagagctgtaggatgacgaaatgtggaagccaggcttatgataccatttctttccgtatttacttgccatgtacaggcacagttctaggctctggaaaggaaaggaggacacttggtcactgccctcatgcatcttgcaaagtctagggggtcactgtcattcccctttccttgatatcatggtctggaggcagtgtgatctgtcagactcaggactagctggggcctagggaagatcagaaaagtccttccctgctcttctcatctctacttctcctaagtgaaaggaatatacagttgtttttagaatattttagctgtttcaccacagtttacttccctctacccttgaatgaggagttgatgtgagtactgtcagagtatttggagaggcatactagggcaaaaggtgtcaaaggcaaggggaacagcttgactgaaaaccatggaaactgggaaggtgcttaagggtcaggccagtgagtcatccaggtttgatgaagctgggggctagtgggaggggatgtttaactcagctcaaataagctgaagtaaaagcaggtttgtcttagggattgctaggtcccagaggagcatgtattttaagtattgtacagtatgcttacattaattttattattcgtcacagttaatgtttagtttttcatctatgttattatctaaaataggtttatttgtttggctaagcctggtaatgcagttttctttgaatgtttctttgagaaaagacattctgattccaagttgtaggcagctaattaaaaaaaaaaaagaaagaaagaaacatcaccagctcctaacatgggatctcccttggtcactgttttcagtgacgtcctaattatcctttactcataagctccttgaagcctctgggatgtccatgccattttatggttttttgttttggtttggtttttattgtcttttccttcaccacagtttgatttttggtggtagactgctagactttaatagctaatgctcttatccattccccaatgatagcataaagtaaaacatcctattgcagatggaattccaggagggtaaacaatgcaggttctaaaacgggtgtcaggacacagttttaactattttaacttagattctttggcttaggaagacaaagttttaagaattatgcagataattatatcagatggcacttttgtaaacttaagagccacagagcacttggtcatcctttaaaaattcaatttgttttcttatttttttgctcaagtcctgtggataatgtcacctgtaaatgctttaacattattaacgtaagtattttcatttgttaagccacttattattctgaattaggcatatattagcacaccgaaatgagtagtgtaacagtctatcttttttcactttagatgtttttttcgtcttcattatcaggacattttgcctgttaacaaacgaaggtactattgttttattttctattagaatatatattttaaaatcatgtgggtttggatttcagaaaggagatgggaggaaacacatggccttttaaagccaaggtccacattaactttctcgcttgatccttcagtattcccctgcccaaagacctgcagctctagccaactgggataactcactgacccttaagtaaaatgtgtacatgtccacctttatgtttctcatcccaccattccccttgcctttacccaccttttccctgtttacctctccagataccttttaccagaacccagtacaatagtcctcctttgcaaagcctttcttgtttatggtaccctggagcaagttgttgtctcacaggagctcattgtctttagtaattactcacgtatttcctgtgccattccttctatgaccctagtgtcaaactgtttaaactttcgttattatttaccacttcactcctttgtatctttctctccaacatcagagattatcacatatatttgttgatatgatatgtatcaggagatgaccctcttaatctagcataattttgaatcatgatatattgtggttgctaaacatgaataaggctttagaccacactaaattacagaaggtttttgtttttgtttttcatagagtggggatttcaccatgttgccctggctgctcttaaactcctggtgtcatgtgatctgcccacctcagccccacaaagtgctgggattacaggcacgacccactgtgcccggccagagagttctttaaaagaatgatattttttatgagttggtcattaattcagttgccgttcactaaatttaatgagtaaatcaggccattaagtcatttagaagcacaaaacagataaaaaatgaagattccaagacatataaaatcagatatgattgttctcttcattgtctgtgcagaagcattgccttgtgtggaagtgaggagggcagtgtggtatagtgaatgggaagaattctggactgggatttagatgacctaggttttagtcctggtctgctgctgatttgctatgagagtttggacaagttcctttgccttcccaattctcagcattgttctctgtaaattaagagggttaaattaggtaatctgtaaggtcctacctgactctaaaagtctagatatagatatcactttctttattcttggaataggtaaagcaatttcaaataaatatacatttatcagggattcagaaacctcattctttatagtaaataaaatttttttccagcaaaactgttatcaacactgcctaaatagtacaaataacagattcttatttagttctttttactttttaaaatttgctttataagaaataggtagaggaatagagcaacaaaagtatacagatatttaagcgtctgttttgaaataacattgcttttgttgctgtaacactatacctgtttaattatctggattccttgaataaccaagagccaactattttatcgaaaacagtagcaataatattaaagaataaaattatctcaattatatattacatttattttgtgatactcagcttttgaggatggcatattatgtcgttttaggcaagttattcatgactctttgggtctcttatttctacctgtgctgtgagagggttgaactacataacctttaaggcttagtttattgaatccttataacatctcctaaaacagcagcctagatatcagtctaaactcagtcttcatatttttccaatagaaaatgtgaaattttaacatacatcattacaaatgattttctattataaacactttatatatgagcattttttacttaagtttggaagtatggcttaagatttttgtaaaattgataaaaatgtgtaggtcttacagaagagaaaacaaaagaaactaaatggttttggtataagtatgttccttaactaatcaaaatacaaatttttaaaatcttttgccatatatttttcttcatgaaatattaccatttgtaaacaaataccttagaatgatgttttatttatgattatattgtattagagtaaaatttttggaatttgaaagacaaatgcattagtccactgaggaaatcagttactcactgtcaggtataatcacataaaagcatttgtgattttgaactgcagaattccaagaaacaagcttttctgttttcatttttattcacttatcaaacaaaaacttgagcacagatgtgtgtttttaactaattttatatattttttcacacacgtacatagcagcattattcacagtagttaagaggtggaaacgacccagatgtccagtgttggataaatggataaacgcaacgtggtatatacatacaatggaatattattcagtcttaaaaaggaaagaaattctgacatgtgctacaacatagatgaaccttgttactaagtgaaatagtctagtcacaaaaagataattatgtatgtggcattatggttccacttatatggaccctctactgtagtcaaattcgggctgggcccagtggctcatgcctataatgctagcactttgggaggtggaggctcaaggatcacttgagcccaggagttcaagaccaacatgagcaacaaaaaaatattaaaaattagccaggcctggtgccatatgcctctagtctcagctattgagaaggctgagggagaaggatcacttgaacctgggaggtgaaggcttcagtgaaccataattgtgccactgcactccagcctgggtgacagagtaagatcctggcccaataaataaataaataaataaataaataaataaataaagtagtcaaattaatagaaacagaaagtagaaagatgtttgctagggcctggggagaaggagaactgatgacttgtttaataggtatagagtttcagtttttcaagatagaaaagttccagagagtcacaacaatgtggatatgcttaatgatactggactgtacacttaaaaatgattaagatggtatattttatgttatgtgcttttctttttaccgcaatgcaagaatttcatatattataaaattaatacattagcacctgtagaaatgatctctttagtgctcaatggtaaaacagtcaattcttctttattttttcaatttaaagtaaaatgactttataaagagactatatagctgttggcttaaaaaaaatccgagtggctagaaagtagcaaataacaagaaagaaaactttagctttgtattttgctttatggttttacaaacaacttcacaataactctgggagataggccttgaaggcattttttccatatatttagaagtctttgagatttacagaagttacgtaacttttgtaggtggtcactatagtgcaaatgaatgtgcatgggttgttttgtccctagcccagtgctcttgtcttcccgtcacactagccaagcaagaaagaaataatcaggcctgtaatctgtgtttctcttttattttaccttttcttttattgttatctacagagtatcactgtttagaatactaaatctgaacaaagtcataatattaccaaagatcatctaaagaaagacatctaaatattcaaaggtgctataaaggctggtgtatgagattaaactacaaagtgatatttattcatatactatatacatacacaaatatgtgaatatatgtagaatacaaaatgcgatatttagcctgagaagatggttaacttccatatgacggtgtaggattgtttaaaaaaagtgtattcaaagtgaattatgaaagtatttgccaaattgcataatacaagagctagaaacttgttagtgaaaggataatgaaattcattcaggactaaccgtattttacccagtggctattcaacttatagaactgttagagtcaagggaagattttggctaaagttcccattaactcacacactcacacactctaatggtatcttccatcttttttgctaaagggaaacaccatttcaattttcttaaagctttgagttcattggcagcattgggtggatggttgaacttggaactcccagattaagttttatgactactttttctgagaagcccagcaaaattggaaacaaggagagaaggaaactacttgtattctgatcttggcttccaggaaacgaggcaacattcttcagctctctctctcgagatatattttctcccttgaaattgtctccttttcccttatgaactggcttttatgaataggccattttctgaagtcatgaatttggacatcacctgcacttgggcatggtggctcacgcctgtaatcccagcactttgggaggccgaggcgggtggatcattgaggtcaggaatttgaaaccagatatcgtctgcacatgatgaaactcactaccatttattgagcatttagtataggaccattttaagatgctgtagtactgtatttgatacaccttatatttaattttcagatcatctctataagttagatattatttaaccatctatagatgaagaaatagactcaaagctacatagctagaaagtaacagagttggaataggatcaagatctttctccttcccaacagtgacctttttataatgcaacatagcctacttatttattcaataaataccattttattgcccagtaataatagtgaacatttattggatgcttactaagtgtcaggcactgtgtccagtgttttatatgtattatcacatttagtcctcatattccattgggctcggtaccgttattatccccattttccaggtgagtaaactgactttccctgaacctgattcatctaatactaaccctgtcaaattaaatcccagggtaaccagccttcagctcgaatcacacattgattctctcatctgtgttaactgtcttttctcctttacagcttctgaatctgttcttattttttgcttgctctaggaaattttataatttctctcactttctaccattattatgatctctattcaggcaaacttgcaatgaaaattctttttccctctgctttttaactctgtcctccattctttcaggctcttgggtaactgttatagaactgagttagaggagacatcttgttttaaccctgtgctgaatgactctcagggcacctgctccctcataccttgagacattgcagctttcccctctttcactggtgaaggtctctgttccctcctgtctgcccatcacattctgacttctttgccattttttagcccagcctctgccttatctacccctgcattctgcaaaagctaccctttcctcccattcatccaggtgctcttccaaactcaaaccttccatcctcttttttgagtacataggggttagaacagaaattttccctgctaatcatgctgactatacaggaaactgatcatgctattcttcacccaccaccttcaggatctgtttgtttctagagtgtgtctcagattgttcattacctgcctcatttgtccagttgtatttgaagggcccttctcttctagttctgcctttttcacctcactgatagacatggcttgaggaatatattaagcatcacattttagatttgaacctaggagaggcctttaagatgtatagagtttactccgtttgttagaaataagctctttccaagactcttcttgacaaccgttgtctacagttttcattgaaaatttcttttaacaaatgttttgaagactcttacatacctgacattgttaacagagatacagcaaggaacaagggctgtagcattggccctcgtgacatttataagaaatggaggaagacattgactatttccttaagaaaaagactacagttaccctttggggtacttgcagtgtacagtgtgacatactaataggtaacctttttgtgtaatcagtaaaggcaaatggatttttaatatcacttagtatattagtggtgatcagtagccagatgtttaaaaaaaaggaattaatttgcaactgttggttttaacaaattaaaggatggatagttttagggaatagtatagtacagacttcttggtgtcttgaatatactcctgaagctgctcaatatttagcgattgttagacttgtgttcttctttttttatggtagattaaacaaatgtagatggttttagaagatgaggaagtggctgatttattcggatagaatctaggaagaaatcaagtcaactttattttgtgacttaattgcctgttaaagtaggctcacatttctgagtagaccagagcagtgctccttagactttaatgtgtaaagtcactgtggaatcttattaaaatgcagattctgatttagtagttctggggtgaggcctgagattctgcatttcttgtaaggttccaggtgatgcttttctgctggtgcatggactctactttgaataacaagggaatggagtattcctaatttgttttgcaatctactgctgtgtactgttatggaaaaagaagaagttttaaacatgcttaagttattaatgtaaaaatcaaatgctagatgtatttagatttaattattttttatcctaacaggaattttgtgtgtcttctggaaccgtattatattgatcagtaactgttgctcattttacctgaatcaaaagggccaatgatttggttaatcttattatcaccttcactttacacatgcgaaaatagtggctctgagtttcaggttcatcatcatggggctagaaaataaatgacagagctagaatttaggtttttaattcaagtcttgtccctctccctgtatcaagctgcctctactccatgtgactccccttgccatcatctaagatgatttcctactgtattcttgtataccttttctttagttcttctaggggtttgggtgttctaaaatttttttaattactgttttttcttttgggagattatagtaaaactttattagcttagcttacttggggaagatagttcattctgactggtggagatcctgatttgcaaaaagctttaaaagaaatcagaaaaaaaattggtctattagaggtttttaaggaagttgctttaataaacatactgataatttgttgtaagtattaattatagttgtttgtgtattaagtagaagttacctgggttagttgaaaactattagattacaggcattttattatttattaaaatctggtttatattgtcatgaaaaggagtttttaaaaatagcctctctaaataattttaaaaatcagagtgagaatttttatgtattttatctcctgaataaataaatacagaattataaaatgtcttctcagtctatgtcataaaatgtttttttattctcagtgtaaactcttctaagtttaattattcatggtaatttttatttaatttggtttaacttttctctttgaagatagaggaggatttagtggttgatcagtgtcaataataatgaaatgccaaaaattattgaactctgacactgtgtcagatgctgtatacatgttgttctattcctcacaacagccctactatcatctataaggccaggggcactaagtaacttcttgggtttattcagctggtaagtgaagagtctaatgctggtaagtctgatttgagagtccatattcagaatatagaactctctaggttgagaagaaaaatcctggaagacattgaggggcttgacttttaaggggaggggctcagattatctctgacatgagacatactttgtgaagatgtaaatttgggagagaataggctgcagcagaagggaatgcatgacgtcgtggtatccatgtgtgctaggaaccttcgcatactttggttcatttagttatcacatcttaaccctatgaagtaactatttcctcattaaaaaaagaaaaaggaagaacagttggttttccagctatagattctgttctgcaccctttccttttggaaatttctcggtctttgtgacatggttttctcttttcctgcctctctggcttatttgctgccatttcacccactcatcttcaactgtcctcagagtcattcctttttcatgttattctctcactgtacatgctccttcccttgtgacctcaaactctggtgtgattgtcattgtcagtgacccctctgtgtgtccacagccctggcagttcctctgcagctccagaggctactggacgcctccacctagctgtcccaaaagtagctcagatgcgagatgttcaacattcacctgatcagtttctcccagatctgctcctcttcctttactctgttatggatcatgacttcactgtctgtgttgccagatagaccagaaatctgggagtaatcctgaacttttctttgactctcttctctcacatccacaacagtcgtggagtctgtagattttacccacgaaaccttcgtatctacctatcctgttcattgccagtgcagctccctaacccaggtttccatcatctcttatgtcctagtggtctccaagtctgcctgcctgtcagaatcacctgggggagctcagatcatagtgtccagtcccacccgcagagattttgattcagtaggacctgggaatctataattttagcaagcacatgattcttacatgggtagtctagtggtagacaagtattgagaaccactgatgcagttggttttcctgcctcttgacatatccccttcccctcagtccacaccccactgcctctaccatgatcttttgaaagccaaaactggctgggtgtggtggctcatgactgtaatcccagcactttgggaggctgaggtaggtgggttgcttgagctcaggggttcagggccagcctgagcaacatggcgaatcctcgtctctacaaaaaacacaaaaattagctgggtgttgtggcatgcacctgtagtccaagctacttgggtggctgaggcacgaaaatcgcttacgccctggaggtggaggctgcagtgagctgagatcatgccactgcattctagtctgggcaacagagccagacccagtcccaaaacaaacaaacaaacaaacaaacaaaaacaatcaaatatctcttcattatctacatgataaattccagcatcctcagtgtagtttgtaagacctcctaggggatcatcacagtcatttcctgccctcttcctttgtatatatcctcttcatcatgtctgcttagtttccagattgttttatttcttgcttctgggctgcttatacattcagttctctcagggtattcagatattctcatttgcttatatcttgtcattgtactaagggaacttttgtaggtctttctaattctgccccgtgaaaaaagacttttctccctgtctgcttgtcaaattcctcttctttgaaaaaaagttcaaatgtctgtgtttataccctgccttctccccttttctgtcctaccactgttcataagacactcctctgacataacactcatcacactgcatagcagttgaattctcatgtctgtctcttcctctgctagttgagcattgagagatcagggaccaagtgatctggccaaaatcactttgctgcaaaggagtagtatatgactttggagtatatgacttaccatctattccaccatgctatgtgatcttaagataaaaatcagattaagaataaaaacttattggtggaagatattcaagggaaaccccatttcaggtggactctattttttttttttgagaaggagtctctctctctctctctgtcacccaggctggagtgcagtgcgtgattccagttcactccaacctccacctcccggattcaagcaattctcctgcctcagcctcccgagtagctgggattacaggcgcacaccaccacgcccagctaaattttttttgtatttttagtagagacagggtttcaccatgttggccaggctggtcttgaactcctgacctcaagtgattcgcctgcctcggcctcccaaagtgctgggattacaggcgtgagccactgcacccggccccctcattttttataaaggaataatacgcaaatagtaaaattgactccttttagtgaacagtttttgaattttgacaaacacatagttacataattattacgtaaccttttaataaagataaaattgtatgattgctgaacacattaaatcagtccctcttggcataagctttaaaaatcagtctcaaaatattttcattacaaactatttattaactctttaagggtccgcaagggttaaggtgtaatgtgccttagtaattctcataattaaaataaaggcttttgctcctgagctcaatttgctatgatatttggctttaggtttgcttaaattttgttcaaaactatcatgggaaacccattaccaaaggagacaactccttctgtgtacaaaagggaaagacccactggttagaaatttcctgaattcaggtgaaatttactttcctataacttctgttggttctaattcctctctctgaaaatggagattaaatctgatttctcataagttctcttagtatttgctgaggcctctttctcttttccaggctttagtctttagtctttttcccttattctgtgtcatggctttgaagcattcatgatcctggcccaagtctgccagatgctgcacctaatgaagtataagacttggctcctttgagtaactcttgtcattctttctattgagggaacttttaaaagtctgtcttattttctttcccttgaaagaatagtcttaaaatatagcatttgtatctataattcagaaaaaaatcgatgggaaattctctcccttaagattaaagtacatggtgattgagtagtgcctacaacagctgctaggttacatgaggctcttgctttacgtgcagtggcaagtctcttgacctctctgaatctcatttttaagataaagggatcatttctaaatctaaaattttatgattctagtttaggtaaaggtttacatgacaacgtgaaaggcttaaaatggttaataggctcaaaataagagcaaatttattaacacatgaaggtacaaacatgttaataagcatattaatagtataaaatataaaaataatttgataaacaaatttgataatttgataaatttgacgagtccatttatatttgtgtcattttttccccctccaccccaccaaaactttctaaagagaaattcccaagaatgctacataaaacatatttggatctttgtactatttggcgacagggtttgacttcagttggtggtaggagaggtaggattttagtcgaagtttttcagtcttttttcttaatgaattaatgacatggaatcccactgataactgtgtaggattaggatgttgacaacataatagaaatgtatctcctgtcacactaatatgtataatctacatttggattcaatacatagcccaaatgagaggatttaatttagctgtaaaatattaatatatatttttaaacattcgagttaatgaaaatatggataatttaatatatttaaagtttacataaaatacatgaagcattagtattcatgattttcctttactgttttagccccccaacctttttttggtttaaaactcaggtggaactgttagtaatgatgaattttcatatcgttgtatggcactattgtgacacagccctttttagtggaaaaggaaacatatgaaagaaatatagaatatttgcatctcatcagaagcactaaaggaaatattaatgcaaatacatgcagaaaaacaaacataactagtatagtattataacatgtaaagacatggaggaatttcatccaaatattattaaaaggttgggaattgttatgctgtggattaggggttgacagttactgtagcttccatgataatcctgggaggctgaatttttgaaagctctctgaccctgctgaactagaagggctaatttgagaagggtatggtgtaaaatgtggccttttataggctgaaaacagggatttgttaagtggttgttgaatgaatgcatgccttgcattgttgggcaaagaagtgagggcattgcttttttcccctggagtaaggaatgaagtaaaaggtcattgagctttgtagagcacatatattcactaaatactaggttgatgagttgttgacttgaggataaagttattatgccagcatagaggaggatctgggaaaagctctaggaagggttcttggacactgaggaaaccttgaatatcaacaaatgtgcttttggatttggcagaaaggatagagaatagaggaatagtgtgaaaaaattatctactctttatttattcatcaaatatatttttaggtactttgataggccttgcaatacaagaatgaaacacccagcccctcttttcagggagaaaacagtttaaaagaaggtcactggacagtgtaatgagtgctgtaatggaatagtaacatgtgcaggtgctctggtcatgcaaaatgcgtcccctgaccagttaaaattttcttgatccagttttcctcaccattagtctattcttcctcctaataattatttttaaaagtaacaattttcagaagttaaaataaacctaaatgatcatgtagtttgttactgctcaaaaggggatggtccatggaataatggcatagcatcagttagagcttcctggaaaatgtggtcttcttagaaatgggctgcatgggctgggcatggtggctcacgcctgtaatcctaacactttgggaggccaaggtggatggattgcttgagtttaggagtttgagaccagcctaggcagcatgacaaaatcctgtctctacaaaaaatacaaaaagtaatagggtgtgttggcgtgtgcctgtaggaccagctacttgggagtctgaggtgggaggatggcttgagctcaggaggctgagcctgcagtggacggagatcgtgctactttactccagcctaggtgacacaacgagactctgtctcaaaaaagaaaaaagaaaagaaaagaaatgggctgcatatctgacccactgtctcaaaatctgcatttttaccatgcccacccgcccccctccccaacctggtgattcgttttctcattgaaactggagaagcactaatctggttcacctacttcccatccagttttacagatggaggaaatgaagatagattgtgctcctaaggtcctatgcacagtagcagagccagtgttagaactcagccagtcagctggtcatggtggcttcttactagtgcctctttccttctctcttttggaaattctctgttgaatgagagaacaacagtgcaccacactatatataaaaaagaatgaacatttttatttacttataatttgtggcatcagcaactcaggaggctgaggcaggtggatcacttgagccctggaggtggaggctgcagtgagccatgtgtgcaccactgccctctagtctggacaatagaatgagactccatttcttaaaaaaaaaaaaaaaaaaaaaaaaaaaacccagtcaccagtctacttactggtagggtcttgtgtgctttctctgatgcctctgttatttcctgtttctctttacttttttactcttctattggcctctattagtgtttcatattgtaagatcttcagcttctcactagtgtctctttccctctctcctgtggtagtcctctctttaaatttctctgttgaatgaaaacgatacagcataccacactgtacatcaaaaagaatgagcacttttacttactcttaatttctggcagaggtttggacctatttctttaattttttttttctacccgctactcagaactttctttgaagtcagtaggaattctgtgtgtggtaagggtgagagataatctatgatgttaggaattaaaatctcctcacagatacatttatcttcctttctttgttacatggagtatggcattaatcagagtacttttgctctttgtataagtctcatgggaaaaacagcgcctgccttaaagttggtggaaaagaacaggataccacagcaactccttctctgtgacctagaacagagagtttgtctaaatgtttcttctctaatatagggggtttgtctaaatctttttttttctataatatagaaaaagaaatacctaagtagatgcacacctcatgttttatagggggcctttagcatagaaagatatggtcatagaatgataatgaacataaaatgataaaatgccattaagaaaagtgaacagtcactgataagaccttcgtggcacaacgcctttttaacaaaagtcagccgtgctatcttttaagtcatttcctccttgtgagaagtttaccatctctcctgtggttcaaatatattggtttatttttaactctgaaatgtgtttgatttgagtgatatagccataatctctatgaatagtagacctccttttaaaactatgaaataaaatcagtttttctgttttcctggttcccatatgtgtttttctttcaagtcattatcacctttttttcccatatctcgagtcatcaagcaatagctcaccttcttaacaactctgatttcattaaaaccatagttgtgtcatttcctgactttgcaaattgtttgattaaatattgtgtttcgtatcttgtatcttactgtctattgacagtatatagacacagattaattttttaagtaaggtattttaatacctagttcactaatccagaagcattttgcatatacaggctttagtaaaaatgacagtttaaatagggagttattatgatcaacaattaagttaaattcatttaggttggttctaagaagttgaattttcttttactactttaaaaatacattatttcttcaaaatacgacataaaatgttttgcattgccaagaataaactagaaattagatttgcaaccttcaactgttgtttagcttttagaaatataaaaattaatattaatatatttttataatgtgttaaaagatgaatttttgttaatcccatccatatttcattatcatgcttgtttcagaaatgttttacttgtggcaacattccattataaaattgatttatggttgtgtatttgaatatgctggacaatcaattcattttaagtaaaataatgtgttgcattttatatatatagttacacatatgtaagttatgcgatttacagctctagagaaaaacattcaagttagttattcatgggaataaaataggtgcatgttctcaatgaaaaagttagaaaaatgtcttgaatatggtgactgtttacattatagaattgtaattaaccctaacttaatctctcagtgcccctgtactcttgtcttcagtgtctcgagatatttcagcaaatggctaccatcgccccgtacgtacctctccagttacattcttgcctgctttaggagtggacacacagagcagcctccaagctgccctgataaatttcacgtgtataatatggaagacaaatgtttccttaacatatttattttctgtgtatgaagtttttcattaacttttcatcccaagataaccacctctgtttttagtgcgctttatttcttgtttttgttctgtagggtctctgtaaaacataatgtgtgacataagtaatgaagcataattttcaaaagccacttgcaggagtcagtattgtttctttggtttttataccatgtattttttgttgggactcaaaggacagtgatccgtatttagtcaaattaggaaattaagttgaaacatcttgattcctaaaaagtgtattttataaaacatttactgattaatgaattttatggtattttgttctctctatagataagcgtgtggaaaattggcctctgatgcagtctccttggcctacactaagtataagcactctttatctcctgtttgtgtggctgggtccaaaatggatgaaggaccgagaaccttttcagatgcgtctagtgctcattatctataattttgggatggttttgcttaacctctttatcttcagagaggtatgtttttaagatcactttaataattttccaaggttattggaaatttaaaaatgagaatgtgtaaaaccatcattgtaatattttacccagacataactgttagctactctaaaagtacatttttgacatttttcacttttgaataacaaaaatattaaacatgaggtataggaaagttgtttaaagtggaattttgaataagaccaactggattctaaagtaacccttattagctgttctggcattgaaagttatttaacttttcttagcctcgttttccccacttaaatacctaccatctcaggttattatcggagtaaagtaagataatttttgcatagtgtttggcacgtattaagcactcagtaaacagtagcagctatttatttataattcttattcagtagtttctggtttggtaactgatcaaaatatgccaatttcaagtaaatcctattacataatgttgtattttgggctggaattaaaatgaattaactgccatatagctgttgttactaatcattatatacttttctgggcactagcaaattctccacaacattttcaaaggaaatcctaaaggctagattgacacagccattttttaaattgcatatgtataaagaatttgtttcctaagagactcattaaaattctgtatgaagccagagaactgactagtaatgctaggaaaataaacaataactcttcttagaaaaagaaatatttctttacttgaaaacttagcctcgagtctcaacttcatgaacactttaatttatttggatacctgtacctaatttgttagatgcaaaccactctggatcaaacatagaaaccagttaaggtaggacaactttgaaatctgagtcctagcaataaaaatttctcttaatactgtgaagtatttaatagatagagtcaatgttcagtataaaatttacatgtgatttttaatttagattttaattatagaacaaattaatgcacagtaacttctagcaatcggaatgcatgaaatttttaatgcatttgaaatttttaaagaaaatattgtgtttaaaataatttgaaaggctacattttgtatataattgtgtttttaatgctgtgtttactaaaactttactacaaatattattactctttttccagttattcatgggatcatataatgcgggatatagctatatttgccagagtgtggattattctaataatgttcatgaagtcagggtaagtacattaaaaatactcttaatcagtaaaagtggtttgatttttataggccccagtctgtgaaaatatagaatgtacttttttttaagagacagtttctttaacattcatttagagacagtttcttgctctgtcccccagactgaagtgcagtggtatgatcatagctcactgcagcctcaaactcctgggctcaattgatccttctgcctcagcctcccaagtagctgggactacgggtgtaccccaccatgcctagatatttttttactttttgtagagacagggtcttgctatgttgcccagtctggtcttgaactcccagccgcaagggatcctcttgcctcagcctcccaaagtgctgagattacaggtgtgagccaccacacctggcaaaatgtactttaatatgatagtgaaattatactagattgttatgagtcagtaaaactatgcttttttaaaaagtacttaatttaaaatttgtttttgtatctcaaaaatgttttttattttgcagcatgagtgaatatgcattgaattactagaatgcagtacttgttaaagcaaagaagtctcatgtttattttaaagacattattttagatttttgtttgtttgtttttgctcaagagtagaaactcttagagtccaagttatgtgttaagaaagtgaggaaaagtaaatgttttgtgaagtgtggaatatttaggaaattaggcatagaacaatttgtattggcataaactcagtttttttatatttgcagaaaaataaaacactagtaacaagatgttatattttattttccattcacttacatgagtaaaattaacattaagcaaaagaaacaacagattaccttattctattacgtatttattgaactcttcttatatactgtggttcatactagaaattacatataaaacataacatgttttatgttacctatagtatatgtagtaataatatctagtggcttcccttgagaaaaatagtttcctggcatggggagtggacaatatataaatatcagtattcatcaagactggagacaaaattggtttaatgtacttaacaattttatgtacgtatcttcatttccctattagaagacttatggactgatgaaaaatcacctgtcttggttgtcatgttggttttatttattcattaaatatgtattgagcatctactatatgttggtactggggacaggggtgaaaagccctgcctttgtggggctggcattttagtgagggtgagaaggcagacagcagccatgtaaacaaatgactaaggaggaaataaaacctagaaggtgactgagagaaaatgagagactactcagatgtattggctatgaaaaattttcttctgataactattgccaaagaatctcttcagttggagggctgacttcttgcttgccgtagggaagggaacagggataagtgtttgactgactgacttctgggagtatgcatagaaaaacccttgggtggggcaacatattactatttttaggataaaggtttaaaaataccactctcacttacagatgtaaattttcaagtctttaaaaaatgagctattatgagaactgtaatctaggaggataaagaacctgagatttgcaacagatttcatttgaaatcttcctcgtgctctcttctcctctctaatatgggatgcaatagagtgaatattttacgcagagactcatttctgtattcattgttacgtagccaagaagtatcactttttggtgtagtttatttaaagatatctagtgcagtttgcaaactaagcagacttatttgttgttattttatgtgaattgtggcaaatgtagaggtccagatagaggagaaataagagattgtatctttccttctagttaaaggttacgatgccaaaatggtgacagttactttattttaaagaactaatataatagtgaatattaactatagtgttgctgggagtagttaactatttcaagcttattttcaaccaattcatatcatttttaatgatatttttcaagtaaattcagtaaataattctcagtttgtaaatactttgtttcttatatgctttctgtttcttctttccccatactttaaaattataattttgtttttcaaatgcaaaagccaaaacaaacaaaaatctcatgacatataccaggtgcaggtataaaatgcaaagggatccttcaactctaaaacacctaagcctgtctgtgaatgaatctgacagggccctaacacatgaaagcttataaatagattttagttatgtactgccttaattgttatttgcacataggatgcttatcatagaaaatacttgacataaaaaattaagtttggtttactgttacagtaggattcttgtaaaacattttaaaacatacagaggtcacctctcactggatccttaatctcagtatgtaatgtaatctttctgtaccatctggtgccttaattagagcccaggaaaagaaaagacttattcatgtaagcaggattatatttatgacctgggaaatatttgtttgttcattccaattttttattttaaagatttaatacctaatacaaactgctgtgattggatatttatgttgttgcacatattggtgcagtcggagaggtgagggagagagggaggtgaggggagagggtgggcagacaggcagacacttgtagagaccagttgctacatgaacttacttgcaagtttttctgaggtagtataatgtaggctaagcatgaacaactaaaatcattttacaaagtaaacatcttagttcctctaccaagttgaaaagcacagcagtctgaatgtgcttccagctctgtattcagcagtttgacactatgtaacatctacctatggaatagacagaaaatgttctctaacttattggcactgtatagatagagctttggactctttcttttctatttttccccatggagagatgcttaggtttttcaaacctacttagccattaatgattccatgccttgtacattttgtgcaatatacaaatgtttattttggacttacttacaatgagtataaacccatacaatagtgtcattttggtgtttataacacgctttccctttttacagatagctgctgctctgtggtggtactttgtatctaaaggagttgagtatttggacacagtgttttttattctgagaaagaaaaacaaccaagtttctttccttcatgtgtatcatcactgtacgatgtttaccttgtggtggattggaattaagtgggttgcaggaggacaaggtgagcattttcaggaatatactgcttgcgtttaattgcatatatgtgttcagtggaaagcaatgagaacctaggactttgacttgatctaccatttaacttgctttcatggttaatcatttccatgttcatttcttttttttttttttttttttttttttttttgagatggagtctcgctctgtcaccaggctggagtgcagtggcgcgatctcggctcactgcaacctccacctcccgggttccagcgattctcctgcctcagcctcctgagtagctgggactacaggcacacaccaccacgcctagctaattttttgtatttttagtagagacagggtttcaccatgttggccaggatggtctcgatctcttgaccttgtgatccgcctgcctcggccttccaaagtgttgggattacaagcatgagccaccacacccagccatcatttcattttttaaaaaatttgaggcaagtataacttttgctttttatctgtgactactttaatacctaaagatttgccccagagatgagcataaaccaagactaaaggtagaaaacaatattttgatggggaacgggtctagtagttctgatccaaagaataccaagacacagcccctcaaatctgaagatttccatcttagcccatagctcactcctgccctaatacagattgaacatccctaatctaaacatctgaaatccaaatgctccaaaattcaaaactttttgagcaccagcatgataccacaggtggaaaattacacacctgacctcatgtgatgggtcacagtcaaaacacaagtgcagaacacactttattcagtatacctaagggaaaaaagaccctcttagcccttttccatgtacagcataatgttgatgccaaacaaccacagataatgtccacacgggtgacatctttgctttctgatgttcagagtacacaaactttgtttaatgcataaaattattttaaaattttataaaattaccttcaggatacatgtataaggtgtatatgaagttttggatttagacctgagtcctatccccaagacacatcattatgtctatgcaaatattccaaagtttaaaaaaatctgaaatcagaaacacatctggtcctgagcattttggataaggaatactcagcctgtataggtcttgttggttcttattcaaaggaaattttatatagccttgttaatgttaaagaggatctaaattcatagcttggccaagatctgcctcctgtcttttcagatgcctgtagattaaggatgattcacattgttgagcttgatgcagattattcctctgaggaggatccagggtacaagtcattatagtatagttcaccttgctgctttccattgtcatattatgataattggcagcttaggaattcatacatatattattgggggcccagtttaaaacaatacagttaaaggcaacttctgtaattttaaaagaaaattagtaaatctgaactgacttagatcactttatgacaaaaattaattattattacatctataccttgattaaattaatattctgaaaagaaagaatgtcattgagtttgactgactggaatatctctgtagatttatctatattaaatgaattattcaatgtgtgtagtgctgtcatattttaaactatttagaaacctaagaaataagtactgttttgttgcagatatatatattggcacatctaaaggcaagaatagtagaattaaaagtaacataggcaacagttctaagggcctatttaagctcactggagtactccatttgaaaacctacaactgtgaaagtcctttgcatttgaacatacatttttatttatatggtaaaacctcaaatctaaactttaaaaatatctagcttaatctgaagggaaaactttttcattagtactactttatatttttcatttctaatctgtactcaagattaaatattaaaaaataatgtgtattcatttattgtacatctcagtggcttactgcctaataaaattttctgtatcttgtaattacctgttgtttttctaaagcattttttggagcccagttgaattcctttatccatgtgattatgtactcatactatgggttaactgcatttggcccatggattcagaaatatctttggtggaaacgatacctgactatgttgcaactggtgagttaaatgcttccaaagtttcttctggtaaaatactgaaattgtttaaatttgattaattttaaagtgcaatgtcattttagacaattttctattatgaaattaactttatcctccagctatatcgcagttatgcccacttgactctagatgacctattcatagacttattggtcccagcaaatctttgtttttataatatgcttaaaagactagacatagcccttactcctctaaggaaaacattctctaaagatgtttgtggaaaggatgattaaagatctaagcacgctacaaagtacgtagtatgaatagaaaaataatatgtattttttccctacaggtgattttcttaacttaaaattttattacctttcttcatcttgtccttgcttaaaaattttgttttttatttcatttttcagtctttaacatatctcatatatttagactaaacagctgaaaagaaagcacatagccaaggaaggggtggggcaaaggaagggaataagggcaagagaactccttgtaattctctaaaacactgtccttaagagagcagagacagatattttcaaatggtggtctttagtccagacagttttcagcacatcccgctagtaagactgtttgtggcaatctgagtgtgtgcattagtgtacctttcagatgctaggcactagcctgtaatcaaactggaaattcaaagccaacctggtaactatttttcaagctttagaatttattataatttgctttaatcatagcatgtgcacaattttatcagtggaatcacatttggaaataatattcatctttgctttaagttgctaaacagctggctaaccaaacaggaagcacaacttttgggaaatgctgggtgcgaaggattcatttgtaaccggagtggtataggaagcttcctccagtttttgtgtaaaagctgttaacacagtttgtgtaattcatttctctcagtaagtagtaaatggacctaagaaaatgaagaggtgatcaaaatcatgtgaattagtcctatctggtttgttggagcctacacctggctctccttgagtgatgccatacccaatcacacccttatacacaccctttttggtgatgcagcttctaaaaaccattgtgaaaccacaagttcttcaaattaaaatatttgccaaggaaaattataaaagtttaatatagtataaatttttagcttacatggcatacattattttaatatttaaaataagtaatactgattattttaatcaataattaatattttaagaacaatgctatccttaaaagagaaaccacaattgtccatttcaaacaggatgttgagtttgtatttccaagccagaagttcccacaacagttagtcatataagttaattgtataaaaagttaacccttgttaacattatgtcttgacccattcttttattgatacatcagaatctatttcattttaatcatctcactttgggcttttttccttttaaaaattcttaaagttgaaagtgattctttttgtatttattctgaaatatctactaaattttatccaaatattatttttttctttttttgggacggagttttgctcttgttgcccaagttggagtgcaatggtgcagtctgggctcactgtaacttccgcctcctgggttcaagctattcttctgcttcagcctcctgagtagctgggattacagtcatggaccaccacacctggctaattttttgtatttttagtagaaatggggttttaccatgttggccaggctggtcttgaactcctgacctcagttgatccacccgcctcggcctcccagagtgctgggattgcaggcatgagccatcgcacctggccatcaaaatattagtttttaaaggatagtgttcgttcaaataaaaatttacctgcctactatctgtaagaaataaatgagccattttgataagctcattttaagtatgtgtatctgcttgctgacaatttgatagaaagaaaccaatgtaaaatgtgggaggaaaacaaaattgaagagcctacaatactattactttactctcctaggccattgattccctttcatcagataacattattcaacacatattcattgatcctgatgctgtgctgaggactcaagaatcaccgatgggcaagacaaagccctgccttctagagtcattttctagtggaaagataggcaataaagaaataacaaatacagaagacaatttcaaataggtataattctccttaaaaaaaatgcagaaagctctttggttaatgggattgggagggccaattgaaattgaagtcttgtcagagagtccttactgaggagatggcatttgagttgtgaatgaggagctagccatgggagccagaaaacaataaattttgcacagtgtggcaaaatttgggcctgtgatagctatgtagaagatgccgatgttgttaaaagttgtttactattcagattaaatgttttgtgctgtcatttctgtttttcagattcaattccatgtgaccattgggcacacggcactgtctctttacactgactgccccttccccaaatggatgcactgggctctaattgcctatgcaatcagcttcatatttctctttcttaacttctacattcggacatacaaagagcctaagaaaccaaaagctggaaaaacagccatgaatggtatttcagcaaatggtgtgagcaaatcagaaaaacaactcatgatagaaaatggaaaaaagcagaaaaatggaaaagcaaaaggagattaaattgaactgggccttaactgttgttgacagtgaggaaaaactcccatatcatataaaatttcagggaaaacagaagcaaaggagagcttgggggtggggagaaaagacaaatgtgctctatgtcctagtaactcttagactgagtaaagtgttaataccatacccagatgttttatttatgaagtttttattttaaacattttttttaaaaattagccttgatattctccagaccaaagcaatcattaagtgactttggggattctccccctgttcacatccagttgtctaaaggatgagatttttcatgtatcttatagtcactcattcttcggtctgaattttagacgatcacagaaacggtctttatgaattattttgataaattactaattatcttatctactgactgaaatcagtggtgttacattttcttgtccaaagctgaaaatgtgtatacacttaaacttgcacatttgaattcatttgctgaccggaatggtcaaatctctccacctctagtcagagtataattttggttgtaattaaatttttaaaatctgctgatctctgtagaatcttagaggcttgatgatgatggtgttggtgaaaataagaaagaattgcagtaaagtcttgtctggtgacccagagatcaccatgacttgaggcacaaatcactgtggggaaacaattttttgtgatgaaaaggcagcatttgaatactcctgttagtagcagaaatatattatgaaaattaagattattgtctgattgaaacatgaaacaactcatgtctttattagtaacatcataagatagttacatttatgtgctgttagaatatgttgatttttatcaggctttccttgttttgatttatggctgttcctgatttttcatatgtggaaatatacctacctcttccgttggaaagaacatttaaaattaaataaattttaattaaaaaatcaaggagtcttctaatgtaaattttaatgttaactttcaaatccactagtattttttttgcttttatgacaaatagcatacaccaaacatttctgtgaaactatccttctctttcaatgtgtttaattttggagtaacgttttccttgtgactaagttgcaagatcttatttattaactaggtatgaagtataaacccattttggtgcaatattcttgactccttggtgctaaagattgttaaattcaatgcttgatgttacaaggtgttgttaaaacacaaaatgaataaaagtgagagtagtcagaactataacattcaatttgctatttacaaatgaagtatttcatgtaatataagtgaacaactggaaataaagtaggaaagaatttgtatcatgttttactacataggttaattttttaagggatgttgcaaagggattactagagaaagacaaaatgtgaccaaaaaaaagcatgaatatttcttaagtatctcaacaacatgtcaaagctgcatgtgtaggatgtatgctgtttgtacaaactatttcagaatattttgtaagctataacatatttattgtgcattaaaattaaatactttttccccaaaggcatgcagtcatgagaattacagaaaatttgcaacatataaagtagtttgatctaagaggattcaacacctttgttttgttgctcagtgtgtaatgactgagatttgtaaatctttgtgaacattctgtactggttcccaagagctattcattccctgctacctgatttcagcacaataaatatacttctgctgtgggaaaaata

SEQ ID NO: 12 - DNA, 104680 bp, Homo sapiens
  source 1..104680: mol_type = genomic DNA
gtgctgcccgcctagaaagggtgaagtggttgtttccgtgacggactgagtacgggtgcctgtcaggctcttgcggaagtccatgcgccattgggagggcctcggccgcggctctgtgcccttgctgctgagggccacttcctgggtcattcctggaccgggagccgggctggggctcacacgggggctcccgcgtggccgtctcggcgcctgcgtgacctccccgccggcgggatgtggcgactacgtcgggccgctgtggcctggtaagtgcaggctctaatctggccccgttaattctggggcctcttgagagtggggctgtcttatctctatctccaaaaatgtgcaggtgactctcaggccaggccgacggcagttggagaattcccagatgttcttgaggacccagaatgacaggagccctggctgggcttacgttcggagccggcttcaatactggcccttttctctggccctacccaacccgaaaattctggacgcctctcaatcttggcccgtctctattgtccttttgtctctgccctttacacccttgtgtcttcagtgttctgtctgtctctggttgcctcttttgccttttttctgtcctctccctgccaggtttggctctgtccatgagtcacctctctccacatttctcctaactctcggtgtcttctttttcttccatttccacgccatgtgtacattgcatcttcaggtacctgggctcttctatcggggaaaggggcgtccgtctctttccctagcccgctgatagaagtcagaactagagcaatgacgcacacggtgtcagagacggtgattcgagatgccctttcaatagcagcttttttctgtgtttcgggagggagacttactttttgatgcaaggtcgtgaacgtggcaccacctttctaatctcaatcattgttgccctggggtggtttaattctaaatagaaaatcatagaaatcttttcatttctgtgcgttactatatgcattgtaatgagattaaattggattttataggaaattttgttctagtatcattagataccttcaagcttagctcattgttgcaggcatttgataggaagtaagatgcatcaagcaaaattggaaaaacgtggttttcctgaattaacttctaagcagttgttttgaattttttccagacctttttaagtggtatagataatttatcgtgtttataaggaatggaatgcattcgttagtttgtttttgttttgttttgagacggagtcttgctctgtcgtccaggctggagtgcagtagcgctatctcggctcactgcaacctccgcctcccaggttcaagcaattctcctgtctccgcctccggagtagctggaattacaggcacgcgccagcacgcctagctaatttttgtatttttagtagagagggggtttcaccattttggccaggctggtctcgaactcctgacctcatgtgatccaccctcctcgacttcccaaagtgctgggattacaaccgtgagccaccgcgcccggcccaatttgttttatataggttaactggagtccaaaatacagaactagatgagataacaatagttaacagtgttagtcagttagaattattgcataggtatttttaatctcatggaattttagtctttgagtaagttcacagcccttggtattaaagtaagttatttacaacccttgcatttctacttctcaatatttagtgaggaaacatatctgattttctttaaataaaaagagaaaagactgcagaagatagcattctctgttggagcaattaagatgtataagaagaactacaaagacggagttttaaaacaaactgatttataagtggtatttatttaattggctgtcattgggctaaattatttctaaagttaccatggatgccattgagtcatggcttaaaaatgtctcctggtgatggcacagtttagctacctaaagaagtagagatgtgggaagccagaagccccaagctctgcagtttttcttttgctatagttcctttgcatgttgtgaaagaatacagttaaattcctgctccctaacagatgagagcataagcatttctttgggcatacatatgtaaatacatgctcatggacatgtgaaaagatcaatactaacatttgggtgcaataaataattgtgtaaaattatttttaaaagaattacatattaggaaatgatatattgattaaaagtgatagtcaatgaacaagagagtagatttctgggggaaacctattttgcatcatacttgatttttagttttgactgaatattgaagtctatattcaaaattcttttcctttagaactgtaaaggcattgctgcattttcttctaatgtaattgtttattgctgctgagaattcttatgacaatctgattttttcatcttcatgattatcttgtttttcccttcatggaatctgttagggtcttgactttatcctttatcctaaatttctcaaggcttggaccaggtgtgggtttggttttgttttcttttgctactcatttgacttggcacactcagtgggcctttccctttatctttcttcatttctgagacgtttttctctcttattttttattatcttcctttcatttttcctgtcctttttctttctagacatctcttaggaggatagtggtcctcttagattgatatgttatgtccgtgatttccaaagtaagatttgtactcgtcgtctgttaaaaggaaaagcatacatataccctatgtatatatgcacacttttttatttttaaattatatatgtatctgtactaattatttacattgtaagtcaaccctaacataatcttaaaggataagatacaaaacatactgcatctagaagcttcagtactttcttcctgaatcccagtagatccttttgttcatcccacgggatgcattccgcccccatcctcccactccctttggataccacattaccacagctctgcatcacttaactttcctcttatgtttttcaccttttttttttttttttttttgcattttatgtcctggggaatttccttaattcatttcatggttttactgttgatttttttaatattggccatcgcaacttttcttttcttttcctttcctttcctttcctttcctttccttttcttttcttttcttttcttttcttaattttcttttcttttcttttcttttctgttcttttcttttcttttcttttcttttctttcacacaggatcttggcgtgttgtccaggctggcctcgaactcctgggctcaggtaatcctctcaccttggcctcccaaaatgccaggattacaggcgtgcgccactgcatttggcggcaacttaatttttttatttttatttttccttttagaggacacctagcactgagcattgcaacttttcatttccatgaacttttaagaaaactcttaaagacatgtttaattctgtacactttctattgttctttgattgctgtttttgaataacaacaaggagtacgccttagcattttgatggtatcctcttaatagtcgcaataatagtccccttggcgctctgtatactctcaagtcttaaatgttttgtatgcagctgtacgttgacagttgaatggtctcgctccaagtggatcagcaagaacataaagaatcatttaactggtacaggctgcggcttgtgaattccctattaacaccaaagaagacgtgtgagactccgtactgaaactaaagacgacttgtgagttccacactgagatcaaataagtctttatgatggtgacagagagtggtgtcaacgcctaaagttttggttaatctctctaaattgaggggctgaccaaaagggggaacttaactgtattagacataattttgagaaacatgggtatgtggatggtaatggaggaaatgggtgtagatgagattgcctagggagagtgagaagtaggttaggtctaagccttgatgagttcccaacatttccaagggtagttgaggatactgaaaatgagtggccagtgagatagaggtaaagctagagactgcccaggggagaggaattttcaacaatgaggaggtgtcaacattgtcaggtattgctgagaggtcagataaaaccagaattgagcaaaatggccattggaagcctatggtgccctccgtaagagctgtttcgctgaagtgatagaaacggaaatcaggctgggcacagtggctcactcctgtaatcccagcactttgggaggccgaggtgggcggatcacctgaggttaggagttcgagaccagcctggccaacatggtgaaaccctgtctctactaaaaatacaaaaagtagccaggtgtggtggcaggtccctgtaatcccagctactcaggaggctgaggcaggagaatcgcttgagccccagaggcggaggttgcagtgagcagagatcgagccactgcactccaacctgggtgacagagcaagactccgtttcaaaaaaaaaaaaaaaaaaagaaatggaaatcaggatggtttggcttttattttaataaaatagctagagcagggaaatggggtactttttttcccccttttaagatgagacatagccaggtgcagtggcttacacctgtaatcccaacactttgaaagggagggtcgcttgagctcaggagtttgagaccagcctaggcaacatagcaagaccttgtctctactaaaattcaaaaaaaattaactgggcatgctggcacacacctctagtcccagctatttatgaagctgaggcaggaggatcacacttgagcccagatacgtggggctgcagtgagccctgataatgccattgcactccacgttgggcaacagagcaagacttcgtctcaaaaataaataaataccctgtctcaaaaataaaaaataaatatgggaggagagatttgacttagattcctcaaagggcaggaggaaagagaattccaaacagtgattcacctttaatgggagaaagatcgcttaattttacatgaggaagaagaggattggtggagatacagtaggtgaacagtttttgtatgaggaagttgaacatgtgtcattctaatagcttccattctctgtgaagtagagggcaaggtcatctactgagagttggggaggtcaagagagataaggggagattagaagagctcttctagcagagagtggaagaatgaattgctaagagagatgaagtaggattgttaagtagttttgagggccctgttgagatgtgcttccagttgggtgtgattttctccagtagtgctttatttccctgggtacaggcagagagaaaaacaataaggctcatgtagggtttgtattttgttggacaagtcaaacagaaaagtcagaggacgagggagtttagaatgtttgcaaaagagttattgaaacgatgaaccgcataatctaaggtggtaagtgggtgaatagataaggaggatgtgaataggtaaggagaagaaagaaatatcagattattgattattgatggcgactctctaatacagctattatgccattttaaccgattaagaaactaaggctttagaaaattcataatttgccctaactgcacagctagtaagcagtggaaatgtgattggaaccagagttcttctgactcaatagactaaatggatgtaaggatgtagttgaaagaagggtgagctaaacgttgtggaaccatgagctctttctctggttgatatccctctctgtaagtgataacatgggtcacgctggataaaaccttgtggtgattggtgactttcctttgtccttcctcctgtgcctagtctggcgagtatctgcctttccctttcctttctcattgctgccacctaactttaggctcttccccttacatctgggtaactgaaataagatcacctttttgttccccttctgatttactttgacctaacattatctttactattttctttaaattaatgtttcattagtcttattctactcaggaactctgtagttccccattgcctacgaaaaaaagttaagcctcagccttatattcagtgactcttcaattggatattcagtccagttttactcctcctatgagccttctatgccagctccttgggtctcttgccctttcattgtctcagctctgcacccttctttctcttttttattcttttttttttttgtacttttttggttttctttttggtttctttttttgttttatttattaaacctccatcacacttcatcctatggagttttgaaccacagcaaggtgcagtatcatcctggggctctggaggaagtggcagggagtccaaaatgtcaccttagcttcttatctggggccacatgtatttctgcatctgctgcttcccacactcttgcccacaagtgtcgcttgtggaaataatttgagatttactgtctggctgaccctagtttcaatctcttttccaccatttgctaatcattctaccttgggcaaaacatagaattaaaagaaaacttcagacaagttaaatttgatggagtttaattgagcaaagaaaaaaaatgatccacaaattgggcagtctccagaatcaccgcagattcagagagactccaggggtgcctcgtggtcagaacaaatttatagacagaaaaggtaaagtgacctacaggaatcagaattgagacatagaaacagtgagattggttacagctcggcgtttgccttatttgaacgcagtttgaacactcagcagtctatgagtggttgaagtatggccgctgggattggccaacactcagctgttattacagatgcatactactaagttaggttttcgattttgtctgcctatttgagctaggttacagttcgtccacaaggactcaaatataaaagtacggagtcctcttcgggccatatttagttcgctttaacaattcccccttttggtcagcccctcaatttagagagattgaccaaaactttaggcgttgacaccactctctgtcaccatcataaagacttatttggtctcagtgtggaactcacaagtcgtctttagtttcagtatggagtctcacacatcttctttggtgttaatagggaattcacaagttgcaactttgtaccagctaaatgattctttatgttcttgctgatccagttggagtaagaccattcaactgtcaatgtacagctgcatacaaaacatttaagacttgagagtatacagtgcaccaaggggactattattatgactgttaagaggacaccgtcaaaatgctaaggtgtactccttaataaaagttcttatgaaatgaactgaaccaaatcagccaagttaaggttcagacaatataagcagttcagcagtattggggtctgattggtcagagtcttcagttggagtatgatagtgattaaggatcatagttcgctgtaaagtagcttgacttaaagaggtgctcgttttcattgttaccttgttaatacaagtcataataacttgaaaacctgctagaagagatataaagattagaaacccttggaaaacccaagcttgccattcaccacttaggatgcctgcaaaccaactgttagttgctcctataaacatatcgtgggttcctttctcttgagagatttctttattgtacttggtggcagtgtctaaggaaacagcagtatcagccaccttttaaattaagctttttgtagtaacagaatcaggggagggattagtacaaaattcagttttgtttaacaccaaacataggcctccagcttgagcaaaaagaagatctaagactgcatgatcttccattaagtgttttcgttgaatatgtatgttgtcatgtgcctttctgagagtagcttctacccatctgaaaccctgggaggtctgattggctaccaaatccaagaattttcccaatatacaaattagttttaaattccgtacaaatggtacttcactaccaccaagagtgagcccccaggaaccccagtggaatctttccccggtagaaactagcttatcctcgtctatttcgaggctagtgctaatttcagttattgatcattttggcctccaagtataagggctatcatgagaattttcaggggaagcaattcgaaaggcaggagcaggccaggccagataacaagaaccaaaccaaccaaggaggcagaacagaatatgcagattctccacagacccaatagagaccctcaggggttggaaaagggggccacctagttgtatttgagcagggatcattcaggtttgttcgaccatgaatctgtagctcctgaataacatccagtgggaaatttacttttctatggcccctttgtagtgtgttgtaagggtgtataaccacatctagtaaaaagagaccctactggatatacaagcaatcacttgtactaacataagtaattcccaaatcttgagtatgtgatgcctgcaagcacaatatacgttttgtaggcatcatttggatttgttttttatatttggtgtgatcgactttatcagttgaaaaagagtgttgtttttagtgagtgtaggaaagcaagtactagtgatgtttagagtatcaagaatagctttccattcttcccttggggtttcagggtgactcattgggaaacgtggaggggcactggcacccttggaatcatttcctgattttttggcattagcccacaaacccaacagttaccctggttttgtgctagagcataagcttgagctgaagccatccactgattatggtcccatggattttcatgtaaggaaaaggaaaggattagggaaaaaaataaggaaaacagaaaaacacataaggctttcatggtggtagagaagtcttgatctgtgatctagggaaagctgtctgtaaccaggatgctgtctgcttctgggaagagatttccctggtcagctttaccttaaagtctccaacgggtatatagtaccaggagtctgagggggcccttttgaattgtgagatgtggacccatggttcaaagccctgaagcttctctgcactgtgggtggtaagaaggacttggtatggtcccatccaacgaggttcaagagtgatcttcttctgatgtcatttccggaaggcccagtctccaaattccagaccatggagggtttgattgtcctcagttggtggatcttgaaatgcttcctttacctggtggaagtatactttggcgtaatacattaaagccttgcagtatttagtcatatcagagtttaagagagcaggagaagcatgagatgctattattagggacatgggcctcccagtgactatttcataaggggtcaatttatgttttccaacaggattgaatctgattgccattaaaaccaaaaggtagtacctttggccaaggcaactcaattgattcagttaacttggacagtttcagttttcaaatgccatttgttctttcaagctttcctgaagactgagggtaataaggacaatggtaatgcaactgtgtcagtaacaccttatttaactgctttataacttgctcagtaaaatgagttcctctatcactggagacttttagagggatcccccataaaggaaaaacattttctaataatttcttagctatggtcacagcatcagctttcctacatgggaaggcctttatccaaccagaaaacatgcaaactattacaagaacatactgataccccattgagggtggtaactgaatgaagtccatctgtaaatgttcaaatggtccatcaggtggtggaaatatactgcctctagtttttctgggattatgagtttgacaagtcaaacattgattataagccattttagtaatgtcagaatagtcaccccaccagtattttttcataatttggatcactttgtctgttccatgatgagctgtggagagctttcaataatggaagcttcaaagattcaggaaggaccaggcggccgtccgggccctttgtgagtctttgcttcacgttaaatttacatccttttagataccagttttgtttttgcaaatcagatgcgttgcactgtttattaaataggtcatcgtaaggaaattggcttggattaatcttatggagttcattcagattgcgtatcttgatggttccagcactagctgattgagcataaaaatctgctaaagcatttcactgatatttgggttcatttctacaagtatgagcttcagtcttaataacagcaatctgcatttgtaacaggatagcagaaaggagctcatctgtttggagtccatttttgatggggatcccactagaggtgagaaaccttcgtagtttccatatcatgccaaaatcacgtactactccaaaagcatgtctactatccgtaaatatttactgacttgtccttagctgtgtgacatgttcaggtaagggcagaaagttctgcaggttgggctgacttgacttgaagagttcgcttctctattaactcattttgggtggtaacagcatatcctgactgatatttttttttctgagtttttggcataggacccatcaacaaaaagtgttaattcaggattatccagtggagtatcttgtatagcaacacgaggggccactatttctgatactacactcacaccgttgtggtcttcaccatcatcaggcagagataacagagtagcagcattaagtagattacagccttttagatgaagataagaaggagataggagaagtaattcataagatgttagtctactcactgaaaaatgctgggtttgattggaatttaatagactttccacagcgtgtgggacttgcaaattaagttcatttcctaaaaccagatctgatgaagcttctaccagcttggctgctgctactgcttttaaacaattaggatatgccttagagactgggcctaattgcaggctatagtatgcagtggtcctatgtttagcaccgtgttcctgattattacattcatgaacaaacaaagtgaaaggtttagtgtaatttggaagtcctaaagctgggggctgttgtaaggccaacttcatttggctaaaagcctgctcatgactgtcttcccaaggtaaaggctctggtacagcatttttagtgagctcatacagtggtgaagctattaaggaaaaatttggaacccaggatctgcaatatcctgcaagcctaagaaagccttttgtcttttggttgcaggtcgaggaaaactttaaataggttttatcctctcaggtaagagggaaatcccttcagcagccaagtcatgtcccaaatagtggactttttcttttgaaaattgaagttttggccaggcatggtggctaacgcctgtaatcccagcactttgggaggctgaggcaggcggatcacctgaggtcgggagttcaaggacagcctgaccaacatggagaaaccctgtctctactaaaaatacaaaattagccaggcgtggtggtgcatgcctgtaatcccagctactcgggaggctgaggcaggagaatcgcttgaacccaggaggcagaggttgtggtgagccagtatcacaccattgcactccagcctgggcaacaagagtgaaactccatctcaaaaaaaaaaaaaaagaaaaaagaaaagaaaaaattgaagtttttccattgaagccctgtgacctttatatgcaagttgctgtaaaaggtaaactgagtcaatttccgggcactccttaataggagagcataacaataagttatctacatactgaatgagagtagaattttgaggaaactgtagtgtcattaactcctgatgcagtgcctggggaaaatatgaaggggcttcagtaaacccttgtggcattacactccaggtgtattgctgatttttccaagtaaaggcaaacaagtattgactttctttatggaatgctagagaaggctgagccaagatctattactgtggacaacttggaatcagtgggtacattaggttataaagtattaggatttgggactacaggaaatcttggtattacaattttattaattgcctgtaaatctggaacaaatctccagtctcatccattttgttttttaactggtaggattggagtgttacaggggctggtgcatggaattatgagtccttgtttaattaaatcttctacaattggtgagagcccttaaattgcttcaggttttagtggatattgtggtaattaggcaaaggtttagaatgatctgttagtacttttataggttctacacttttaattcttcctatatcagttgggaagaggcccataaacattaggtgttttcgaaagatcaggggtattacaggcttgagtttcgatcttatcaatttctgcctgtagacagcataacaattctagttcaggagaatcaggaaaactcttaagattatttctgtttctgaggaaaattttaggtgcccttttagctttgaaagtaaatcttgccctaccaagtttactggaacagtatcacgtagtaaaaaactgtgtttttctgaaagggggctcagagttaattggatgggttcagatatgggaacctctggaacttgatttgaaacccctgtcacagaaatgacctttttactctaagggatttgttggcttattaaggtggggtttatggtagatagagtagccctggtatccataaggactatacacaactccctatttattttaacctctgtttccccatgttcctttaaaggtattacggggagcaatccactggagaatcccttagagcctcctttaagttgaatattgtcaggaggactaaggtctcttgggctccctctagtggtgaaacagtttggcctagagggaggtttatcagccgacaatcccttttccagtgccctggttgtttgcaatacaggcagacatcttggggtaaagaaattcttgttctgggacctcttgatttgatttttttaatatataattttaaaaatattttccaaagtgtgacttaaaaaaatttttttttattatactttaagttttagggtacatgtgcacaacgtgcaggtttgttacatatgtatacatgtgccatgttggtgtgctgcacccattaactcatcatttacattaggtatatctcctaatgctatccctcccccctcccccaaccccacaacaggccccagtgtgtgatgttccccttcctgtgtccaagtgttctcactgttcagttcccacctacgagtgagaacatgcggtgtttggttttttgtccttgtgatagtttgctgagaatgatggtttccagcttcatccatgtccctacaaaggacattaactcatcattttttatggctccatagtattccatggtgtatatatgccacattttcttaatccagtctatcattgttggacatttgtgttggttccaagtctttgctattgtgaatagtgctgcaataaacatacgtgtgcatgtgtctttatagcagcatgatttataatcctttgggtatatacccagtaatgggatggctgggtcaaacggtatttctagttctagatccctgaggaattgccacactgacttccacaatggttgaactagtttacagtcccaccaacagtgtaaaagtgttcctatttctccacatcctctccagcacctgttgtttcctgactttttaatgattgccattctaactggtgtgagttggtatctcattgtggttttgatttgcatttctctgatggccagtgatgatgagcattttttcatgtgtcttttggctgcataaatgtcttcttttgagaagtgtctgttcatatccttcacccacttgttgatggggttgtttgtttttctcttgtaagtttgtttgagttctttgtagattctggatattagccctttgtcagatgagaagtttcagaaattttctcccattctgtaggttgcctgttcactctgatggtagtttcttttgctgtgcagaagctctttactttaatgagatcccatttgtcaattttggcttttgttgccattgcttttggtgttttagacatgaagtccttggccatgcctatgtcctgaatggtattgcctaggttttcttctaggatttttatggttttaggtctaaattaagtctttaatctatcttgaattaatttttgtataaggtgtaaggaagggatccagtttcagctttctacatatggctagccagttttcccagcaccatttattaaatagggaatcgtttccccgtttcttgtttttgtcaggtttgtcaaagatcagatagttgtagatatgcggcgttatttctgagggctctgttctgttccattggcctatatctctgttttggtaccagtaccatgctgttttggtgactgtagccttgtatagtttgaagtcaggtagcgtgatgcctccagctttgttctttggcttaggattgacttggcaatgcaggctcttttttggttccatatgaactttaaagtagttttttccaattctgtgaagaaagtctttggtagcttgatggggatggcattgaatctataaattaccctgggcagtatggccattttcacgatattgattcttcctacccatgagcatggaatgttcttccatttgtttgtatcctcttttatttccttgagcagtggtttgtagttctccttgaagaggtctttcacatcccttgtatgttggattcctaggtattttattctctttgaagcaattgtgaatgagagttcactcatgatttggctctctgtttgtctgttattggtatataagaatgctctcttttgttctttgttagtcttgctagcggtctatcaattttgttgatcttttcgaaaaaccagttactggattcattgattttttgaagggttttttgtgtctctatctccttcagttctgctctggtcttatttatttcttgccttctgctggcttttgaatgtgtttgctcttgcttctctagttcttttaattgtgacgttagggtgtcaattttagatctttcctactttctcttgtgggcatttagtgctataaatttccctctacacactgctttgaatgtgtcccagagattctggtatgttgtgtctttgttctcattggtttcaaagaacatctttacttctgccttcatttcgttatgtacccagtagtcattcaggagcaggttgttcagtttccatgtagttgagcagttttgagtgagtttcttaatcctgagttctagtttgattccactgtggtctgagagacagtttgttataatttgtattcttttacattttctgaggagagctttatttccaactatgtggtcaattttggaataagtgcagtgtggtgctaagaagaacgtatgttctgttgatttggggtggagagttctgtagatgtgtattaggtccgcttggtgcagagctgagttgaattcctggatatccttgttaactttctgtctcgttggtctgtctaatgttgacagtggggtgttaaagtctcccattattgttgtgtgggagtctgagtctctttgtaggtcactcagggcttgctttatgaatctgggtgctcctgtattggttgcatatatatttaggatagttagctcttcttgttgaattgatccctttaccattatgtaatggccttctttgtctcttttgatctttgttggtttaaagtctgttttaccagagactaggattgaaacccctgcctttttttgttttccatttgcttggtagatcttcctccatccctttattttgagcctatgtgtgactctgcacgtgagatgggtttcctgaatacagcacactgatgggtcttgactctttatccaatttgccagtccgtgtcttttaattggagcatttagcccatttacatttaaggttaatattgttatgtgtgaatttgatcctgtcattctctcaacatttgcttgtctgtaaaggattttatttctccttcacttatgaagcttagtttggctggatatgaaattctgggttgaaaattcttttctttaagaatgttgaatattggcctccactctcttctggcgtgtagagtttctgccgagagatcagctgttggtctgatgggcttccctttgtgggtaacctgacctttctctctagctgccattaacattttttccttcatttcaactttggtgaatctgacaattatgtgtcttggagttgctcttttcgaggagtatctttgtggcattctctgtgtttcctgaatttgaatgttggcctgccttgctagattggggaagttctcctggataatatcctgcagagtgttttccaacttggttccattcttcccgtcactttcaggtacaccaatcagacgtagatttggtcttttcacatagtcccatatttcttggaggctttgttcgtttctttttattcttttttctctaaacttctcttcccgcttcatttcattgatttgatcttccatcactgataccctttcttccagttgatcgaatcggctactgaggcttgtgcatccgtcacgtagttctcgtgccttggttttcagctccatcaggtcctttaaggacttctctgcattagttattctagttagccgttcgtcgaatttttttcaaggtttttaacttctttgccatgggttcgaacttcctcctttagcttggatagtttgattgtctgaagtcttcttctctcagctcgtcaaagtcattctctgtccagctttgttccgttgctggtgaggagctgcattcctttggaggaggagaggtgctctgatttttagaattttcagtatttttgctctgtttcttccccatctttgtggttttgtctacctttggtctttgatgatggtgatgtacagatgggtttttggtgtggatgtcctttctgtttgttagttttccttctaacagtcaggaccctcagctgcaggtctattggagtttgctggaggtccactccagaccatgtttgcctgggtatcagcagcggaggctgcagaacaacgaatattggtgaacagcagatgttgctgcctgatcgttcctctggaagttttgtctcagaggggtacccggccatgtgaggtgtcagtctgcccctactggggggtgcctcccagttaggctattcgggggtcagggacccacttgaggaggcagtctgtctgttctcagatctcaagctgtgtgctgggagaaccactgctctcttccaagctgtcagacagggacatttaagtctgcagaggtttctgctgccttttgttcggctatgccctgcctgcagaggtggagtctacagaggaaggcaggcctccttgagctgcagtgggctccacccagttcgagcttcccagctgctttttttacctgctcaagcctccgcaatggcgggcacccctcccccagcctcgctgccaccttgcagtttgatctcagactgctgtgctagcaatgagcgaggctccatgggcataggacccgctgagccaggcgcgggatatagtctcctggtgtgctgtttgctaagaccatcggaaaagcgcagtattagggtgggagtgacccaattttccaggtgctgtctgtcacccctttccttggctaggaaagggaattccctgaccccttgtgcttcctgggtgaggcgatgcctcgccctgctttggctcatgctcggtgcgctgcacccactgtcctgcacccactgtctgacaatccccagtgagatgaacccagtacctcagttggaaatgcagaaatcacccgttttctgcgtcgctcaagctgggagctgtagactggagctgttcctatttggccatcttggaaccgcccgattgtgatttaaaatgagaacgagatggtccctttggttcctggtccctgtaactgttgcaattgaaggggcataagcttattagccttttgaggttttttttgctctagagtcttctcaaaatgcttagctaggttgggcacgatggctcacgcctgtaatcccagcactttggaaggccaaggtgggaggatcacgaggtcaggagatcaagaccatcctggctaagatggtgaaatcccatctctactaaaaatacacagattagctgggcatggtggcacacgcctgtagtcgcagctactcgggaggctgaggcaagagaattgcttgaacctgggaggcagaggttgcagtgagccgagattgcgccactacactctagcctgggtgacagagcaagactccacctcaaaaaaaaaaaaaaaaaaaaaaaaagttcagctaaggccaccaattcagtcacatctctaacttcccattgcaacttatgttttttagttaaactgctaagttcaggatggagtccatttataagtaaagcagttaatgctgtttcagcccctgcagggaatactccttgctgtactttgagcccaggatgtttcacaaatatttctaagcgacttctgtaatctgaaactggttcatcttttcttttcttttttttttgcttacaagattgtatgatggaccaattttttgtggaaaaattttaggaactgaatgttaaaaggttttcagcgatttttctagctatttttggtccttcttgtgaggagctcttagagggccctttaaaatgtcctcctcaggtttgtcccattctgctgctgccatccatttctgagcttcaccagcccccagtatcatatgaataaattggtaaattcatgaagtcctggatcgtaagctcctattaggattctaaattcctcagtaaatttttgagacttttcccttggaccagggaagtccttcacaatggggctaagctcagttttagaccatggagtgaaagtagttacagcaggcaggcctggctgatataaggtctcactttgtaagacatctgtctaacttccttttttttttttttttttttttaaatcatcttcagggtgaaagtgtaatttaacaaaaagtttagtggactcagagtatgtaggtagagatggacaaagaaggaacagtccgagttagatcagtcaaagtacagtcctctttcttcatgtccttggtctgttgcttaagcttttcatttggtttttgcaaagaatcttttaaggaggcactttttgattcacttagtcttttggaggcctttgcgtatccatgagacaatacatcccactgtatttgtgggggctttgatcccctttttctaatatgccttgcaaacaattttatccaaattaaaacttctccattgtggccattttaattctaagttttctttagtgaggttaacccattttactgaaaatgcacatgttctgggcccataatttttatacgtaaaattagctggagtccctgaagatggagtcccagactccttggattgagatgatcccattattaaataaggtacttatcagaggtctgaggcctctaactgaatccaatccagttaattatcaaatccaatttgatcttggatccagtccaggctaagtattgcttgagtaaactcggagagctcaaaacacaagttagtggagctcggaatctgagagaaaactcacccatgacctccagttacaatcaagagaccagtgagagcaacggcctcagtgggtacctcaccaggtcacctggtgttccagggggttgccagagtttttcttcaaatcccacttctgacaccagatctgttaaaagaaaacttcagacaagttaaatttgatggagtttaattaagcaaggaaaataaacactttgcaaatcaggcagcctccagaattgaatgcagtttgaacacttagcagtctattagtgcttgaagtatggccactgggattggccaacactcagctattattacagatgcatactactcaggttttccattttgtctgcctattgtgctaggttatggtttgtccacaagaacacaaatatagaagtatggagtccttctcaggccatatttagtttgctttaacaatacttaaaaaaaaaatttgtaaaataaggatacttaaccttactcggtgtttctgagagttaacatttatatagttatgctgtagtgaaaacagctagcgtaatgtctggtatgtataggaacacaagagataccgcttttcccatatccccataccattcttcacagcattgctcctgtcttccttgattcctcctcctccttctttgttttttttttgtttgtttgtttgtttttttttggaggtggagtctcactctgttgcccaggctggagtgcagtggtgtgatctcagcttactgcaacctctgcctcctgggttcaagtgattctcctgcctcagcctcctgaatagctgggattacaggcacacaccaacacactcagctaatttttgtatttttagtagggatggggtttcaccatgttggccaggctggtcttgaactcctgacctcaggtgattcacccacctcagcctcccaaagtgctgggattacaggtgtgagccaccacaccctgcctccttcttaagaagtttccagtcccttgtaattaaaggaattaatattttttaactacttagaatcagactggccctgattattagtaagcaactaatagtaagcaagcaactatgtatgcaactatgagtgtatgttaagatatggttgttggtaacctttcattctcttcaggaagaagaagagggtggagctctacagtcaatgtgtacatttaaattctgttccctttcgagcttttttgctactttcattcttctggggatccaggtgcttgagttgggattgattaacttccttaatttccacccctgtgctgtcaggatcgggagacatagatgaaggtgttctaaactgctagaaattttgtttttgaaagcaaaagtttgcatgcatttttgttttcaacttttacttacagtgaatagtagttaataaaataagtccctgccttttctctctttggtttcaattcctgagaccaggatcatagcccacatattagagtggagtcccactgctttggtttgaatcatgcctttgtttcttatgtcagtgtgactttgggcaagttatttaagtctttgcaccacattttcctcatctgtaaaatgaggataatactagtactttctacatgggattgttagcaggattaaatgagatagcacatactgtaaccatgtctggcacatagtcaatggttagtaaatgtgaactattgtgtgacattgtggttagtcacgtatggggctgtgtttcctttagtatattgctcttttaatgtcatttcctttgtactgttaccctctctgatctttcttccatattcatttttctttcagtgaggtctgccagtctttagtgaaacacagctctggaataaaaggaagtttaccactacaaaaactacatctggtttcacgaagcatttatcattcacatcatcctaccttaaagcttcaacgaccccaattaaggacatcctttcagcagttctcttctctgacaaaccttcctttacgtaaactgaaattctctccaattaaatatggctaccagcctcgcaggaatttttggccagcaagattagctacgagactcttaaaacttcgctatctcatactaggatcggctgttgggggtggctacacagccaaaaaggtgaacttgacattcctcctggttttccaattattatatcatgattaagtttctatagcataaatcatttttgtgtagtggaatacaattggatgtttaaacatttattttgtgtctctaccatggactagattgttttaatgatgctaataggaagatgcctttagaatcttagttataattacaggaaattaaaatggcctagtggaaggagcacagggctgggaataggaacacctaggtttgattttgagcttagacatttagtagcacagatgtgaaagtcaggtggcattctcacacaagcacttcttggcaggtctgggaccagaggcaaggcgtcctgtctcccagtctgtcttccttctaccccacagtaatatttagggcaaaattatgaaacctgtttgaaataggagtatattctgaatttttacattttccatatttaacagaggagtgttaacttgttttatatgcttgtttgctgagaccacttaattttgtttcttaaaagttttgaacataatacattattcttagtagattaatgtgttttaattaaataatttttctttacatgtttatttggcatgcagagcatctgattgacacactttcttgtcttttagacttttgatcagtggaaagatatgataccggaccttagtgaatataaatggattgtgcctgacattgtgtgggaaattgatgagtatatcgattttggtttgtatcatgaacattaaaatactttttttggtcatctcgaggaaagagaaatagtttattgagatagtttcttaacttatgaacctaatatatcacggttttattttaatgatataagtaatagaatatcaatgaaaaaatctgtataaaagaaatacccagtagcccataattttaccacagctgccactaactgtttggagcattttcttttaattatacttactatatgtggttagtatctttttaacttatcgattgagacaggatcttgctctgtcactcaggctgaagtgcggtcttggaatcataactcactgcagccctgaactggctaaagtagtccttccgactctgcctcccaagtagccgggactacatgtgtgtgccaccatgcccgactgattttttaatttcttgtagagatgaagtctcactatgttgcccaggctagtctcaaattccttagctcaaacctctcacctcagcctctcaaagcactgagattacaagtgtgagccactatgcctggcttgagtttttttcttttaatttttttcttttcatgaatactaccacagaatagtattttagttccctttttaaaaattatgtaatcatggtgaatattcactttggtattttgtcttttgctacctaacatattttgtcagcatttccatgctgccaagtagcctttctattaataatatcattttctgcattatgtaatgttgcccagagcatatttattgtgacccacctagctagctccttttgattggataccttggttatctctaccttttgtagccaagttctttaaaagtctgttagtatccagggtaatttcttttcttagttggccactgccctccctttttcaataggtggatgagaaaaaagtatattggatcgctatgattgccagtaattcatggtgatctttaagaaatatattttcatcaaatttttttaaaacctttgtcagatttcttagtttaggtgtatgtggaggtggaattaatctatacttgcacttattcacagaatttataaagataaaactgttctatgttgacgaatccatttgcaaaaaaagcacactttcaaattgttcttctaatattaatgaggagagctttcaaattgatgtatttgccagtaccacagcgtagtggctgagagcctgtattctggagctggactgcctgggctggaacccgggctcctccacttccttgctgtgtaccttagtttctcatctgtaaatggtgttgataatagtagctgttttgtagggttgtcatgaggattaaacaagttaatactttagccctttataagaatagtatctgacatattttcttagtttcatactctatatgttttgatcttttccagagaaaattagaaaagcccttcctagttcagaagaccttgtaaagttagcaccagactttgacaagattgttgaaagccttagcttattgaaggacttttttacctcaggtaaggaagaagctgtttgatctaatttaaaaatttaagaaccatggaggaaaaatacatggattatttgtttattcccatttttttaaaattaaaatatttagtaccaatgaaaaacaggacattttttaaaaagataaacacaaagttttgttacacaatggttttaatctttgtgtagcccagtaaaatgacagttcctaagcacttaaacatacttggcttttagtgaggggaaaaaatgtatcacttgttcttgacaagtagatgagacttcctatgtatttgcttttcataagtggttggaccaatttggtggttttaaaacaaatttaagtatgatagaccataatgagtagcatttattaagtttaatcctggcatatttgcccaattattgccctatcgtaatatgaaatctgagatctcagacatctttgtttgctcatttctgttaaattttacatttctatttccccttttgctgatttttcacaggtcacaaattggttagtgaagtcataggagcttctgacctacttctcttgttaggtgtgtaaacagacatttttgctgaccttaacatgccttttaaatgcttctaataaactagttgcaaataaaattgcagaccaaatttataatgctgcttatgctgaattttaaaaccccagaactatattaggcaaactcattatcctttaggtggaaataataaaataattattttgtgataacactaaaattcttaaatatgtatgtgtattataagattaaagctattaaaagaaaatttacttagcaaaaatattttcttgaaatagatctaattgtttttgataattgaaatgaaaagtaattttagtttgtctcatctgccctgtcatggttgacatttaaatttgttttccggccgggcgcggtggctcatgcctgtaatcccagcattttgggaggccaaggcaggcggatcatgaggtcaggagatcgagaccatcctggctaacacggtgaaaccccatctctactaaaaatacaaaaaatttgccgggcgtggtggcacacgcctgtagtcctagctactcgggaggctgaggcaggagaattgcttgaacccaggaggcggaggttgcagtgagccaagatcgcgccactgcactccagcctgggcgacagagggagactctgccccccacccccaaaaaaaaaaagaaaagaaaaaaaaattgttttcctgctatacatggtctgtaatgccagtggtatgtggctgaactgtaagtactctcatgtaaaataatccttaccaaagattgtcttatttttttattgtaattttcagttatatatttttaattgttaggttaaacatatgctgcgattgctatagttagttttttttttattttctgcacaggttatcagtcatgttccttaaaataagaataaaggcgatttgattctttgaatctgagttgctctaaaaatccattcaccttttcattgactcgatgtaatttgaaattcagcttaggctgttgacatcactggagaatgtaaagggttgcatatttatctttaaggttctccggaagaaacggcgtttagagcaacagatcgtggatctgaaagtgacaagcattttagaaaggtaagtgtaaaagagaattgttcatgtaggtagtcttgaaagattttttaaagtttttacttctttggaagattttaaaatgataacatctgagaagcaaatacaaaaacatccaagtagagatatcgttactaatcttagtgcaaagtacaaggtattacgtggcagttctggaaatataattgagaagcccatttctttcacatatgtccagtgaagcattagtttcgagggttgtccccaagaaagagttgtgttgttaagtgtgtggggggagaaaggctcgtttagacaaggcaagcggacttcttttctttccctaggacctctcatactgtaatatactcatgcgcattgtgaatttccaaggagtcaaagcatacagtgttttcccaaattatttatcaacagaacccttttgctcatggaacgtcgtatagggactagatttcactttggggaaactagaaagggaataggaattgggttattaggaaataaatcaattccctgatattgatagttaacaaagttatgtatggggttatttatggtatgttattttcaacacatattcattaacaaaatccatatgaaagttataggagaattgctgaggtagaataacatactttgtttgtatttataatactcatatatttacctgacgttttctgagtcttcacttttttcattcttttggaattggtaaaataactgattccttgaaagtttttttctaaataatacctagataatagatttatagaaaaaatattgtatgaatgttttaacattcatgtaatatggaacatgtaatttttatactggaggttattatagttttaatacatcaaagaaataatgtttattttggaagcagaaagaagaaataatttctatgaataggttttcatctctttccttgttcttcaactttgaactttttatattccaaattttaattatatttcaaaagatttttttcttttgccttttaattttatcttttggagaaaaatgtatgtcaaaatgtatgtacgtgtatttgtcttttgatttgatcttttttgaccctcttttgcattgacattattttaaccaaaggacactcttgattgttcatgctactgggggaaaaaaaaataagtagaaattagcctaatagttgtggcttattttgagtgaaggccttagcccttaaggcaattaaatttactgtggagagaagagctaatctaatggggagaaggagcctttgttacaggtgtggtagtgtggttctttgagtgacaagatttctgtttgccagattggttaggagaagtctgtgtgtctgctttctctcttatggcctaggatcactgtggtgaatgaaaaacctgtctcagggcctgactcagataattcccttaaaacccggctaaggtcatagatgaataatcagtaattgaacagaagctctgcaatagaaaagaagccagataattatttttggaaatttaattatatttacagattttattttatacagtagacatggaattaaatttattacattatgttctaatttactctttgcttgttttgatttgcttgtttgacaatacatgtccttgtaaactatttccttttaactttttctcaatttatggtgcttattttccccattaaagacttaccaattttttttttaactatttgttacacatactgaatctagagttgtaattaagctactttcattactggttaagtcaaattatagcaaatgctactataaaaatttactatccaaaaatgtgtctcaagccccaactgatggtttcaaattctgttattaataatatgcagcattgtgtttgcaaagcttggctgttacttgtgatgcttgagaatgatgagtcactcagctaaactgagtgattttgagacttgtgtacaaattgatggttgaatgtaagcatgcaaagagagaccttagcttagcagtaccctttttgaaatcactctgacatcaagtttgaaaatgtgggcaataatcagaggtggtaaggtggccaggctttagctgaatacttttttaactggttcagtctgagggctgaaagccccagatttaaacagtatttagaatttgaagcagtcaagtattagtttaatggttgtcaggtttgtaacaaagtttctggctagacttctactagaaatgtaaaagtgcatgtgaatcagctttttaaaaaagtaataataattgaaaaacatttctacaactagaactaaagaaaagatttgtcctttctaataggaaaacacatctggagaagtgctggcaactagcagaacagttaggaccattcagaatcaactgaagtgaaagtgacggggagctgaggggaacacagatagtttgacttcagtcagacagaataaacatgatgaaccgataacctgtgattcccagcctggggttactactggagttttaggtgtcctggaaagttataataccggtcttcaaaaagtctacagaaagcatagatttccacataatgctgcacaggctaacgaattaatcaagtttctttggtttggcctggatttatatccattcagtttgtggacactactgaattatttatgtcatgttgatcaaaagttctgatatgatttgattaatgaaacattgaaaaaaatagtaaaaccaaccatttttaaccttacactactatcttgaggtatgattgacatacattaaaaccacctcttaataaatgcttcttgttaatcaaaaatttgaaaacgtatgtccactggaggaaaaaagacatagccctggatgtgaactgaatattactgagactcggagaccttcagaactacctgaagatgaatcgaagtgctgcctactttagagaattggactaatttaatttgggagtcagcagattgctgtatatcagtcatcatatataccggtgacaagaccacttagttcattcccttttttagattctgtaagattattgtgttccagtgaaattgatttgcaaaatgagacattttattttctgtgcttttgttctatcatgtttctgattggtcataagcatctcacagaagtaagaaatatggcgattcagaaggcaacaagcacatttataatttatagaaaatatttgaaggactttttcatggcccaaatcatgaaaagtagtagtattgttttaagtataattattaaattataatacattaatgttctttcttgcaacatattactctcattctttttttttttttttttttttgagacggagtctcactctgtcacccggctggagtacagtggtacgatcttggcccactgcaacctctgcctcccgggttcaagcgattctcctgcctcagcctcccaagtagctgggattacaggctcctgccaccacgcctagctaatttttgtatttttagtagagacagggtttcaccaggttggccaggatggtcttgatctcttgacctcatggtccgtccacctctgcctcccaaagtgttgggattacaggcgtgagccacccagcagtctgattcttaattttatagtttatgttgtacctccccagctgaagtatctcttttcttttttcccgcgtgtttagtgttcactcatctttatagcatagctcaattgtcacttcatgaagccttccataacctttgtagctccattaattatattcttctgagtgtttaaaacacttgccatatgaaacactatttactttggcttacattcttactatctaatcggccatttctgttactaaatctttttctcagagcacctgggatagtcttgtgtcttagtaaaatcagttgattgatttaactcggtagagtagaggctgattaaagtaaataaatctggttgatgccaacaaaattttggtcccctcaattttttgctctcattacctgcaaattctccctggccttcatatttggcaaccattgaggagaacaaggctgtaaaagtagttcatgtacttgatattctgaattggaattaagcagagttgcttaagtaggacttgcttttctgggatttcttatgcaacaaataatgtagtaactggaaatccaagttcaagacactggcagattcgatgtcttttgaggacccttggcttcatagatgatgccttctccctatatccttacatagcaaaaggggccaggcagctctggcctttttttgtaaggccaataactccagaaacctcatgacctcatcacctcccaaaggccccacctctcaatactatcacattgtgaggctaggtttcaacatatgaattgtgggagacaaaaattcagaccatagtataatatttcaagattacttaaactcttctctaccaaactcattaacttttaggttagcacagtattttcattgatattttggtttctggagttattactaattttcttgatctgatgttataattaaaaaaaaacaggactttgtacgtgaaatgagactgagataaggaagctgattcagagatggagatttaaaaaaagagagatgagagattgagatctgcagtgtcaaactgacaatagccaggagtcaggagatattaagagactatatcatctgtgattgttaatgattatttattgttatttataaatactactgtattttatatattatatacattgttttaaaaattatttttgtaccatttcttgaaagaaaaatgtctaagcttgggaaaatatttattgaaaaatgtggtttgtacatctgaggagtgtatcttgcacagtaggtgcatagatttcttcctcttcctgttccacatggccttagcttagaggctgtgtggccatcacttggtatttagggtaagactggtgcacaaaatcaaagacaggtaaccttggtataagtgtagtatcatgtaaatagcttttctatgtctaattcttgttttcttcctactttttcaggaggtcaatttcagttcatttcaactatctttacataatagtgctttagtaacaggcatggaaggaaagagacatgtccctagagtgttttcttgaaatctaatagatgattggagtatttaccatgcagttgtgtatatacataagcagtgaattcgagaggaatttttaagctgtaaaaaaaagcattgtgtgccttatagacgcgagtgagaaatgtggaatatggctgatccaaagggaatgagttatctcaattgattaatcacagtcagttacagattgaactctttgttctactctttgcccccttctcactattgctcttgactagtcttaagaaagaaatgtggaatattttctcacggctttgggattttataaattagaatactagtggtatgtaaatacagcaggtacactactgtataaaccaacataggaagccttctttaaagggaattgtttgagaaatttgaacacttggataatttgaataaaggattgtgataaatgatcaaatgaaagaaaataaatcaggttactcttctttctgcttgataaagcaataattttttttaaaggtaaaaattatgagaatgatgaggatagtagttagcattgtctttctttgataggtttgttaatgatcataaaactgatttatttaaagacatgtctttttataactattttatactgttgtatctggaaacaaatattgaatttcatttgtcatgtggaagaaatcaactagttttaacctttgatttataataaatcaaccactttcatttattgtctaatactggcaatgaacacagcctaatgtatcaaaactaacagaataaaaattctccaagttatatccagactttaagacactttctaattatataaaataaaatattttgggcagtcattttttaactctgaaactatttaaaactcctaatttagaatatcttaataaatacccattttcctctttttatttttataacttggtaaaaattgagtccattgttttcccagaacgctgttcttaaacaaatggttacctccttcattagaactttactttttttaggatttctaattaagaaaacattaggcttgtaacattgtcaaatcttggtggtctttcttccacgttttttgaggtcgattatctaagaggccatcagttaataaagctatgcaggaaatgacatcatgccacatgtgaatatcctgtattaaaaattgtatcaatatactattttataattatgaagtggaatgaattttagaaatagaaaaggtgattttttgtgcataggtccaaactgtgttttgttttcatttcagaatttcataataactatattgtctccatatcttaattgtgtttttttatagcacttttgtttagtaatttgtatatgcttggctgtattctcagaggctgtttctatttaatgttgtcaaaacagctcataaaaagtgaaaattcggtcagactagttatttgatattatatatgaaatcaaaacaacctgaaacattatcttttaatttaaataaagaaccccaaattttaatcaaatgtatgcaaaggcacatagaatatatgacttaatgtacaacctttattaacttgatgatggaaacctgttcctagggacctttacttgaataaatgaaatatcaagaaaaaatactaacttaagaataataatttaataagtaagtaagctattatgatcttcaatcagtcctgagagaatcatggttgagaattagaaaatttagaccagtaagatcaacactgttaaaaaaaaaaaaaaatcagtattttttctccatattttttatatatctggatcattttatttagcacttattattgcactttccttttcactttttaaactatgctgttttatttttctgagacatctgatttactgaggaggaaaatggaaatgcggtacagagcccaagggtatgacggctttaaatgagtttccatttctgttttaagttaaccatccctccctagcttacatctgttcctttgttgcacccttggtttaacattattctcctccccaatttcctcttctcctcattgtgaactcgtggcagggtctgcttggtgagctcattctcttacaacaacaaattcaagagcatgaagaggaagcgcgcagagccgctggccaatatagcacgagctatgcccaacagaagcgcaaggtgatggatggtttaagggggctaccgatacattcacactaatcagccatttctgccaagatcatgtcacctcaatctgttcatggactccaaatacaagaaattaatttgacaaagtgaaaatataaaagatgcatcatataaatatgtaacttttctggagtgggtagtataggtaaagccaaaagaaacaaattcaagcagaggaattttggtttctgaaaattaggttgtctgtagggtccctgtatttatacttagaacaaaattaggaatttctgtttatgtggtccagttattgagtcaccctaagtttgtaggcatcttacctacctacttgctccccaagtttttatttctaaaatgaaaagcattgctgtagatgaccagtttacactaaagaataacatttatttatttgttttagctaaagtatatggacagggaacattcatattcttgtagaagaaaattattttgacttttgggcaaaagcatgtagttcttatacactttgacaaactcattgcgtacatttttcacattaatcaaagtcagcacaaataaattttcaccttggaccacggagggtttgaacactggaaatttgatataattctggttgctaaagaacaagttctaataaaagcttaagtgtataccaatatgtggctgttggtgcaatcagcaggtccgtaaaaatatgattttaatggttaggtaatcccacaacggagatcccaaagttcatgtttggaagagacttttgggtcaaagtgaaatcagtgtaatgaatttaaaattatactctgagatcttgaaatcagctaattatgttacatcttattagctcagaaaagttttgaagttatatacaaatgctagtcaggaaaaaagattcagtcatgtaattcttgtacattctactatttaaatcaaccaatattatagattatgatttagtgcagtaattctgctggctaaccttatctcatttggtggtggttagtacttcagagtactcaccatagtttcatttatgttttcagcatcacttcctggtttttctcaattccatggctgtggaatcaattcatatgtatatttagcttcggtgagcaaaaacatagctagaaaaagaaaagaagtgagtttcctacctggttaaattaaagtcgatgtgttaagccaaggaggacttcttttgaatggtactttaacaatccctgttctgtatactgtgaatatatcatttaaatagcctaataaattggatgcttaggctgagccacctatactttagttttgttatggaaagaagggagaggagcaagtatgttcttatatgttacttagaaataagaatgtagctgtagttacacattgttcttaagtttttttcgtaagacaacttgaaatgagtcccataggcctgctatttaacattctaagatatgacttaaggttaatgatgagcttttgaatctgacaattcaagagatatccataatgaatactgattcattttctacattgctgaaagctaatgttcattttaagcctactttagtagcctttatttgggcttagagatgttattcctctttctgatatttattgggttatctgtttaacccttttatatctccctttcccgatttgtaaattagagactggcaagactttttaccctgagtagagcaccaaacatggcttgtttctgcccacactgtagttaccttgaggggaagtaaatgggactttaaaagcaatttatgctcttttatagtgaaattatccctcttactatcccgaaagactgttaccttacaatatcctccactcctttccccctgtagttactatagagatgacttttcggttcttcactgccataatgatcaaaatcctaattcatgagatttttatcattccaggcatgtgaggtttacttgatgcataaaaccgcaagtactttttgttgttttttaattgttttttctctcttatcttcttgaaagtctaagtagatcatcatttttgatgtcttattagtagcaactaataaattttccctgtatcttctcagcaaaagaactcaagcagagacagaagattagaactaccattggtagttttgcttcctatggatatgttcacatacatagaaatttttacaatgacctttttatatatgtatttcagaatttcagaatggcctcaatgccttaataggaagaaatacttgaaatttttaaattagggcttggttttgtgaggagctagtaaaggtttttctctttcagctttagcttgtttctgcggaggattccgctctttctccatcagtttcatagccctggaattgtagaaaagctctggtttcaagaccattgatatccatttctgtcagggtgagttttaaatttatttcatgatgcaaacaatatattgaacaacaggacatgaacttgttcttgttgtaagtggctgaattttatcagtaaagcacatcaaaataaaatataccccaattgctagttaagacctagagtgacagattgaaaatagcttgtgttattctcttaagaaaatatataaaaattatcatctcatcaatctttaatgtttgttttataaatctaaatgtttttatattgtttcctaggaaatattaggtctaattttttactttaccaccagctgtcttttattttactctttttttgagacggagtttcgctcttgttgcttaggctagagtgcagtggcactatctcagctcactgcgacctctgcctcccgggttcaagcgattctcctgcctcagtctcccgagtagctgggattacaggcacatgccactacaccaggctaattttgtatttttagtagagacggggtttcttcatgttggtcaggctggtctcgaactcccgacctcaggtgatccgcctgcctcggcctcccagagtgctgggattacaggcatgagccaccgcacctggccagctgtcttttaatataacattatgattaattgtgatgttccattaaactaagcggagaggaaacatgctggtaaaccatgtgtgagttattcattgtaccagaaaggcaaatgatacattttatcctaaaattcaaatttataaacatcttaacacttgtgatcattaaatactactaatctagcatataaattatatttgtaggcggggcacggtggctcacgcctgtaatcccagcactttgggaggctgaggtgggcagatcacgaggtcaggagatcgagaccatcctggctaacatggtgaaaccccatctctactaaaaatacaaaaaaaattagctgggtgtgctggcgggcacctgtagtcccagctacttgggaggctgaggcaggagaatggcgtgaccccaggaggcagagcttccagcctgggcgactccgtctcaaaaaaaaagaaaaaagaaattatatttgtaatattctactaaccttatatcattttaactttttatataacttttttattttaccaaattaagttaaccttttatagcccttggcttatactaaacatcctaacttttttgtttaattgtattagtttttaagttattgccccagatgtcaagtaatgttggattttctataataatttaggatatattgcatgaagtcagttagtatttacatttaaaactaaaacaatttatactaatacagtttatacatttcatactaatttagctacagttggataaatatttaatggaacaaagtaaatcaaagtaccttttcaaatgaattggaaattaaatccacataacaattttttatgaccacactattacagtgtgatggcatgccaaatgatcataatgtggaattatgtatttcttcattggctttcaagattctgttctttagtttgtgggctcctctccaacttgcttgtctcctcacagtttaggcgactgtttataattcttgtccatcctgcataaacacacacagtcaaaatgaaaaaaagcttctatcagcagatctgtgcttgctgtacagaaatgggaaaacaattgaagtttgcattatcttttttctaattaccagatcgtttttggagctatttaggcatacgcttttaaggaaaaaagaaaaaaagagtgtaccttttgtttctaacaaaggttgttatctatattattgaaataaaaaattggggatagttatgacaaagtatttagaaataggaattaaaatcttaaaataacttttcatagcatggacaagacttattaatgtctacctcaataagcaaatcatttaaaaatttttcatgtatatttgctgccatgatgtgttgtgattgcttaaataaccaatgaatgaagatcaacaaggatttaaatgaagaagaatatggatttaactattttctcctgtgaaataagttcatatttacaagttttgattttcagaaattagacaattatttttaaaggctgggatgacaacttctgcctcttaccaagaagtcaaagcacagttatgtgaattcatcataaatcacatcatttttattatattttgtatttataattgtattgtgactactttaaaacctgttataaaataaaattgttttttaatattttattttagaattattagcattaataacaatttgaagtagtttacacaatacctgtgagttttatttttgttttatattgaaattaattttagttgctttacttggcttcattgctatggatgcattctctgtgttacgagttagcagatctttccttggaactgaatttaaaagcaagcatttggctccacttaaatctctgaaaatgcaacttgttctttgcatttattacataattcgctacttatggtacagaaatggatacaatacaaaaatatttccttataagatacactgtgaccaatgagctttttaaatagctgtaatcagtaacatgtatttgacttttcaaaacacatttctggagggatatcagtgctttatttccccaaatatctgaatccctatgctttagtacaaaacaacttctgaagaatttagtaaccatatgtgttgatctcttgtttttctaactagtctttcataagaaatgactagaatagcaacagggaaatgattgccttttaaggtttttgtttctcaatataaaattttggtgaaccatttttattgataaatacaggtatttttactttcttaaatcacttgatttaaaattactttgattaaatatgcatataaagtcagttgtttttaactctcaatacttatcaaaaaaatttaacttgctgtacattctgtataaacctaattctattcaactaaaattattttaaacatttaggtgtcagacaaagagaaaattgaccaacttcaggaagaacttctgcacactcaggtaatcatgatgactaagaaaaactagggacttttaaaaattatattcgaatgtaactttggtgatatggacatttattttttcaacagagcaaaatttggaaggtgtaatgatagaaccttattattatcgatagatgcaaaagctaattgagaaataaggaataaagacagaactagataagtatggagttaactcatttatatgtaaaaacctattttgagtgaatcttatgcccaaaagggagaaagtggcttgtccttatataaacttatgcttgcatttttacattgataagctaatacagttaaagaaattcgagttgagtctaccacatcgttctagtgggctctcaggaacctttactttgcttcgcaagtctgaaagcagtcagacaatgcttatctaaagctctttctggcactacttagaaaagctattttcttatagttggtgataaaattattactttaaggacctattttgtgcaatgtaatgagtgggtaacattctagtacaaaattaccctatcacagccaggcacggtggctcacgcctgtaatcccaacactttgggaggccgaagtgggcggatcacaaggtcaggagatcgagaccatcctggctaacacagtgaaaccccttctctactaaaaatacaaaaaattagctgggcgtggtggcaggcgcctgtagtcccagctactcaggaggctgaggcaggagaatggtgtgaacccaggaggcggagcttgcagtgagcccagatggcgccactgcactccagcctgggcgacagagcaagactccatctcaaaaagaaaaaaaagttaccctattactcaatcatcagtttttctatataggtgacactgacatgcattaattaacttattttttaaagttcaaagagttactatcagctgggcatggtgggtcatgcctgtaatcccagcactttgagaggctgaggcaggaggatcgcttgagcccaggagtttgagaccagcttgggcaacccggagaaaccccgtatctataaaaatttttttaaaaattagccaggtgtggtggttgtgcctgtagtcccagcaactgggaggctaaggcgggaggatcacttgagccccaggaggtcaaggctactgtaagccatgattgctccctggccaatagagcaagaccctgtctggaagaaaacaaaaaagaataagaaaaagagttaatcttggatctcttttttgtgaaaaagtgaaacgactacaagttgaatatctcttatctgaggtgcttggggccagcgtgttttggatttcagatttttgaattagggataatcagtcagtagtatgttttgagtcacaggtttctttggtatctatttattgagtctcaaacctcactatacgctagactcacctgtgctctgagtggcactatatctatgtttttaagggttcctagccaggtgattccaatctgcaaccaggggtaagagtcattggtcacaaagcatagcctctggagcacattagaaatgcacattcttgaccccatcccataccttctgaagaatcagaaactctgggatgaaactcagcaatctgtttttaaatgccctcaagataattctgatgcattctaaagtttgagaattattgttctagagctttgagagacagctcaatagcacatctcttcaggatggctacaaattggcatctgtaccaaaatgtttccatccccagaaaatgtagaccccaaaattgattttgtgtttacaaagaaatgagccagtggaaattctaccctcttatatgccttgatacaaacccttcaatttgtgcaattgtaattgtcagtcactaggcactgatagactgtattatggagaattcactgggttatctatatcaatgatgtccaatagaaatatacaagccacctgtgtaatttttaatttttacattaaaaaggggtaaaaagaaacgtggaattagttttaataatatatttaacccagtctatcccagatagtatcatttcaacatgtgatcagtataaaaaatatgaatgaggtattttacacttacagcacaacctcacttcaggccagccacatttcaggtgcttgataactacatgtggctagtagctgccgtgttaaacaacacagatctaatccttagatactaccagaattttgttaaatatactattactagatataaatgagtgagtttatgtaaaaatatgtttatagtagagtctagccagtagttctgcctgtctcatactatgtaggtgttcaattatgtatgcgttcttttaatttggcttgagttggacttgctgtaaggatagaaccatgatttcctgttaattactttgttcttgaaagattccaataagctaaaaaaattgtaaggaatattttttattataaaaggcatattataagttggacataaacattctgctggttgtaagaatgggttatttttaatagttttctctgtgttgttaatgtttagagaagaaataaaagctgggaagacaaattagaaaggatcaaatttatttgagacggaaaatgtgtagacaagcaactacttacaaaaaaaaaacctgtttagacatattagtcttctttaaaaatctgtttttatatgattctttttgattttggtgttttgttttgtttttttgtcaagtagttgcttggctacacattttccttctcaattaaatttggtcctttctgatttgtcttcccagctttttttgtcttcgccaggctggagtgcagtggtgcaatcttggctcgctgcaacctccgcctcccgggttcaagcgattctcctgcctcagcctccctagtagctgggactacaggtgcccgccacgacgcctggctaatttttagtagagacagggtttcaccatgttggccagaatgctctcgatctcttggcatcgtgatccgtctgcctcggcctcccaaagtgctgggattacaggtgtgagcctctgcgcccagcctatatcattttttgaaatagtaatatattatctctggacatggaaacataacaaaacatagaagagtttgagcctctgacagccctctattcaaaaccctgctcctctactaagtgaccttggtcaggctctcagatattcctcgctctttattcctagtctgtgtaattcctgctttatggggtttttgtgaaggctaagggagttaatgcgtttgcaccacttactaaggagtctgtcacataatgcatgcttgggtactgctagctattattttatagcatcttaattaaaatctaaaataatgtgaagaaagggaagaatttgaatttttgttaagtggccctgtaatgtgaagacttaaaattttgatataataggaaatactcccttctagaatgtatttaagaactacttctttaaattcttacgttttcactatttcaaaataattttttcaatgtgagtagcaaggaattttccaagtgaaattcttaattatgatagaaaattacaatgatttccactgtttgtaagagataatagtcattgtttattttattcctaatgttttcgtagatgcttttaaaatgtaatacattttaaataggagatatgacttcaagattttggaagattttaatttagacttaatactatttgataacccatcttttgcttatatagttacacttattattttattgcagttgaagtatcagagaatcttggaacgattagaaaaggagaacaaagaattgagaaaattagtattgcagaaagatgacaaaggcattcatcatagaaagcttaaggtattctaagtttgtcttgtttattctcaaaattttaccgcttaacgttgtgtgttcatcagtaccagtttctaaggagctgtaaagtattctgtcatccttttctttctaacctaatgtgcttggaggatggaggatctcttcctatattaagacattttataagttgtagtctccaaatacttgttttatactatgcccataaaatctttacacttttaagagttatttcgtgtgaatcagtttatttttctgaaatatctagtttatctctaggcttaacttttacataaaattttatataaaatcagaattgttaattgatggacatgtaagtgacttatcatcattgctttacttgtatgccagtgaatgattagaccactttcttcagtttttaaaaaattaacacttttcttctaaggagagctttcttaggcatttcaaagaactttcgaaaaagtgtgtgctggtattgttactatcagcacattggtgaacttatttaccaataaatcaagtcttactattccccacccaactaaaccacatgtgctaaattgaattgaaacaattatttaacttaaatctcatataagtaagcagagtttatatgtagcaaaactgcagtaaatcatggcatgtacattctgtagtcaaggtccaaagataatacagttctagcttaacaaacatgcattagtagctttgactataaatcatgactgcataaaacagataacatgactatttacaagtggcacttagaactgagaaaagtcatttccaagtgctaatatatgtagagtttacctcagaaacagtattttctctcataaaatgcagtggcaattaacattttttgtttatttttaggctggtgggttggcaattgcttgccatttaattttttctagggattaagaaatgaaaggacccttaagccatcattttgctcctgccttagcattaaaacttatccataattattaaatgcttgatggtacccctttttttcaggcctgtgtatttttttgttcattcattcatcaaatttacatgaagcttgttacacgcaatgcaaggcaccacattcatttctgattctacagcaagaaacgatacaggatatttgcccttgctacactcatatttcagcctgcccagttgtcagtggatacttaaccacccttactggtttaacagtcttcctggtttatcctttattcagatgcttgcttgcacgtgctctctgtcctctctctttctctctcatgcatgcctcaaacttagcaaagaataatttcattgtcagttggttacctgaccaccttttttttgcctttttggtgttaatggtcttttcttgcattcagtattagctcatcagtattaagtaataatttccatcttatttaattagaatgttaggaaatcctgaattaatttactttattaaatcattgtatctaaataaactgaatgagaaatggacttttaatctgtaccgttttagtttttacgatgaagatgtatttatgtaatttgagaaaacagtacaatgattatggaaaaacaatttgaatttatcacttttttctcttgacacatctgttatatttttttctttacttttactgttttatattataactttttaaaatttttacagaaatctttgattgacatgtattctgaagttcttgatgttctctctgattatgatgccagttataatacgcaagatcatctgccacgggtatgtgaaaaattgatagtgaacttgccaattagcaaaaaaagaagcagcttagcttcctaaaaattatgtgtatatatgtacacatacacatatatacatactagatgtaggcatttatattttttatgtaatcttacatgttccaagtaatgtcttaagcaatattatttgactattttagttcattataaatattaataaatataagtacattatatttatgagttactgtatgtgttataaaggaagatatttggctttatatgtcttaatattagtaatatttaaatactgaacagtggattaaattagccatatgcgtgaaatttaagctaatagaattgaaaatgtgtttgtaaacagtaaactagctatggaaaagatttatggaaagttaataacctggttttagaaatactggtttaaattagcacaagtttttaaaataaaaattaggctataaacagtggatccagttatagttttgctgttcctattttcaatgtgcacacatgcatcaatcaccatttttttacggattttaaaatattttttcacctgtagaaattttaaaagactaaaaaactcagagcagcattacaaataggttttaattttaatttggtatcagaaaaatatgaataagtgttctttgttttgtgggaaggttgttgtggttggagatcagagtgctggaaagactagtgtgttggaaatgattgcccaagctcgaatattcccaagaggatctggggagatgatgacacgttctccagttaaggtaagaacataggccgtctcagtgaggttccttaggagagtaactgcttcagtgagacctgttcattgtgttgaaatgaggacttttaaccaaagaaagacttgatacatagtgtttggaatgatccctagtgtggaaatcagtagaaggcacagccaggaggccagtgtggcaggagctgagtgaggggagagtggtaggagaggatgacagagacccagttgggaggcctttggattttattctgaataagataagagagaagttaagagaatgagaatattggaagtggagtcaatgaatatagataattttctagttttattgtgacaaaagagcagagaaatgaagcagtagcaattgaatattgttgaattaagggaaggtttttaacccttttcctgtttagaaaaaaagtgcagctcaacaccagtgctcatttaattttacgtaaacacactctctgaagctgaagcaaatctgactaattttcaatgtgaaaataaaatataaaaactgttcttagagttatttctaaacagtactaacatcagaatcgtcccaatcatcagaatgtctgttttttaaaagtcagatttatcaaatcaatcttcggccaacaactttttgagaatgatgtaaacatcacacataggaattccgcattttctaggatttgacattttcagctattgaaaattactatattttgtaaatggacgtaccgctactaaaaacagaatgcttgaaatagaatgtcttttgtttccaaagtcagtacactagagctatgtgaaaataatcataaaagtgaagatattttatggcagagttatgttggggcaaatgctgcagctgcaagcggtgctggcaaatattgtcggagcaagtgggaaaaggattaaagatgtttatatgctgattataatgatctaataaaggggggaaatgatgcaagagagagggaaaattgcaagagcaaagttactgaggtgaaggagattgtgacttggtgtactagtccatatctgggagcactgacaatttctccagggtcacaggaagaaggtatggggctgcagagtctttcattgaacagatatttacggaatgcttaatatgtaccagtagcattctaggcaatatgttggtaaacagcaacaacaaagaagaaccttgccttaatggagggtatgttctagtagagggagacagataatagataataaatataatacataattgtatagtaggttagaaggcaatagtgttgtacaacaagaaaaagcagaaccaggcaaggagaatgagggtgccagagtattcatagattgcattgataaggtggcatttgaaccaagatttgcagaaagtgagggagtagtcctgaggatatcctgtgttcagcaaggagaatagctgatgcaaagcctctgaggtggttgtgtggctgtcatgttcaaggaacaacaaagaggcctgtgtggtcaggtcggggtgaagagctagccatggtcggggcaaatgatgacattagaggaataatgaagagcggggaggaacagatcaataaggccttataggccattgtacagacttccgttttaagtaaaatggaaagccagtgcaggatttcgagcaaagtaacaaaagtgccttttaaaaggctgctcttttgaaaatagttgtagccaagatgtagaaccagggagtctaggctactggagtatccaggtgatacttgggctagggaagtagcagtgaaactggtaagaaatggatagattataaatgtgttttgaaagtagaattaacaggatttcttgacaggtttgatatggagaggggagagaagaaaagcaatggggagagagagagagagtgtcaatcatcaatgatgcctccagggtctttagcctgaacaaattgaaggatgtagtttgcatggaagtctgtcagtggatcaggtttgggggaagaagatcaggagttcagttttggacttgctgagtggtgataacaagcagttgggtatacaagtttagacagaggtgtgggccagagacatacatttaggagtcatgatcaactatctaaaagtagtatttaaagtcatgatcttactggagaagatcttcaagggagtgagtagagatagagaaaacacagaagcaagcagtatattctgggcactctgaacattaagatgttgagggaagagaaaataacaaaggaatgtgtgaaggcccaaccagtatagtaagagggaaagcagagcaggacagtgtgcgcaaagtcaggtaaacaaaaagaaaacatggaggaggagggagtgctcagtgaggtcacatgctgctgatccatcaaggaaggtgaacatagaaaccagtcgttgagttcaccagtggaggcaagaaaggggaacgtgtggaagtttccttctgattgcttccgcttactcagtgaaatactaagccagatgatcagctgttaattagaaaggagaagagattaaagactgaggcaggaagaaaaagtgaagtctgttaacagatcgtggtgactctaggagtgaatcagtggagaaagtcaagtgatattaggattactgaggtggactgaagtccctttaagttctgtggacataaattttaaatgaatcattatgattgtgttttgtttttttcatgtttagctggtggggggtaggtgtagaataattggaagattgaaattaccaagaattatggcaagaatagtgggagaaagacagtgaggctgatgctgaaatcttcaagaaatgaaatctgtttacaagtgcaacagggtatgggcagcctagtgtgattcatctagattgcacttttgtgggtctagctatggattgaatcgtgttatgtgttactagttctgtgtgtggtactgtgtgactgtaccagactttacatatccattttactaccgatgggaatttggggtacatctaacctagagaaaaaaacaaaatgaacctcagactacacctcatatcctgttcaataatcagttgtaaaaacatgggagagaaacctaccttttacattgttactagcatcctaattgtagaagctgtggatgatacttcaagaagaaattaattttgttttggcaggcagggtgtggacaggtttccttgaaacagatgaggctggtctctttccggtttgtcattagtcccttagtgtttactagagcttctccttgaccaaccctgaattccagttttttgtttccctagagcagtgaaagtgccaaaaccccagcttagcattttaacctccttagcagcttctttctgcttggtttcctaaaatgtgaatgccgtgaaaggaaattgtgcgcaggatgtagggttttgttttgttttggaggtttatttctgcagttcatttttctttgggattgtggcaccttaagacgtgactacttaataactcggaattccaatcttgtctactcaacccagtgaaactgctacacattttaagtttttctcttgggcctttgccctgtgctacaaatcagcaaatcctctgatggaaaatagctaaacagctttccaacagctgtttattgtttttaaatttagcctgtttagctaatctcagtagaaggaattgtatttttaaagtaaaataactatagagaagctagaaaggtgtcaattaggcatttagaagttcttgtgaaaccactgactgttaatatacattgctataacatttcttggctgggtgcagtggctcatgcctgtaatcccagcactttgggaggctgaggagggcggatcacctgaggtcaagagttcaagaccagcctggccaacatggcgaaaccctgtctctactaaaagtacaaaaaacttgccaggtgtggtggcgggcatctgtaatcccagctactcgggaggctgaggcaggagaatcacctgaaaccgcgaagtggaggttgcagtgagccgagatcatgccactgcacttcagcctgggcgacagaatgagactcggtctcaaaacaaacaaaaaaacaaacaaaacaaaatttcttacccaaatatcactccttgagtgaagcctgtcgtagctcccttatcatcagttccattctcttctgtggcaccctaggttttgtcactctcttctattatgtctgtgtatatttctcccagcatgtgatgaggtctaaaactgggacagtcagctctgtgtttccccacctacaacacctgacacatagttcactctctatagaggttgaatgaatgaattgtcctttacctaaattcatctttgaggttaaatgcaaggtttccttttagtgtttcaagttttagagagatgattttgggcttagtgctgtgtatagcattgactggggaaagaaagaggcagcagcattttaggtcataagcgatataaaggaaccagcattcttgttgggaaatcacaacatatatgacatatatacaaacaatacaaatacaaaattattgtcttgtcagaactaccatgttgacagcttcagggggtgccccagcagtagtgtgaagggactcttggatttgtgcaatgcagtagccctgtctagaccacatacgggctgtgggaattaatattacttataaatacatcattacctctcagttttctgttactatcaggtgactctgagtgaaggtcctcaccatgtggccctatttaaagatagttctcgggagtttgatcttaccaaagaagaagatgtaagtaaaattcatctaaggttgatatgtgtaattttataacctggatgagcttataaaagacagttaaagaatatttgtgaattaagattttcttagattttcttaggattttgtgttttccattagcttgcagcattaagacatgaaatagaacttcgaatgaggaaaaatgtgaaagaaggctgtaccgttagccctgaggtaagggttgcaattcatttcagtgacgttttatggaaattaaatgtttatgatttcaaataaatcaaaatctaggtattgatgtttagattgctgctatctagatatgtagagcttttaaaaaaaaatccaaataatatatcattttgtgggtaattttccagaataattacttttaggatcagagaaagaataccatttttgtgagcgtcttatctgaatggatgagatatagaatttttagaatacatttcaccaaaaaaaattcttgacaaattccccccaaactttagcattgttttatttttatttttcctgagtagaccatatccttaaatgtaaaaggccctggactacagaggatggtgcttgttgacttaccaggtgtgattaatgtaagtatatacaaaacatgtattttattttattcttattgtgtgaagcatttataatgacatttaaaacctttttctttaagactgtgacatcaggcatggctcctgacacaaaggaaactattttcagtatcagcaaagcttacatgcagaatcctaatgccatcatactgtgtattcaaggtaaatcatatcaaaagattttaatgtactgatatgttttcttctttagcaatccaagctttgcattaaatagtttgtgttatgtaaacatacaagataaatgcatttttgccttctcttcgtattcattttattagtaaattaaattgaagttgaaattattttgataagttttacataagcatcattgaaatttttatcggctaggatttctttttagtaaataacgtaaatgtattaaaatctttcttgctataatgtagacacaggggtataatttgtactgagttttaaaagtctactttacatcttaaaattccacagtgtcatttttttatttttttcagatggatctgtggatgctgaacgcagtattgttacagacttggtcagtcaaatggaccctcatggaaggagaaccatattcgttttgaccaaagtagacctggcagagaaaaatgtagccagtccaagcagggtgaggtcaaattctttgttgcgagaatagattctttgtaaaagctccagctgtgatagggatttgttatttaaaaaaacaacaacaacaacaaaaaaacaccttacaactaagatttattacaatgaaaggataaagcaaaatcacaaaaggaaatggtacatggtatgaagtctgaaggaaaccaggctcacgtttttccactagttcattcccagtagactctactgggcacatttaattcctccagcaacaagctgcttgttagagactcagctcctaaggttttcatcggaggttagtcatttcggcaccctcatgtaccaaaattatttcatactcccaaaaggaaagcatatgttataattaaaccacattacttcagtagtgagccactgttatataaggaaaggtttatatcagtgtagggaactgtttaccagttaagttttcagataccagccaaagacaggcaggcctttttaaggacagtagtctcaggcctgctgtgttaacccttttctaggtagccaccataacctctgttctgctttctttttaagggtaaggcctgccgtggcattaatggttctgatatggagaaggggagaagtgaggtagaaacaaatttctgtggcctcctccccatctttcttcattcctttcatttctttcaactctaggatagtgagtttatatttcttctgagatgcaactgaagcttatttcagtcctttttgtataaaagattcagcattagcttaggtgtaacttgtcttaaaggagggattctcatcccattattaatctgaatgggcttcagggggtagaaactctaacatatgtgaaaggtctctatgcaaatatgcatttttctgggtacatagtctttttttttttttagtcacatttagaaatggatttttgatcctaaaagagttgagaagcagtggatccaaatattaaagaagaaggtgggaggggaggaaggagtaaaagaagacaatccagcttggttagaatttagatatttgaagaaagtatggaaaaataataatagctaccatttattgagtgcttcatgcctggcactgtatcatattgtcccataatctcaccaacctttttgaaaaaattaagttgtttacttaaggtcgcataactactaggcagcagagcaggaattcaaactaaggtctgtctgactttaaagaactacacatcattccgggttttcgatacgtgtgttttaataatacattttcaatgtagtaaaattaaatgtatttttttcaaatagcaatggaaaaacattttaaatgcttttgtgcagatttatttaactatatacatgtatagcattattttgctttctaaattgtatattacgcttttaaaacttatgtaaactatatctcacattaatttttcccacttttaaaaatagattcagcagataattgaaggaaagctcttcccaatgaaagctttaggttattttgctgttgtaacaggaaaaggtatgcaaagatggattataataacttatttttagtttctgttgttttcaaataataaagagtaattttcttgatgaaaatttgaccatcattcttccccagggaacagctctgaaagcattgaagctataagagaatatgaagaagagttttttcagaattcaaagctcctaaagtaggtatcttgttaaaacatttaaacattttacagtaagagagtagcttaaattgaactgttttcacttaaaacatcaggttttataactattagtttaacatcggatttctagaatttttcccaaatagtgaactgtatctaataaacaagtccttagctactttttggcagaattgagagcagtttatcacatggtacaatacatactggcatgcttccttggacgtgggcactgaaagacaacatagatatctgcctcttactttattttacttataaagtggttttagaaaatcgacgctttcacttttaaacgtgtacatatttctcttacagtattggggaagattggagtggggttgtcgaagaagtatccctagatatatattgacaggagataagataagcaaaaagagctaaaggccagttgtattactgtatactaaaactttatatgttgagtttctggaaatagaaaagtatgtttgttcctaggttagtacggtaagtcaagatagttcttgcaaaccataatcttacgtgctttggggagtgcactgacaacatatagaactgtgctgtctaatatggtatcactagttttgtgtagttattaaaatttaaattagttggaattaaattaatttctggaagatggctttcttcatgttctttttaaaggcatggtggctcacacctgtaatcccagtactttgagaggccaaggcaggcggatcacttgaggccaggagtttgagaccagcctgtccaacatggtgaaaccccatctctactaaaagtacaaaaaaaattagctgggcatggcgatgggcagctgtaaccccagctactcaggaggctgaggcgggagaatcgcttgaaccccgagggggtggggggcggaagttgtagtgacccaatatcacgccactgcactccagcccggacgacagtgcaagattccaattcaaaaaaataataaaataaaatataacattaaatttaaattagttaaaattcaacaaaattcaaaatacagttcctcagttacactagccacacatttccagggctcaataacccagtgtgccagtagctaccgtattggaatgttttcctcctcacataaatttttattgaacagcactggtatgaaaggtaagagtggctgttagcaagcacattcgcagacttggtggtagtattgttgtcctttttgtcattttaatatactttagctcttgttatttttttttaataggacaagcatgctaaaggcacaccaagtgactacaagaaatttaagccttgcagtatcagactgcttttggaaaatggtacgagagtctgttgaacaacaggctgatagtttcaaaggtaagttggattttttaaagaagcaagcaaattaagacattttattagctggcaatctttggcatccatacgattctgtacttctttcctttaacagttgcttggtagttcatttacaattagacagtatctggaaaatagaagaatacaaaccttcagttgttatacaagaacaagatttttcctttcagaggaaacatctctagaaacacatttgcagagttcaaacagatgagaacatttgctagtgcttggaagtacacaataaactatagagaattctagattcaccctgttgaggatgaaggagcagatgtgttgggaagcagagccctctgaacttcctttacttggcaccatttcctgaatcccacactttcctgctcagtgtcttttatcggaagagaatatatttgctttctcttttcccatatgtaaatcctacctgatcctacctatttatgccagttagtccctctgcaatcttgtattactttcatttccattttacagaagaggaaacagaagacagttacttacccaaataacttatcctattacccagtgtcacacaacatgggtaataggcccaggatttggctgttggtggtacaactgcagagtccattctctcagcagctctatggtactaaactacttcagctgtgtgctaatggatttaacatggagaaactagaatcagggagaatagttttgaaagctattgcaaaaatgaaattctgagacgttgagatcccagagtactaaggggtcataggcgcactctcagaaattcagttaatacagaggatatgtattttaaccactttaaccactacatctggaaagaaggagggtcatcaaacttgaacttttccttcttcctcagcaacacgttttaaccttgaaactgaatggaagaataactatcctcgcctgcgggaacttgaccgggtaatatttggatactcgtgtattttgtatatatcttaatttaatgttgtttgctaactaaatttatgttgagagaaaaatctgataagctaaagtactttggttttgactataactactaatttgtaagaatacatctctaggagcagttatctctttcagtaatttaaattatttattatataacattaaaaatggattataagatgtcaaaacaagtgttgaaagtgttttctgagaaggtaatgaatgtgctttaaaggttttgtagaattcgtgtattcctgtaatttagtgggaattaaacattgtttttccttgattttaaaatccccattagttaataaaacacagcattaatatatagttactgatgtactaaattaatatgtattgatgctttcacataacgtgaacaagtgttatgtgaaaaactgcattcaaacttgagaaggtagatatttatgtcagtttctttgtccttatctgcataatggcattcctaaaaaaaaacactagaagtgcatttttgctagtcatgtataattaaacccaaattcagcctagtcaaaaacctccctttggttatctctgaaaatcatgacagggtaaatttactgtcttatggaaatcttacttacttgtatttatattgcctagaatgaactatttgaaaaagctaaaaatgaaatccttgatgaagttatcagtctgagccaggttacaccaaaacattggtaagtatttgatattaatctcttttctgaaagactttactgtacaggttataatgaaatgctaaaacttagattgataaagcagtgatttattgttgccttggctcataggcaaaaacgtaatagtatatttttttggcaatatctaactacttttgtagtctaaccagttgaatttcttcatgttctttttaaatcttgattctctttgccttttctttatcttatacctaataaatacgtaatcatgatttctgtaaaatcctttgggcagaagttttgtcaaattatactttaggtaaatatcaacctgtcaaaattgatttataaagggagttggtatatattttcaggttctccattctgagtaagaacagttagtgctttctgtaacatgtggttaatatgttgtatacaaatcacattttgaacttaatgctattaatacttgaaatttttaaaaatagcaagtaaatgcacctttttgaaaaatatgttaatcttttctaaggcaaactgttaccttcagtttatattttatgtaagtttggccattcctaaattcagtggaatgagacacggtaaaacaagctatgtataaatagccttgacatttttgtagtcacatgttaattaacaaattcctcatgcagaaattatctttctaatgaagactgtggtatttttaagaatttatttttggagcagagctatcctcactgccattcattgtaaatattttctgtacctagtctattcactcagttaaaggttatcaaaagtgagcctagatagtagtatctggtctgtttgaattcagcatcactagtttcctcatttcagtgccctttcttcctcagtggtgaaacctcttctatcttcaagtagtccacatttgcctgtttttaatctccgttccttatccaaaaaaagagatctaattgtatctattcttgttgattaatcaaacattgttatgacacaacttatgtttgtttatttgtatcttagcccagttccatggctttgtgtcagtcagctttcaagttacaaagagatatataggtttacagattgagtataatactagttgccttgctagattgtatgagggcatttaatgtatataaaagtgatatgtaaactgtaacaactaataatgctgtttatggggagaaaatgtggtccttctataaattaatttttggtatcatcaaatggaaaggttagttttgtttggacagagcaaccctgaaatcaaagtatttcttcactaaagtgagccttgaagataaatgtaatttatttaatacaaaggtaactgaagagaattgtgaggggacagtgaacgcataccaccagattgcccattgaaaaggcaacggtcagatctgggacatctggctgctagagatttacttgtgtaagctgccggatcatatatgattctctgtgttttcagactgtagaggctgaaaaaatgttatgttaacgcaaatataaatcagagtagcaggtccaagccttagctgttcataccacattgaattcaagtacattacaccccaaatattttccacatattttattattttgacatagttgatgttgtcttgaagtttttattggtatctttttgctgaataatcctatgtgatattttaggacactgcctaaaatgtttacaattatttaagtcataagactgtttgatctatatttggttatctggaaagtgttaaaagcattttatgtcataacatgacagtttgttatttcctttagacattccactgtccttcagttaagttttaggaaggttattaggggtatagatttgacatataatacattatagtaggaaatactcactcagcatttttacgctgtgcctggttttcaagagtgaatcactgacattcagaaggagatattgatatatcattaacatcatgtgaccagcaatgtagacatatcttttctagaaggatagctggctagcttcacagaaatacattttttctaaaaatgctactatggtacatttttagaaattctcggacttcagaaatcaaagatttgcaatatcataatttgaaatttaaaacatgaataagtgttaaggcagaggcaggaatatggtaagggccacgagatgagaacaagaaaggcgacacaggtagctgtgtcctgtggctttaacataaatgggggcaagaggcaggagataaaacagtagatgtaagcaaaatattgggtttattaaccatattcagaagcttagtgtgtattccataagcagtagggggagggtggtcactgaagaggattaggtcaggtttgcattttagaaaggtctttgtagtaggcaaaatggaatacaggcggagaaaactgtaagcaaggaggcagttggcttttgcaataatttaggcaagatgtgatcatggcttaaacttggatagtgagtggtagtacaggtagagaagagacacttgtgagatacttgagaggttacctaaaagatagaattgacaggatttagtgattgtgtagataatgaagagtctattaaataatgagtatgtttatattcagtaattacattgctaggaatatatgcaaatgatatatttgacaaagatgaacacacaagacctttcaccttgattttttaaataaatgtgaagaaatggaaagcaatttatgtgtcccatttggaattatatagtatttggtttatatagagcagattactgctctatggatagaagtagcctttgaaaagtataggatgttgacatggaaaactaaatacaatatacttttagatttaaaaaagggatttataaaacagtatgtataattatgaaccacttgtgtaaatacacacaaatagttacgtagacataatttttttaataataaaaccataaatagtggttatcttataaaagaggaactatggggtacttcttacattttctgtattggttgaaattattatatggagtataatagtcctctactttaaaataaaaaaaaatccattttaaaaagaatttaattaaagtggaatgtaggtaaagtttctgtagataaagaaggcaataaaactattacctttattatattttgctaattatattttgtgtattagtagaagttatccctggttgatggcaaaacctggaatagagaagtcacctataataacacagaatatagtccaggcacggtggctcatgcctgtaatcccagcactttgggaggcccctatggtcggatcacttaagctcaggaattcaagaccaacctgggcaacatggtgaaaaccctgtctctaataaatatacaaaaattagccaggcatggtggtgcacgcttgtaatcccatctacttgggtggctgaagtgggagaatcgcttgaacccaggaagcggaggttgctgtgagccgagactgtgccactgcacttcagcctgggtgacagagtgagaccctgtctgaaaacaaacaaacaaaaaaaaaaaaccatagaatataggctgggaaaattgttagatgatagcagcaagcaataaggtagcagatgacataactagatgaagtggcttcacagtgtaatggtttttatatgaacattgagaactgatggttcagaagagagactggggtgaggaggacttaacttctactttctaactctgaaggccatttaactgctgaatagcttcatctcagcagaatttgaggacagaggacaatcactttccttaaggaaaggtttggaggtaagaatagggaaagagaatgagagtgtaaaatggtttgtcatggaaccgggtattacaggagcacaacagaaattgttgggatggaggggagcagtgggagtctgagacagaggacagcagcttggcgatgaaaggcaggagaggctgggcaaggagaagtgataacagctgcatctgtggatgtcaaagcagcaacctcccttgagaaagttgcctttagcttctcgggatttggtaatcaggattttaaaaagggtgtcagggatatggattcctggcccacagactccagggaaaaataacagactatgtctcttctgaagcaggatgagaaaaaagccctggaggtcagaggctggatcctggtcttcagttcaactttcagtaatcttcttgagattgtgtataaagtggtatctgaagaggaggccctgacaggctgcttttcttcatcttgctccttaaattctcccactctctgtcattaactcagtgactaaattgtctttgtccttttgggccccagtcatatatcctcctcagactctgatttctttactggttgtaactggaaagtgacctgaaagttagcagtgggaaaccaggatctgtgttgattgattcagtagacttaattttacacaaaatgtttagtaaatagtcttggagggtaggagatgttgactctcctcaccagagaagttcagctgggcttttggacagcaggatatttctgctaccctgagatttgtggctatatcctaaagggttgagattattcttaagaaggatcccctgataagcagagttttttttttatattgtagtattctaagtttattacccaaataaatatttccttgagatttcaaattgaaatagttgtatttttttattagtgacccatgttcttttaagatgtctttcaaggcagaattttcaacatgattatgcatcttttacattgttaccttaatcatgaattattgaaaaattttatctacagcattctataacatctctgtgctgtgatctgataagttgtcatatttataccaagaaattttcagtctcagactctcccgtaagcacatgaagtatatgttaatactaggcagataagtgtgcatgaaaagatgctcagaattattagtcattagagaaatacaacgtaaaaccacaatgaccactataaacttactaaaatggctacaattttaaatgacagactataccaagtgttggcaaggatgtagaggatctagaactctcattctctgctagtggaaatgtaaactgaggcaaacatttcaaaaaaaaattaaacatgtaattaccatatgatccaaacattccactcttaggtatttacctaagaggaatgaaagcatgtgttcataagaaagacttgtacgtgaattctcatagcagctttatttgtagtagccaaaagctggaaacagcctaagggtctatcaacacaagaatggataaacacattcatgcaacataatactacacagaaataaaaagaagtgaaatattgctagatgcggtgtctcacacttgtaatcccaacactttgggaggccaaggcaagaggattgcttgagcccaggagttcaagaccagcctcagcaacatagtgagaccccatctctacaaaattttaaaaaattagccaggcataatggcgtccacctgtagtcccacctactcgggaggataaggtgggaggatggcttgagcccaggaggttgaggctccagtgagccatgaatgtgccactgtactccatccagcctgggcaactaagcaagaccctgtctcaaaaaaaaaaaaagtgaaatattaatacatacaacagcatgatgaacctcaaaataattatgctggagtggaagaacaaagacaaaaaaagagtatatgccacatgattgcatttatataaatttctagaaaatacaaagtaatcacagtgacagaaagcagttccagtggttacaacttttgaggatgatggatgcgttcattatcttgactggtgcgatttacaggtatatacacatgtgaaaacttatcaaaattttaaatatgtacagtttattataagttaatgatacttcagtcaagctgtttttaaaaacaatattatatttagatttggtgcttttgatacttttttatttcagggaggaaatccttcaacaatctttgtgggaaagagtatcaactcatgtgattgaaaacatctaccttccagctgcgcagaccatgaattcaggaacttttaacaccacagtggatatcaagcttaaacagtggactgataaacaacttcctaataaagcagtagaggttaggatataatttaattaaatgggtaagaagcattatctgaagggagtaggagctgtgaattttagattttattcccatcacagcctctatctttcttttaggtctttatatctcatttattctttattcctcatctctgttttgggactaaccttaatgttgctaccagttactacggttataaaaatttactaattggtatgatgttggcctgagggtattggtacttcttccaaagacaatatttaacaagcaaattttgcttgaatatgaaatatttgcttgagtatttgcttgaatgtgaaatattttgaacattttctgtggattctgtggattatagagattccataaagaaaatacttaatagatgaagcatttcatctgagctcagttatacttaaattatcattttcttaggatcctgacagaagattaaactaggaattattaaaaaacaaaacaaaacaaaacaaaaaactaccttaaagaatctatttctgctaccatgtatcttggctttatcacttaatagctgtgtgatcctttgcctagttgcttaactttcctatgtgttttttcatctataaaatggtgacaataatgttgcctacctcacagcattgttataaggattaagtaagtaattatatgtaaaatacttagacaatgcccagcccatggtaactgctcagggaatggacctgctgttattatggtcctcatcatctgaattgatccatcatgtacatcaccccataaacagcgattgttcaagctaagagtcagtgtgtcctgtgcttgtgtgtgaggttgctcacaaaattgaagtcaatgttaaaagtaattttgtttttcatacctatcttaaaggcagtgtcagtttctaattattcggatgtgatttcacccctttcctatcttgctccagtgttaacttccttatctctgttctcaatttcttcaagcccctttctaagaactccagcagcctccctgcctaagttgcacgttgctgagccctggcagttcttgacacatttacccctgaagaagttagagagctgctgctaccccttcagtagctctcattactggcactaacattttttctgcgccctgtcccatgataggatattttcacatcctaaggttcaagcagtggaagtggttatgaaagcatcaatttttctttccactgctgctttctgtccctcagcactaggtgtcatggaaagaatgtagatctggtgagaaggtcaggaaacatggatcttaatactcaccccaccactcactccgtatttttggacagtcactttcttttttaaaatgagagagggctaaaatccagcattaaaaagcccacatagttataagtagattttgttcttcattatttttgacactgtgctcttcctttcaccgttcagatcattaggagttagctataatacaaagctgaatactcttcggctatgttttaaagtgttggtgcattgcttcatatctttgcttaaagacaaagctatgaagatgactgaatcattaagacatttaaaaccttttgcagtgtgaaagaagcagtcagactcatgtcttagaggttgaaataaataaatgaactaacttgggtggcaggcttagaatacataccttatcttgaagagacagccctgttcagctacagtaggtggtgtcatgtaggaatatgggtatatccttctcagttagtccaagagaagccgtaaatgcagacttttatatgaaatctctcaatttttaaatattagcatgcaattttaaaaatgagaaccgctatacatgtctaggaaaacataccaggaagccatatctgtccccagcaacccgtgtgagacctctacatcatggtttatatttgcctttttgttaatgtagtttcacatatattttctgataagctgatttatttatcacatctgtttggcttgagctcgtgttatttttcatgttaaccattgaagtatgtagtaataatatggctttttttctttcaaataattataggttgcttgggagaccctacaagaagaattttcccgctttatgacagaaccgaaagggaaagagcatgatgacatatttgataaacttaaagaggctgttaaggaagaaagtattaaacgacacaagtggaatgactttgcggaggacagcttggtatgttgtttgtatactggggtatcagcctcatatttttatataacttctcaaattgatactttttcataggagactttatatgactaaattacattctgaattaaaaataatgaagtaaagaaacagatttatgatctgtaatctgccctttaatatttccctgcccttctaaaatcacctgttgctgtttctttcttggctatcatttcagaaaaaagtaaaactttgcagtaaacagactctgataaacttctacaaattgtcatctgttagccattttatgggcctgtctgtagataggtgcttctaattttaccctctgtgataatgaaaggaactacatgcgttggttttcagtggattataaaatgttagacgcctaaaatcataacaccagctaccatgtattgaatgcttactatgtgccaggaactctgctaggtattttgcaagcattatttgatttaattcttaaccactcctgttattgtcattgacagagctgggattcaagcccctctctaatggcaaagcctggttcctgacaccacctgataaatcttttgttatgtagactgctctcactaccaaaatcaaatctgttaagtgcctgctgtgctcagagagttactagaggtgttgttgaattacaggattgagcgattttctgggaaaatgcagagctggttgtaattataattttgttttaaagaagtgtttgtctttatggccgggcgtggtggctcacacctgtaatcccagcactttgggaggccgaggtgggtggatcacctgaggtccggagtttgagaccagcctgaccaacgtggataaaccccgtctctactaaaaatacaaaattaaccaggcatggtggtgcatgcctgtaatcccagctactcgggaggctgaggcaggagaattgcttgaacccaggaaggggaggttgcggttagccgagatcgtgccattgcactccagccaaggcaacaagagcaaaactccgttttcaaaaaaaaaaaaaaaaaagaaagaaaaccatatttattcttgttaaatgccttattaagactggcttactgagaaaacagcttcatttttattcatccaaaaattataaaatttggaagccaattttcaactgtaataaataacttttatgattttatagaccttttaaatgtctaccttattacttttttcgttgctgttaacactgggaataatggttaataatttttttctcctcatttttgaaaaggctaacatgtaggtcacatggcaaaaagcgatgaacatgatctgaattattaaaccctgaattttaggtttctagatgttgcatttcatgtagttaaatttgtaatattttgtataatgtaaatgtgtaatattacccacgcaccccatatggttagcttgtttaatttgggccaggagagaatctccactctttattttttagatagcaagctaacaaataagcaggcaagtaaaagaagcttatgcatttttataggaaggatatatttttatgctggtttatatacatggttatttttccatatttactaagctgtcaatttgaataaaactactaaaatgatgagatgtaaaacaagttggctttttctcttcttgttattttcagagggttattcaacacaatgctttggaagaccgatccatatctgataaacagcaatgggatgcagctatttattttatggaagaggctctgcaggctcgtctcaaggatagtaagtggagacacggcttattgagttctgagttcacagtggtgaaggagtcatccaactttagtgaacatttgtagaaatagattgaacatttcaaagtctttgtcattaatactatagtcgaatattatttgtggaatttttttagtcaactgctttgtaactactaaaaccaatgaataaaatggacacatgatgcttatatgcatttatattctataaagctataatgcagaatattttagtgtgttcgctactgtacttataggaattttataagcaattatacttttaggtatcttaaacacatatataattaaactcttacacatgtgccatatcagtcatgtgggttttttcctttatttcaactgccttcatattgatatagcactttgaaatagttaagaaagcaagaccattattagttataatttgtgtgtgtgtaagtgataaaattcttgattaattaatttttttttctagctgaaaatgcaattgaaaacatggtgggtccagactggaaaaagaggtggttatactggaagaatcggacccaagaacaggtagaaataaacaagtctctagtcttatgatgatataattttgttcattttaattcaggcattaaaatataacctttttgtggctctagaccagtctcaggaatattaaatgttttatatcatactttctaaaatataatgaatctttagaataaagaataaactacataagaaagttttttttaagtgaagtagccatgttgttaaaagacaagagatgaaacatgccccttttgtggttgattacattgttcatttcaattccctgtttgaggtaaaaaggaagattaaagttatgaacaggccaggcacggtgtctcattcctgtaatcacaaccctttgggaggccaagtcagaggaatcgcttgagttaaggagttcgagaccagcctgggcaacatagcaagacctcctctttactaaaagtcaaaaaaaattagccaggtgtggtggcgcatacctgttatcccagctactagtgaggctgaggtgggaaggattgcttgagcctgggagatcgaagctgcagggaaaataacttgtgaatagaaaaaaatagtaaggttttcagaggatgtacaatgaatatgattggcgggaaaagatacaatttttcttgccttattttattatcttatctatatctaccattaaagtccctacccctcacctccacccctgttcattcctttccgattcttatagcttcttttcctatctagcattcagtcttataccactgtctcattccttgttcattccttaaatgaaagaatctaaatagaatatagaatctaactacataaattaatgaaataatgaagatgaaaaagatttagcatccaatccattttcttttcttgtttgctttgttccttgaattcatttagagaaaggagatcaagtaatggaaaaatagaggagacaaagggaataaaaattgaccaaatgagatgtccctatttctttattttatattttcattttcattttaaatacagttaattgtataatctatatcctatttttttcctagtttcccacatttcttgtttcataagttctctatcagatgtgagtctcaactttcctcaaaataatgaagagacagtcttctttttctctgtgtttctttactatttttttttttggtaatgacttttgtgaaaaatgagccattaagagactgaagcaaagctgaggaagcagacagttagtgattgggtcatgcatgtgttcagggtgcgttggttatctctgctctacagatgggccgagagaaggaggtctgtcagaagagaatttctagagatccatccaaggtttctgactttgatagaggaagatgcattgattagaaagagctgctgtaagggagataaactgcaaaagaaaaatggtatctggccttcaagacttagtgatattaggcctaaagtctctagaacagttggtggcagaacttgcctcagcaactgactggtggtaaatgtgctttggccaaacactctctgaaagaagtgattcctgctcgtaagttatttttgtcaggaacttaaacccataggggaatcccttcaagagaaagaaaggaatttgctttaaagtcagtgcaaagggtctgtaagcctagaagaggaatctggaaaccctttacagaagagccttctccccacaggatttcagggcagcatgtgtgagacccaggctgactgtagaacagaggccataatttggaatatagaagggaggggcatctgaatcacccggggaggtgtttatatatagtgttttgttttttcttcaaaagctagcctcatgtcagactcattgagtcaagctctccttctctatcctttctatccctcccactcccagttgaagacaagtgttttcaacctcatacctggaggttacagtgagacatggattctagaagaggttgagaatatccctaggtctcacatcgtaagttcacttagctgaatgacaggatttggcaggaaaagaaacttaaagatgagaaatccattctctgaaaagtattttgtgcttttgtgtttcttttgttttctaggaaaattcatccctttgaaacattctcgccttgtttaagccaaactaatggaaattttggtcaggatagatccaagagtagttctctcttctaatggccaagtgtggtgacagtcaaatgatgggtagaaagggggaagtaaaacatgaggcaggatgagcttgggaacaccattaccagcgatttcctttccatctcagactgaatagtacatgtttaagcaaacagtgaactttctctttatcaaatgctcttttttctgaagtattagttttcagagagtattaattagtagttccatttacaagttaattgtttgcatttatgtgttaatcttgtctactcagatttcatagctgtgatagagtttggggcaaaaaaaaacactcagtttcgtagctgtggtagattttctattctagtaatttatttagggtaatgattgaatttaaagctagtttcttctatcatatacaattttgagtggaggtttgaaaaatgacaagattaatttaacacagtataagaatcttgttatcaaacataactagtgtaggtaagttttcctcctttggtaaagagattatgaataattacagataagagactggaagtgaatttaagaaggacagatacctcacaggagcagtctgaagtaccattttttatgaaaaagctttttaaaaatcaagctatgcattttatatttattggaaaagaaacatgtcaacaagtttaagtccttacagtaatctcgttcttaagtatagttcttagatatgaagcattttagaacatcagctcttcctatgcattcagggtgctttttcctagattcaaattataccctacggtcaagaaagaaagaaaatacatggtaagattcctggtgctgtaacttccacaggaaaaaacatttcagcaaaagtaaatacataacaagtagggctaatccctgggttttctaccctctcataaggcaaattcttctgtgttcataggccatttaccatattcataagccggggtgctgtgttctttcttgtgtttctttcttgtttgttgtgattaagcttgtgttatcttttatgcaatagtaatgtatttattaaaattgagactgtttttcaagcaccaaattatgaaccatctaaacacagtccttttttaaacattttaaagtgtgttcacaatgaaaccaagaatgaattggagaagatgttgaaatgtaatgaggagcacccagcttatcttgcaagtgatgaaataaccacagtccggaagaaccttgaatcccgaggagtagaagtagatccaagcttggtaataaatactgctgagaagcaggaatctgcttccttaatatttgtttcttgcagtaaatgttactacatgtgttagttagatatttaagtgcttaatttgacttttgtcacgtgtacatttgctgacagtaaaagcttagtcattttgattgcgtgaagagaaggaattttattctcagtattgcttttttaagagtaatgctttaatttgtaaatggagaaatttactttggcaagttcaatggtcaacagtcagttcatgcaaaatgggatgaaaccgacctagacctttgccccacgtcacgctgtttcagattgcaaaatagaatttctgtttaaaaatggcatatatatgtgtttttgtgtgtggtttacagtcaaatgtaactcaattagatgtgagtggattcagaaaaaataaaaatgttgtttttattaaattggatatgaccattgagttctttctccattgtcctcttttgttaatgtgagaataaaaatagtctacactttaggctactttttgcttaccttcatgatgctttttttgaggatgaattttaaaaaatactttcgggcccacgttttttaaaaactacattctctactgcttagttaagatgtaaggaattcaaaagctccttataatattagcttaagtgaacacaattagaaaaataagtctagtggggaaagcaatcattaacaaatttcaaagccacacaaactcttttaaagattatgtgctatttatgtttctgtacttgagggatgagtatacttattttaaattccaccacaggtcagaacaagtaaaaaaataaaaataaaattggtaaaactcaaagcagttatatacatctagcattatttatatattgaaaatgagatgaaagctaatgattacatgagctgtttgagttgaatgtggatttaggttttattcttgttggtcccagctctcgttaacaataagttatattcagtttgacacttttaaacgttatgtggcacgttggtgaatacagtaggagggattttctcttcagagtggtatagaagagatgttacgtgattttttttttaaactttttgctcatgtcttaggcaatgaattgactgtatgtcttaattagtttctaagaccaagaaaacctcaggttttttaagtgacagtttgttcagtgcactttgcaaagctataaaataagtagcaaagtaccacgagaagaatattgcatggactagatatcaggacatgtgaattctagtgtatttccattatattagctaataatatgtcctttaataattgataccacttttctgacctcacttacctcatctgtcaaaaggggttgatgtttttctagttaacattattattgttttgctcaaaaaaggacagagggtattaaagaatattggacactcagagtatctagtaataaagtggtagggatcatattggtatggtagcagtaaaattttataaacagaaaggaaatgttgagttgctagacatgatctgagaccatcttaagttctaactctgtttttagataaggctttcaacctctttctgcattggtttcctcacctctaactaggggaaggtaatacctaccctgtctactccacaagatgattatttgattatagtaacagcatttgtttaaatcattgctaatttttaagtacataaactggtaatgggtcagagtagtagtaaatctaatctttgccttaaaaaaagtaagtgaataaaaaaatttgaataactatgtaaagaataaccttgcttttgcttttaattaacttttttggtaaatataatttttgtacaacttctcagtgtggttgatcaacatgaagaatatacagtaactctgggctttcttttttctcattttagattaaggatacttggcatcaagtttatagaagacattttttaaaaacagctctaaaccattgtaacctttgtcgaagaggtttttattactaccaaaggcattttgtagattctgaggtaaggtttccaaaaacaaagagaagtatttttaagcaacagttgtcaaaatatgcttaaaagtaaactttagcttaagcattaattttaagtcctttgatcatctggggaaaaaaagtatgtgtaatttataaagaataatctaactcttatattttcaaagatatttgccactttgttcgtgatacgtgcatattatccccaatgcttataagaatatgtgaatataaatagtaaaaaaaagtgtgaatataaatagtaaaaaaaataaataaataacaggaaatagtcccttattccctgacctgtaagaattttagttaacatttttatgtatttcttttcaactttttctgtacatagggagagagacagagagggaaagagaaagtgtgtgtgtatctgtgtgtgtaacataaccatccatttgcataatggaaatcatcctgcaaaacagtttttatcatgcttttttcaggtgtcataattatttcttcatatcactaaatcttgttttaaataatcataaagttcttgtattaaaatgattcataatttaaagtaacccctaggtggcagcagtctgatatattttcagcattttcttacaagcaaaaatgcttttaaatatccttttgataaagctcagttaatcaacaatcttatttaattgagacttctaacatgctgttcttttgttttcagtagatgaacataaatttatatttaaatgcacctaattaaaagtggcaagttttttttgcataattttaattgtagagtgaacttctttctatagaaacttctgtagaaagaagaaacttctgtagaaactgccttctgtagaataagcttctttttaaatacatcactttattttcacacagctgaattttaaaaatggcttgagtacagactcaaagaaaagaggttaacctaaggacgtatttaagataaacatggttagctgaaactaaatataaatggagggtatatgctgtgaatttcaacttacatacaatgtaatgtaatttgctactactcaagcttatttactttgtcattagaattgaaacaaagctatctaggtgtcagacagatataagccaaattatgcagaatttcatggctccgtacagaaaggattctgtagcttatatctacagtatatgcattaggtaaatctgagtactttttaagcttaggacatatctactggttctagtagttgtatgtgtttacgatgatagttttcattttaactttgcatctggtaatcttagttacttaatatttcagttggaatgcaatgatgtggtcttgttttggcgtatacagcgcatgcttgctatcaccgcaaatactttaaggcaacaacttacaaatactgaaggtaagccacatagggactgcagtcttattttgacattaaaaaataatagtggtaatatccatatttaatagaaggatgccaaaatacttcccaaaagtagatttattagaaaaactggccaggtgtggtagctcatgcctgtaatctcagcatgttgagaggccgaggcaggaaaaccgcttgaggcctgtagtttgagaccagcctgggcaacattgtgagactctatctctacaaacaataaaataaattagccgggcatggtggcacacatctgtagttctagctacttgggaggctgagatgggaggatcacttgagccctaggattttgaggctacaatgagctatgatcatactactgcactctagcctaggtgacagagtaagaccttgtctctttaaaaaaaaaagacaaaaattattatttgcttttaaaataaatcataattggaaaagatgggtgataaaacataccaggagtttattttcattgcatgaaactctgttgggaatggactcctaggtatcacttagttttttgggaaatctgcacttccattaaagtgtatagcttaagaatatgacattctctgagactatataggtttcatgctgataaaactactgtataacagagattttctatgactatgaaaagtattagcaatagttctaacatgataaaaaatttactctccatatatataggttaattttatcatctttattcatttataaaaacgatgctcctcaggttttttaactttctttaaacagttaggcgattagagaaaaatgttaaagaggtattggaagattttgctgaagatggtgagaagaagattaaattgcttactggtaaacgcgttcaactggcggaagacctcagtgagtagttcttactgccctctaccttactacctttccacctttcccatttccatttgtttgttgatccatttaatctcaaacttacagaaaagttacaaggaactgggctgagcacggtggctcacgcttgtaatcccagcactttgggaggccaagatgggtggaaaacaaggtcagaagatcaagaccatcctggctaacacagtgaaaccccgtctctactaaaaatacaaaaaacttagccaggtgtggtggtgggtgcctatagtcccagctacttgggaggctgaggcaggagaatggtgtgaacccgggaggcggagcttgcggtgagccaagatcctgccactgcactccagcctgagcgacagggcgagattctgtctcaaaaaaaaaaaaaaaaaaaaagttacaaggaatttttttcttctctgaagtatttgagagtaagttgctgaccttaagtcctatcacttccaagtaggttcatgtatagttcttagaaacagattttctcatagcaaccgaacattgataaattacaatatctaattctcagacccctttcaagtttcacccgttgtcccagtattatccctccatataacaagatgttccaggctcaatacctgacccagcttcctttttttgaagaatggtgtttagaaatggagacctagaaattatatatgctgttattggaatatcactgttccctggtttctcagtggaaagagctaggaactaagtgttgtgaatgtttgtgtgtgtgcaggtgaatatacacacactgacatctgtattcctaaatcatgtgtatatttatttattaaaaactgtgagttgatgctgatacttcccattttaatccagcattacaaggtttgttctagtgttctccctttcgatatttgtcacttgctttcctgatagaaaacgggcttctagtatccttaatatattttcatattttggtcagtcctcctatacgtaacccaacttgaatgaagatatgtccttttccattgcagaaatgttctttttccccagctcggactcaacactacacaccaggccaccacatggcgccgcacccagcattgacacttcttttaccttgtctgggctctgacatccgtgccaggttgctcttcgtcatggagtcccttttactgagctctgctctgacgctttgtgccaggtgcctctccatctcatccttcccacccgctagcctctgcccgaccccagacagattccttcctcacctgaagccagaccatgcctttgtggagataccctctttaccctgcctgtgcttcgccagcctgcaccaggccaccctcctgcacagatactctcctcagtactggaccaggctaccaacagccccatgtgaacccattgtaacccaggtcaggcattaacacctgcagtaggctaccatggcttccccttcccacccccctagcttggccctactaataatcactttgtcactgtttggggttgatatttggttgtttcttgtaggttcctagctttaagataggattgcatactaaaatttacttagatctttgagaactcaaggaaatcagtgaaacattattgttattaaataaaaataaaatacctgtagttggtacctctgtttgagcctgccttgttacaagtttcactgacttcagcttcgtgtaacaaagtatctttttctttcaacgtgtacttaaatttcctgtcttattagttttctgatatctaaaaggaaaaaaagcagatatcgttaataaattagaaagaagttctgcaaatttaaaagtgccttctaagctgagttgtaggattacagtacaatccatagggttatcctgaagaagccaggcagggctcttctgtgttacaccctgtgcctgcgcagcatgctcaccccttgccatcagcgcttgcggccccattctctccctctagtaataatctaagttctgcattgctttctcctttccttttctttcttcctttaaatattcttctttcgagacatatctcattttaacttttattttcattttctgtcacttttggtttttctcatgccaccttggcaatgtagttaagtttgtgctaacgtagaagattagtgctcaaatctgaattgccatttactactagctgtgtcatcttcggcagggaatctcccagagccttagcttctttatttgtaaaatgactattatagtggttatttctcaggattgttagaattacttccgcaaacatttgcaagtccctggttcataatttcatgctaaattagtaccgttacaggaagtggtatatcattgtcacagtgtatacaaatatatttcttttatatccctcgtgatataattatcaagacagtgaaacaattcaatgaattttaccagcataacacatttttaagtgattggaaaatcataagtatcttttcttatgtttttagtagaggctttgcaaccccattactctccgctcccaatttgattatttaaaggaagtggattactaactcagatatgtacactgtcaagccaagttctatgttctactgctggttttcctgagaaagcagtcatataactcccttgaaatgatttactacttttgtacatataaaattataatggtgttaatgtaccaaataatgtccttggaagcaagggttttgccagtaactcagctgcatcagtcaccctcaaggagatgagccatgactttgttcattagttggaaaagagtctggagagtgccttttcgttactgtttatctttggtctgacacttgggaatagggtcatggatacttcagccagaaaactttccaaatttaagttattaatgtattataaggatcaaagtttctagtatagcctgttcaattagaacatagtgtgttggttgattggatttggagaaagggaggcaatcaaatttttactacagtttcagcctgttacagaatattgtatagagtgttaaaatgttgatgcattcatatttttgccagttttaagcttgtacgattttaaatcatttccttaccttggagacttcccccccacctttttttttttttttgagatggagtctcgctgtgtcgcccaggctagagtgcagtggcacgatctcggctcactgcaaggtggttctcccacctctgcctcccgagtagctggggctacaggcgcccgccaccatgcctggcttattttttgtatttttagtagagacggggtttccccatgttagccaggatggtctcgatctcctgacctcatgatccgcccgcctcggcctcccaaagtgctggaattataggcatgagccaccatgcccagccctgactgccctttaagatgagtacataagtagtagtagtacatttttctttcacatcctggagaagatatactgtgttcactattgaaatgaaaccataaagctagagttaggaagattgaagaaatgaaaaaggagctcacatgattttgtctcaggagaggctcttccaggattctttggagatatggtagattccatagctggagcagggaaaggacaggatgagcctgtgggtgtagaaaggaagggagtgcttgaaagatgatgaggagatgtcagcaggtcacagaaaccctctgaaggaggctccaactggccaggctggggacaatttgggccccaaaataatgacagtaacaaattgtaactcattgaatgaaataggaatccatacattggtaattatataaataagggaataaaaccatgatgcaaaaagggatgtttatgtcatcacgcaaaatatgttcacagaaaatatgtactaattaaaagagggaaaagagtaactttacagtggatgaagcctggcaatcatcactttaagcaagtggtcagagttaatattatcagtaatggtcaaatcaaaaccatatgcaagaagactctaaaatgcaagaagactcctgaagtacttcttaccaaagatgtagaacttaaattcagtcataacaatacatgagacaaacccaagttagagcacagtctgcaaaataactggcctgtaatcttcaaatgcatcaagatcatgaaagacaaggaaagagtgaagagctgctccagttggaagagacttaaaactaaatgcaatgtatgatcctagattggatctttttgctctaaggacattaatgggccagttagtgatatttgaaggggatccgagggttccattgtagtaatatatcagtgttaatttttaaatttttattaggttgggattattttggaaaataccattattcatagcgaatacaaagtagaatatttggggatgataatgcatgattacaacaaatgtttcaggagaaatatgatctttgtagtggtcttgcaacttttctgtaagtctgaaattgtttatgcataaaaggttaaaaaaaggttaaattttgtttttataactaataatggattagggtcatgtgaaagtactttagaggaaatgagacttttgagaacatcatccctgaagacgttgaaacactgagttacctcatggataatttaataggatatgcagctgatttttctaccttaatttcttgtttgcagtatctacccatacttagaattgtctggtgttaaaatatgcccactgggactttcatgaaattcttttgattttctagaaaattcagtttcaaaggattttttaaatagatattttaagtttggtgtcaacttagataaaatctgtttggagtcccagtgtaagttttagtaatgtgtccaatctgtttattgaaatagtataactttagaatactttctttggagagatgaagattggtatgttatagttcaattcaaagttgttctttctattatgatctattttataattcataaaatctatcttatgattgtcatcataagtgcaatttgttttttgccccattctacctcagaaactaagtatctgggcatcaataacaattggtagtagtgtttgctgctaagccaagtttcaccagtacagtgtggaattattttattgttttttctgtgaacattgtatctgctgttactaggttattgtgaggtattgggccttcatagaaattgcctggaacccttgttcactaaagcctgttacactttttattctctgtgcgtgtaatcagagacttattgatactgacacattcaaggggcattattgatcatttagattgctctaagacctaaggagtcttggccggatgcggtgcctcacgcctgtaatcccagcactatgggaggccgaggcgggtggatcacctgaggtcaggagttcgagatcagcctggccaacatggtgaaaccccgtctctactaaaaatgcgaaaattagctgggcatggtggcaggcgcctgtaattccagctactcgggaggctgagacaggagaatcgcctgaacccgggaggcagaggttgcagtgagccaagactgtgccattgcattccagcctgggtaacagagcgagactccatctcaaaaaaaaaaaaaaaacgaaaaacaaaaacctaaggagtcttttctccttattttacaataaattccttttgattttgtgtaaaaacttgaaactgtttatgaatgtaaaataacatttgaatacttttcttgtgccagatattaggttaaatgctttatgtgaattttcatttgattctcacaacttttgagttaggtagttatttttctcattttacagatgaaatggagggttaggaactcgtaggtagtagatgctgaagctgagatttgggcctgggtcttttcactactgtgccagaatcatttgggagggagtaaaaactcaagcctttggaaaatatgatgacataaaattgtcctttatattgagaagcttccatagttaccagtgtccttcacagggttgatcggaaagacatacatgttagtgatgatgataatgatgaagataatcattattaccacaggtacttcctataatataagcatctttcaaattgtatgagaactttcatagaacatctgagtaaatgaacagtacagtgtgcatgaaaccactaagcaaaccaagggaagttaattttctttatatgaattgtaaacatgtctctagatatcctttatcagattccaccatgcgtaagtagtgtctaagttgccccatatttagagtttttcaatgaggttgtgttcctacttagaatcctaaagttcagctataacagatatattaataaaatctgtggaatctttaattgagcataatggtggctgttattttaacttgaggctttttgttgagctggattggaagtgcaacttattagaaattacagtgtatttattcctatttcttgttctttatgtgagagaagatatactttagtagactgaatacttcagagctgtatctcatttaccaataaaatgtgaaaacagtggtaaattccttcacttgggctaccattgtacaggcctattttaatggtatagtttgatatccttaatgttaaaagcaatatagcttaaagaggctggtaaattagaattttccaatatcctcagctttttttcctctcacagttaatttgctctgctgactccctacgcgaggtggcaacagctggcccttttactggagcttgtggggattagagagtcgggctcgcagcagcgtgctcggcctcttgcctctgttgactgttctttattgtttgatgcctgagcatctcccagacagcgagcaattgtttctggaaacttaaagtttgtttctcttgggagtagacaatgcttttggggcttgtctttgtgtttcttcactttcccagtctcctcttatccttcatcctgtgctttctcttgataattagaaaggagcaaagataccacctttttatttaggtctgcatgagattctaaaacttagaagtataggctatagatgaaagtttcttttttcagtaagccacctcagtaacaaatcatgttttaaatgaaaactttgttcttcataatatcatttagtgagagaaaacaaatgcatgagtgcatttttgaaattatggtactaaaagggagcagcagcaaggtgacctaatactgccattttaaaagctaggattagaaatgtatcataactgcttaaatctaaaaagattctttcactgaatccaaaatatagttctaatttataggatagttataagaaatctctatgccatgtggaaacatgaataaaaagtagtcagaacatagctaaatagaaccctgaggtaggcagaatgattttattcttcacatttagaaaagaaaacatcaaggtaccctggaacttaatttctacagtgacttcacattccgacacttctcccatacctgccatacccttgagtgttgttacggatgagaatatcgtctgtgaagtagtatgagatggaaattttcctagaaagattattgtactcggaatttggaactgaaaagtgtagaaaggggaagtgatgtgtttaaaactgtttgcggaggtggggctctgccatgtgtattttgacaaagctacacaggtgattcttgccatccccgattaccgtgtacccgcctgcccctgagctggcactccaaagagttctttcagtgcatagcaagacaatttttcatgctattaattgggataaaattgacatacattcatttgtagagtctgagacacaacgtcactttggaaaatttggtgagcaatttgaactgcatctgcactggtgtgttctttttgtttctgtagacttaaccaaagaaaatgaactttaaagggactttaaaggcatctgcactggtgtgttctttttgtttctgtagacttaaccaaagaaaatgaattttaaaggaagagagggtgataccaagttgtagaattctaggtatgtaggttcagaggagattttttttttttaagaaaaaaaaaaaaaaaaaaaaaaacacccaatcaagaagaatagagcagggtgtcccgaagagaacgtgtgagctcgaagcatcccggcagcatctttcatatctcagtactgttgctctgtttcttgggctcacaacaccatttcctctctcctggcttttaacacatctcgaggcaaccttttccctttctttttatgcacttctctcactgcgtctcttctatatcatcatcacttcaacctaacccagtatttttatcccacctgcttatttaccttccttcagtgactaaaaaccttactcagatactgccagtgttgtttaattgagcagaatagaggcttctcactataggcaactgtaaatcaatgaaaataaccatttaaagaagaaaaacattttcatgtctatcacggtcgatcccttctgccaaagtgatttggttcattcataaattccccatacctcgtgtgttacatattgtactgtacacatttactgaatgttcgattgtgatcttgtaatacagactgttcattagcccccttctcttgacttaaaaagttggggggaactaactcttttcatcccaaggaaactttcttctactctgtcttgccagaaagttactgctcatttctcttgtagagcagcttgcctgtgtggcattcactcctgttctgcccactcccttcctaatatcgtgcagtctggctttcatctatatcaaaaccacttattgatagatcaccaatgatttcctaatgccagtctacccagttcaccaggaaactttaataactttttatgtttattaggaatttttaagttcattggaatacattcaagtactttttggaatgattatatgatgtagaaatgtgtatgtttgagagacagaaaaattgatttttttttcctcttcactacagaataaataatgtatttgttttatggtagcaatacttgaactctttaaggcatcttttcatggtaaatctggcaattttaaaaatctgggctttgtaaaataattttttttatagtaaggcagttaacacattaaagcaactaggaaagatagtgaagaattatttttaccttgagtctgtatagatgaagtaggctctgctttgtgttggaacagaacaaacaaacaaaaaaacctgagttgatacaaagataaagtaatcctcaaggaaagtcctctctgttagagaagtggttatttacacacagaattccacatgacaacgcctgagtggtgtggtttccaggttattgatgagaaaatcgagactcaaaatgggtcttttagaatgaagtacatttttcatggcctaagtctgtctttaaaagtcaccgttgtggccgggtgtggtggctcacgcctgtaatcccagcactttaggaggccaaggtgggcggatcacaaggtcaggagatccagaccatcctggctaacacagtgaaaccccgtctctactaaaaatacaaaaaatttagccaggcgtggtggcgggcgcctgtagtcccagctgctggggaggctgaggcaggagaatggcgtgaacctgggaggcggagcttgcggtgagccgagatcgcgccactgcactccagcctgggtgacagagcaagactcgtctcaaaaaaaaaaaaaaaaaaaaaaaaagtcactgttgaagaatatcaataaattagtacaagcgtaaaagaacattttcttttctataatattatacatgctgctggtaatcaacactttactagcaagtatattcttttgctttaaactcaagttttaactgattaagaataaagacaagaatgttctctacaataatgtatggattgaatttgccatttatcattttaatgtaggttttacttatatactattgtgaaaatactcttaatgtattcaaaaggccagtgcacaatttttttttcttttacttcttttttttttttttttttctttagaaagagtgtcacttgctgcccaggctagagtgcagtggtgtgatcatggctcactgcagccttgaactcctgggctcaagtgatctaatacctttaaagttgggaataaactttatcttaagcgtttttatttttaaattatgtttttgcatatttgatagaaaaagtagaatgtagtaattgaaaacctaatcacaaaacaattcattggactctgcaacagtatataaaaaataaaattaaacgagataggaaatcttaagggattggtggattgatgcacatgaaactggtaacctctgttaagtacagttctccaggtagttggagaaattagttaaatgtgaagagaattttaattttgcactattttgtacatttctaaactgtgtctcccacagcccttctcccccagtgagcacgattcagaattactttgaaatgttgtagtcttaattatcctattcatggaaatgacgaagctaatacacgatgtgctctatcttaaaagtaacagatattttcccaagtaacctactgctggttgtgatgctgagggacatttcatgggactgcatggtcgttgctcatcgtgataccatcctcagtggttgggggattcacagtgaattctcatatcctgtaactatgcatcatggatctatcatctgaaaataaatcaaaatctttgttgaactcacagtttccacacttgtatcacccatttaagattgtttcattgttacctcctgtgtacagaatatttcatttcaatttctcttagaacagctcattcatctattctctagtttcaatattctgagcagtagaagtttgctgttttgattaacttcagttagatctcttttctgggccaagaattaaagccattttatctttagtctctccttttgttggcactgcttcatagactgtgtcatatatacagatctgtctttagactgatctttaccaaagtacactactggaatttgagggtttttttttttaacatccttttcattatgagagagctagtgtatatgcattgtgggaaattagaaactatagatggcaaaattttaaaaaataattgccaccacccagagattgcactgtagtttaagacacttttgaatgtggtcctagggacataatttctggaacacatttttcgtgaagaggtctcaggttggcttcttatacccacagctcgttgtcattgcccctagttttaatttcccatcgctcagtgggctagattttttttcattttcttcatataaacttatttcagaaatgttcattaagaggaataagcagcattagtaaaaatgaaacctatggtacccattactttatatagttcaagtattctggaagccatattgtagcatagcatgtactgaaaatcactctcctttgaacagtaatcccatacctgtatttgggacctggccttcctttgtgtgcttgtgtattcattatatcccctttctctcttcaaagatgctcaagtcattctcatcttaaaactaatgggttgaaccttccatgcagtctagtagctactgtgaactctaatctctattacaaaggttagctctttgagtctcacttctactgaagttgtttttttttcccaagattactgaaaatttaagagaaaataatggcccaggcatgcattcaggactagaaaatacttccatgtacagaaaaccaaacaccacatgttctcactcataagtgggaattgaacattgagaacacatggacacagggaggggaacagcatacgccagggcctgttggggcgtggggggcgaggggagggaacttagaggacttaagtgcagcagaccaccatggcacacgtatacctgtgtagcctgcacattctgcacatagagcccgcttttgtttttgtttttgtttttaagaagaaataacggggaaaaaaaaggtttcaaaactcataaagaaagagaaagagagggagggagggagggaagaaaatgcttccatgtaactgcatcatttggtactttggagtccatatcctacttgaaactctaggatctggccctcacatttatgtagtgctttattttacagtttacaaaacttctgcttgtccatgtgtgtctgtaaagtcatatgaggcattatgcccattgttcagatagagaaattaacgttcattgacataaatggttaagcccattatgtaaatatttatggcaaagctggggctaatcatatgtgttacagataggactttttttaaagaattgtttaggtattctgttcatcattagtctctgggtttgtgtttgtggtaaccatagacaaccaagttcatataatttggcttcttttttatgtgatttttgatacgtgttaaggatctataacaatgaatttgcctcctaaagaggtacataatgttttcattcctccaaaaagataattctaggtttataaatctatgtatgctcagtgccagttgaattttgtgattgttcaatagaaaagaaattgtgacttaaaggtgattttccagtttaatggaataaatgaaattagtttagaagttatttttatttttctgagcctgattctcactcagttgtgataaacagcacctctgtaagataaactcggtgataaaccgagaacttctgaaatcagcctaacatgaatacctgttcttcttgtgctaagtttcataatgctttatcctaatacaccatttttttaagaaatggaacttgtatttcatttttgctttcatctcacctaattcataattttattaaaacctacgatttttaatttctttttttatgaatttttagtttggtgtataaatcagaattacattctctgatcttttacttttaaaattacagtgatgaactgactgtttaagaatcattctcatgattcattcgtctgttatgcctcctttttaaagcttcagcactgaaggtcttttgacaaaccaatatttataacagtttgacagcaggatgaggaacagcgtttgtctttgtaacagcttgaagaaagaccctttccaggacccagtcatgcagttacaatcttgacctctttcttatgctgggaacatgcatacagcagcacctcccatgtgttttcttgtcccattgactgtccattcacttcccatctgttttgcagtcttaaaggaacagaaggggccttcttataaatctgtctttgcaggtgataaatgatgcctacctctttaagagctgcctgggtggttttccttttcttagaacatttctgctttcctcctaactaaatcagggaaaaatacaattttaggaataagagaaaaagaagaaaagatgaatttttaaagcatttaattgactaagaatattttactgatcttttttaatcttcccaattaattgcctaaatcatattttttaaaatgtattatcgatatttagatttttgtcagggagtaaaatgaatgtattcattttgaaataatgtaactcttttttgagaaaacaaagccatgtatcattaatgagttaacatataaaataactttttaagttttttgtgataatttaagtgtggagcatcttatgtattggatacaaaagtaaaatatttcagagtaaatcattgtaatcttatggtaaaatctattcattttttacatttaaaaagatgatcataaatcccataaacatttatgcttttacttctgttgctgaaaataagtattgtaggaatagatattgatatcattgggttttctaagaattcagcagaaataaaaataatttactttttctcccatgcagaaattatttatgcaaggttttatgtaacaaatattgtccctctatggccctgcagaatattcttaaattactgatttaaaaactattaccagtataaaatgaccacttttagaatattgtggtgtattatgtgaatcagctggctaataatatatcttctgtggactagcttgttagtttgtttattaattccctggcatattccaaaaggaatttgaggcagcttacatatatcctacgcaaaagataaaactacttaagtgaaaaatttgggttgaaagaaaaggaaaatccaggcaagtgaaataaagtaaactttcagataaaattggtgcccctcaaagtgcatgctcaagggttctacgtacaggcagacctcattgtattgcatgtcactttattgcacttcacagttattgcatttttaacaatagaagttttgtggcaaccctgcattgaacaagcctgttggcactattttcccaacagccatgtgctcacctcatgtcactgtcacattttggtaattcttgcaatatttcaaatttttccattattattctgtctgtcatggtgatctttgatgtttgtattgtagctattttgggtaccactaactgtgcccatattagtcagtgaccttaatcagtaaacgtgtgtattctggctgttccaccaactagacattccctgtctctctcctcctcttcaggcctccctattccataggacacaacaatattgaaatttggccagctaataaccctacaatggcctctacatgttcaagtgaaagaaagagtgccatatttcactttaaatcaacaactagaaatgattaagcttagtaaaggaggtttgttgaaagccaaaatgggctattagccaaattgtgaatgcaaaagaaaagttcttgaaggaaattaaaagtgttattccagtgaacacacgaatgataaagcagaacagccttattgcctgagacgcaggaagtttcactggtctggatagaagatcaaaccagccataacattcccttaagctaaaacctaatccagagcaagttcctaactctattcaattctccgaaagctgagaggtgaggaagctgcagaataaaatttgaagctagcaaagtttggttcataaggtttaagaggaaaaaagccattctgcaacatgaaagtgcaaggtgctgatgtagcagctgcagcaagttatcaagaatatctaactaagataattgatgaaggtgattatactaaacaacagattcttgatgcagatgaagtagctgtctattggaagacgatgccatctagtaatttaatagctagagagaagtcaatgcccagcttcgaggcttcgaaagagaggctatcccctcattttgggtgccaatgcagcaggtgcctttaagttgaagccaacctaaagaatttaccattctgaaaatcctagggcccttaaggattatgctaagtctatcctgcttgttttctaaaagtggaacaaaaagcctggatgacagcacatctgtttacagcatggtttactgaatattataactctcgagacctgctcagaaaagttttctttcaaaatattactgctcattgacaatgcatctggtcaagcaagagttctgagggagatgtacaaggagatttatgttgtttttgtgcctgctagcacaacatccattctgcagcccatggatcaaggaatactttcaaccttgaagtcttattattttaaaaatacgtgtcttaaggccctagctgccatagatagtgattcctctgatggatttaggagaaaaaaaaaggaaaagcttctggaaaggactcaccattttagatgctgttaagaccattcaggattcatgggaggaggtcagaatgtcaccattaacagtttggaagaagttgattccaaccctcatggatgactttgaagagtttgggacttaagaggaggaagtaactgcagatatggtagagacagcaatagaactagaattagttctgttgtaatatgataaaacttgaacagatgaaacattgctttttatggacaagcaaagaaagtggtttcttttttcttttttttttttttggcagtctcagtttgaagaaagtggtttcttgagatggaatctgttcctggtgaagatgctgtgaacattgttgaaatggcagtaaaggatttagaatattacataaacttagtagataaagcagctgcagggtttgagaagatagtgtcccaatttttaaagaagaaaaatttgagtaaatttgggtaaaatttacccaaaattacctattgtgggtaaaatgctatcagacagcatcacatcctactgtgaaatctttcatgaaaggaagaatcaatcagtgcagcaaactacaattgttgtcttattttaagaaattgccatagccaccgtaacctgcaacagccaccaccctgatcagtcagcagccatcaacgtcagggccagaccctccaccagcaaaaagattatgacttgctgaaggctcaggtgatccttagcatttgttagcaataaagtacttttaaataagttatgtacattgtctttttagacataatgctattacacacttaatatattacagtatactgtaaacgtaacttaaacgcaccggaaaaccaaaaaaccttatgtgactcactttattgtgatatacgctttattgtggcagtctagaaccaaacttgcatatctcccaagtatgctgggactttgctagaggtaagctgcaaatttagccctcagtttcctggtggctggcagttacaaaatggaaagcagaggtcattccatcattcatggtggccatcagacaacaacacagcagttgcttaggagaagcatgggtcttcttcgtacgcacaactgagagaaatttcccttaaagtggacactgagttagatgatacaatgaatctaatggctacacataatcatgaaaatcatggggccctttattgtaatgtttctcatgcgggctaacatgcgtagttctagggaaaatatgatgctgtccaaacatacagctatttggtttggcttatctaaagataaaatacatagtatccagagaaatagatgaactgtatgtcctccatacagtctcccataaatattatttctttttgcagctgatccttttagtaaatatcaggtagccagaagttcaagattttacactcattgacattgacaagcacctggaatggtactaccttttttttttttttttttttttgagacagagtcttgctctgtcacccaggctggagtgcagtggcatgatcttggctcactacaacctccgcctcctggattcaagtgattctcctgcctcagcctcccaggtagctgggattacaggcgcccgccactacgcccggctaatttttgtatttttagtagagatgggttttcgccatgttggccagggtgatcttgaactcctgacctcatgtgatccacccgcctcggcctcccaaagtgctgggattacaggcgtgagccactgcgcccagccaagtactatttttattagttaagtcagagccataatcattataactgagctgaaattagaattgccatccacttaagaaagttgagtggtctaacaagtataaaagcctaaatataaggctaattcatgttcatactgaagccttttggggaataggccttaaaatatgtagaaagtatttgaagcggttttaattgtactagccaaaaggagcctagtagaaatgcttgtgttataagagtttattttttaaaaagctgaatttatctgaccaggcgcggtggttcacgcctgtaatcccagcactttgggaggccaaggcaggtggatcacgaggtcaggagtttgagaccagcctagccaatatggtgaaaccccatcactactaaaaatacaaaaaaattggccaggcatggtgatgcctgcctgtagtcccagctactccggaggctgaggcagaagaatcatttgaaaccgggaggcggaggttgcagtgagccgagattgcgccactgcactccagcctggacgacagagcgagactccatctcaaaaaaaaaaaaagctgaatttatcaacaaattgctgtggagttttttatatattcagcaggcatcagttgtaatttacctcacagactttcttaaggttgctttctttctaaattatactttatgggggtcacaaaatagcaatttttaaataatcacctttaatgattaagtattgtttaagtcagatcactcaactatgaatgcatgaatattcatggacatctattacatagcaagcagtgctatgctgggccgagtgattttaaatgacagactttttggtaagtagagaatttacccaagcagtccttgctgttctccacattaatgctcagaaaaaatacattataaaaatgatctttccaaaatgaattatgaagccccatgagaatgatatggcaatttgtggttacatattttactagaggattaatatccaataaataaaaagatactaaggaataaacaaaaaaaatttaaaagatgaagtatataatgaattagaacaatacattttaatcataagttttaaattagtgtggactttgaattctcctggacagattccttcattttatagataaagctaggactgtgacttatccagttatgaggttaacggcgaatacaacattgtcatatattttaaatgacacacattacaacatgttctctgctttataaaaatcatatcaaataattgccccatagattattaaaggtgttagactagggattcttaaaaaaaattttcatcaaatgtttctttcattattaatcccatgaagtccatgttacagaagattttgtctacaacagtgcagttacattcttctcgttagaaatacaaccaccagttagagttcctaatcagtataaggaagtagttgttaggagaggggatgggtttcttgtccaaatgaagttttccatttgagtttttgaagtagtgaaactaacccagcgtttacaggccccagaaatctgggaacctcagctttcaaagtactgtaccagtctttaacagttttcctggacgtgtgaattgatgcctccttctgtaacatgcaggagtgttctgtctgtcttcattgagtgttaaaaaataatcatgcctatttcaaggaaaaaatctacagaactaagatgcagaagataagtgctagatttaatcatattccttcatctatctgtttggttcaacctttcatcaactaaaagatgcaccttttttcttgtgctaactctaagattttagctacagttttgagaatcttgagtgtagtctcttgtttaccttttttcctttttttgtttcccccacaccctagattcatttaaatactgaacttctaaagggcaagtatatagtgtagtttaataaaaagcaaaccttttcatgaacaatatatattacataataagaagcgttcctttacttttcagtactctagtgaatagctttctacagtagaatctcacttagagggtgtcttaaagcttaacaccaagtgctcaggcagcatgttatacaacagttccattaaggtacatttggatctttggatgtgtggtttgcttaaagtacactgcattagtaagttggcagcttgctttctttaaaaacatcaaaagttttaaaaggtttatttcagggcatgtgttagtgttttgtgtgtggttctttgttcctgttctaaactgttattaaccactgaagtgaaccttctcccgggtttggccttttggtattcacagtgtattcaaaacctaattacagattagtctatatttgagacttttagagcaagtatcagaagacccaaaaagaaaatgagagtagcagtatcatttcatgtagagataaagagacccaaaacatgaatgggtgtcaagtcagctgaagaaaagaaaaaagagaaggaacttcattcactgagacggtttatgagttggggattatgggaatattcatgactcaatcaagaagcacagtgaattgatgtttgaaatagctcatcttttaagtaaacattggataaatggaaagtagactcagtattcactacacgtagaaatagctatttctgtatagcagaaatagcagtttgttaatcccttcctgagttggtttaatttaccaagtaaatcacaaattttattctttatttgtgaatatttaattcaaatatttaatggaaatatgagtttgctttataattagtcatgctgatccatacacgtatttctgagagaaagcaatttctaatggtgaaatagttacaataatatttttgaaatttgaaagcaccgtgatactgaagcattaatctgaaggatcggaaagtagggagtttttgttgccaacatttaacttcattgtttatggataacttggttttctgggcagccagatggcacagttagtatacagacattcttggaaacttgtatcaaaatttaaaatgaatgaatttatgagaaataattctgcttattatttgtaatgtagctttcttgaaaagcaagaaatcggaatgtagtttctaaagctgcaagtgaatatgtatacatagccagctctttcagccttgataataaggtgcaaccattaagatgaagggatttttttttcccacttgtgtttttgggcccgagtatcctgatctgtgttgcttgtctggttcaggtgtgagccaccagctttctttgactttcattatctatgtgtatcttgcctcctgttcccaggcttgctctagctcttctgatcctgtcttcctccctcttgatcactagtgtagtattcatgaagccagctaagttagtttttccctttgaaaaccacagcccttatcttctgtgccatattttgggcaacttcgtttatcattgattgaccgtacgcagtgatcaggccttgttctagacactgaagactctgagcatttttgggcccattttgtactcctgtattgttctccaggggcttctccaagtgtgcgtcaatttagtcttctcaagagggcatcattttcatcagaatatgatagcatattatggagtgtccggtcatccttaggcatagactacttaggaggtgtaactgttttgttccctgatttttactgaaatgggtcttttctttttttttttttttttttttttttttttttttttttttttttttttgagacagagtctcgctatgtcaccaggctggagtgcagtggcatgatctcagctcactgcaacctccgcctcccgattctccctgaaatgcgtcttattttaagtcaaaggtaatacttaaaaaagaccaaagagacttaaaataacagcatttgcttcgtcactatgagctttgttattatgagttaacatacagtagcagactgggtgtagtagctcacgccctgtaattccagcagtttgtgaagccgagtggggaggattgcttgaggccaagacttcgagaccagcctgggcaacatagtgagacccccatcttgacaaaaaaaattgttttaaattagccaggtgtggtgctgcatgcctgtggtcccagctacttggaaggctaaggtaggagaatcgcttgagcctgggaggtcgaggctgtagtgagccgtgtttgcatcactgcactcctgggtgacagtgcaagactctgcgtcagacaaacaaacatcgtagcagatgtgtttcttaatcagagaagtgtagacaaggctaactccaggctttaatgtcctcatatttagcaatgatacctgcaaggttgtatgagaaccaaatgaaacgccaaatttggaaatacatagtagatacatcatagcagagtaagccaggaatgcttctcaaaggtaggatatcatctgtgtcctcatatcactttatgaagtacattgtgaaagtgaaagaacaaagaaataaatgttttttagttaatgtttaaaggatacatttatcataattgctcttttaacactcacctccagtctcccctccgttcacacctcctacccccattacttcctggtaacttagttaagtgtcctttgtcattcctgaggtttcaaggcatggtagtactgtgtcctgatattctaatcgtaaatatttaagggaaattcggcattttttcattttgtggttttcatattaaagtacattaaatagtctttttgcttttatttaggaaaaaaactgcttacctgttaattttagaaaaatctgattttcatttagaccttacagggtgagacacctgcatcagggtggctcttggtatctttcaattcaattggatcttctctgaatagtctcttgtagggagtgaggctgctgtaccacctccctgcagtagtccatccagcttaagatgggggtcaccagtaggccaaaagaatgggtagacctggccatgcactgccctattgtactcaaatcgtgtatcaaatggagttggatttcttctcttcatacagtacagcatttccaagtagaaatatttctcaatgaaatgtggagagaagcacccgtttgagattcccgtgtgttgtgtgatttaagttagatggttttttaagaccacattcatttccagcattctaggtaacaatttagaaaatgtctttctcctaacctccccactttttaaaaatcctccaactgatgaactgatgtgaaactttcttacattcactgaaaaaaaaaaaaaataggttaagctgtttctaagcaactagatgaattaatttttaaactaagaatgtggccttattttgggaaaacaagaatatttacttgtttgtctgctgtttaaaaaatggaagtcagcctaccaaaaaattgagactcaacttctaggagatgggttaggatttttttttttaagtttctctagtttaattttatatataaggggttaatgctaccttcataataactattatcatattttctcaatacatagcttgattaaaacaactggactccccccccaccccaccccacacacacacagattttatatcagtctgaatctaatgcctagaataagaagtgcttcagccaggcatagtggcactcacctgtagtctcagctactcaggaggctgaggcagcaggatcaattgagcccaggagtctgagtctagcctgggcaacatagtgagacctagaagttttaaattactggaaaaataatatgaaaagaataaattactggaaaaagaatatgaaaatgttacgttctttatatccaaccgtggtaggcttttttgagttcctgcaatgctaataagaattcataaaaaggacaattcttcattttcttgggtactcatcactaatagctgcctcgctggtaaaaaggaatacatgtatcttcaattgcagattatttacttttaaatataaaagatataaatgtcaaatattaaatgcatcttacatggttttcctacatagtgaaagtagaatgcttgccagttttgcctctaggtcactcactttgaaccagccaacccaccttaattgatcatttccactaatatgttaaattaccttaaaagaacaaaaatatttatcatgcttactataacctgtgttttaaaataggaggccaggcacagtggctcacacctgtaatcccaggactttgggaggccaaggcaggaggatcacttgagcccaggtgttcaggaccagcctgggcaacaaagtgagatcctatctccacaaaaaaattaaaaataaaaacttagccaggcgtggtggcacgtgcctgtggtcttagctacgtgggaggccaaggcgggaggatcacctgagctcaggaggttgaggctgcagtaagccctgccaacaccactgcacgccaacctgggcgacagagtaggacccccatctcagaatataaaataaagtaggaggtgcatgtgaagtagtatagatcatgacttttccaattttaagaggggattggcatgtactatgagcagttcacatttgtggaggaaatctacatttcagagagtatatatttcatttggaagtctataaacatgaaaacctaaaataaataatgtaaatctacctctagtggctctggtatttttaaacttatttatagctggcaaagtacttttttgtatgtatttttatagcaccattgcacttctcatgtttgttgcaagcatctcccacagcttcctttgtcttttaattttatgacatataaataaaagtatacatttcaatatggccatattgattgatcttttcctttgtaactcttactactttatatttaaaaagtcatttcccagtctaaggccacctctattttcttttagttttttaaaatggtttcattgttttatatttgcctatgatccagacattagtaactgtgggttcttaattgggcttcagagaatctgagaattccttaaaattctctacataattgtacatgtacttaatacatgcttttttccatgttaagagtccagagtttttgttagatcctcaaaggggtcagtcagtctctcctcccacttccaaaaaatgtctgagacctactactataatccatctggactttatttgggtaaaaggtggtatggtgagactcatatttttctttttcccgcaaatagttaagtataccaaccatttagtaaataattacctcctgatttgtgatacctttgaaaaataaatgtttttctttatttttatctccacagagaaagttagagaaattcaagaaaaacttgatgctttcattgaagctcttcatcaggagaaataaattaagtgagtaaaaattctctaactgtattggtgctgactaaatacaaaattacacttttcttaatagtttatcattctgcttcatttacatcctgcttgtcacttatgctgtaatttcaatggcatgaatctctgaaactagcttccgaatttcatttgtataacgttgctttgaataacttgattgccttctggctgaattaagaatatcctctagaactcattttgaatagaacaaaggtgaacacagagctaagatattgtataatatgcaggtgactcattttctaggtgtaaagaattgagctgtagttgacattactttattcttcttgcctatagtctatcaataatgatgtgtatgttaaatatttaacttagaaagttttctgtttgacttaattaaaattttaataattgttcttaatccttatctcttttgtttaaaaacatttagataagtgtttttcctacttaatttatatagccttagaatttagtactccttgaatttactttcttgtctgattctgctttctggcattagaggcatgttcctaataaaatacatatttaaggacttttccttagtagcataatcaattaattgttgctgaagaattttaatcagtaagtcacttgcttgagaggagacctcgctctgccacccaggctggagtgcagtagtgcaatcactgttcactgcagcctcaacctcctgggctcaagcagtcctcccacatcagcctctcaaggaactggggccacaggctcatgccaccatgcccagctaatttctttaattttttgtagagatggggtttcaccccgttgtccaggctggcatttgcttttataaaagaagttgaggaaagaaaaatactgtagttaagtcattatcacttcaaatattttgtcacttttgtctgtgacccttaccctacagacagcctgcagcaggctcagaactagaaggagtagaaatgtaaaaggttccctccctggctacgctcggttcaggtcagttcagaaaaggctcttaaaccaaactacctactttcctgtcaggaaaatgtatttgagaaagcagggtggaaagggaagtacaacttccatggtacatcattcggaacagtgtgccagcaaaggaggagagaaacaagacctagaaaacttgaaaataaagctttgtaactttatttcatttgtttctttagtaagttaagacaggccagtgcggtggctcactcctgtaatcccagcacttagggagaccaaggcgggcggatcacttgaggtcaggagttggagaccagcctgaccaacatggtgaaaccccgtctctaataaaaatacaaaaattgcccaggtgtgctggcacatgcctgtaatcccagctactcgggagcctgagtcaggagaatcacttgaacctggaaggtagtggttgcagtaagcagaaatcgtgccactgcactccagcctgggcgacagagcgagactcttgtctcaaaaaaaaagtgaagacagatatatggaaatatacaaaaatacataatcatctttaacacaagctaaacataatttttgtgttttataagtgtccgtgttcataaatgttttctatgtcttttgtgtatgaatattttattttaaaaccattaagtgttacaatatcaccctaatcatggtggttaccgtgaatacttactattagaaataaacatctgtagcgcctccttgatctcccctttagcaccagagcttacatcatagttctatttactgacctgtgtgtgctttgcggggaaaaattgatgaaagccccggaagccccgttaaaaagacaagctgtatttctgtttttttaacaaaatgaggaagctgaaagccagccagtgttttacataatggtgtctctcccctcagctgatcagtgtgacatccagagttgctgttgctgctacctgtctagtctctaagacccttttcaacccttgtgacttaagactctgtgaacttttacaaagtatcttgtgatctggacagatgatctgttttgtaccctgcagatgcatttaaaagaataaatctggcagaatggtaaccttgcttcattctgaccattttatcaaagttaccaaggaccctaaggaatactttctcaagtatagttttaacacataggattcctaattaattgttattctaatatttgctgaaggtgtttatatgctatacagtcatacacagattcttcttcaattaattttagtatatgcttttaacttatgtttgataaaaaaattatgccaatattgttaggtcggtgatagactatataagtttagtaaaactagcaaaggtaagcggttaggcttcaacattgttgtgatcatgcagtcatcaactttgtttagaaattttgcatttatctcccctgacctcagtttgttaaatgggtttatttttacagaatcgtactcataatcagctctgcatacatctgaagaacaaaaacatcaacgtcttttgtccagcctctttttcttctgctgttccacctttctaaacatacaataaagtcatgggataaaaataatcgatgtatgttacgggcgctttaaccatcagctgcctctcgaatggaagaacagtggtaatggattaacatcctattttgttgtactaaagtgacaaatcggaataatataattggtatggccattaggttcagtccttgaagataagaaacttgttctctgtttgttgtcttatttgtggtggcactcgtttaatggattaactgaggttgctcaatgttcagtttcttttccagaaatacaatgctaggtgttttgaaataaaacttatatagcaattgtttaaagttatcaattgtatataaaatcacagtagcctgctaaatcattgtatgtgtctgtagtattctattcccagaaactatttgaccatgataattcagtttatattcaccacatgaaagaaaaatgggtaacagaagaacccttaaaacaggttaatttggattgtaacgttcagtgaaagaaatttcaacccttcatagccagcgaagaaatttgccttggaagccaagtcagtaccagcttacctatttgattcagttgctgttttctcactctctatatccatttgaaattgatttattttagatgttgtatacttacgttaggctttctgttaatagtggtttttctcctgttgacagagccaccggattatgacacaggatgaggaagattaaggataatcaattgactaatttcatttagaatattatcaaacatttcaactaggtatcagaaaaaggctttctttcataagactattttaaatagaaattatttcaacaattaaagtaatgttgaccatccccctctcagctgaataaagaaaaatttagttcaatttattgcaatttaattacaatactaccttcacaacattttcatgtgttttaaataaatattttttaattggctaaaggacattcaagcaaagaaatgctttctttacttaaaatgtctatctcatttgctgccttttcactaagcctttactttgttaataaaagtgtccattgtgtgatgtttttgattttacagtttgctaaatcttattttcttggagttgctttttggtaacagccccattgctactccccattttattgttttacatcaatgcatgcttcgttgtgatccctcaagatgtaacacttggtatgctcggttgaggatatgaaaaaatacttccgaaaccaggaattcaatgtatgtttgttttatactgtttgataagaaaagtaggtccagccttaagcagcacagatgcgctggtagatgcatagtcaggaactttttttatttcttttaggtctagggacaggagtgaatagaaagggaggagagctctattatgttctatacacagattaggagatgaccttactgggtacacccctctaaccagtgcttacaggttaatgcatgttaatgaatatttttgcagttgtaaagcataacaattacaactacacatctatttctaaagaataaaacaggaccatatttatttacttctgtcaactatagaaagaaagaccttcagctgtatttccacagatttctcccaaggaaaaggctaatattagtcactactgttatcacatccctttgtataagttttaaaaagagatggagggagatcttcatttctttgaggagatcagtattgtaacgtatgtgaatagatgataacaattaatattactaaaagtcccacatgagagtcctgacgccctctccatgccccacagtaatgtggcttctttcatgggtttttttttcttctttttagctgatctcatcctaagcatgctttatttttccttgaaagctaggtatttatcaactgcagatgttattgaaagaaaataaaattcagtctcaagagtaaaccctgtgtcttgtgtctgtagttcaaaagtcagaaatgattctaatttaaacaaaaagatactaaatatacagaagttaaattcgaactagccacagaatcatttgtttttatgtcagaatttgcaaagagtggagtggacaaagctctgtatggaagactgaacaactgtaaatagatgatatccaaacttaatttggctaggacttcaattttaaaaatcagtgtacctaggcagtgcacagcacgaaataagtggcccttgcagcttccccgtttaacccactgtgctatagttgcgggtggaacagtcaacctttctagtagtttatgatattgccctctttgtattcccattttctacagttttttccgcagacttctttctgcaaattattcagcctccaaatgcaaatgaatgatataaaaataagtagggaacatggcagagagtggtgcttcccagcctcacaatgtgggaatttgacataggatgagagtcagagtataggtttaaaagataaaatctttagttaataattttgtatttatttattctagatgtatgtatctgaggaaagaaatctggtatttttgctttccaataaaggggatcaaagtaatggtttttctctcagttctctaagctggtctatgttatagctctagcagtatggaaatgtgctttaaaatatgcttaccttttgaatgatcatggctatatgttgttgagatatttgaaacttaccttgttttcacttgtgcactgtgaatgaactttgtattatttttttaaaaccttcacattacgtgtagatattattgcaacttatattttgcctgagcttgatcaaaggtcatttgtgtagatgagtaattaaaaaatatttaaatcacattataattctattattggagagcatcttttaaatttttttctgttttaacgagggaaagagaaacctgtatacctagggtcattatttgaccccatagtataaccagattcatggtctaacaagctctcagtgtggcttttctctgaatgcttgaatttcacatgccttgcatttcacagttgtactccatggtcaaccggtgctttttttcacatcgtggtacttgtcaaaacattttgttattttccttggtaaaatatataaaaaaggttttctaatttcactttgctgccaa

SEQ ID NO: 13 - DNA, 121035 bp, Homo sapiens
  source 1..121035: mol_type = genomic DNA
ttattctcagtttcccgcctatgagaggatacccctattgtttctgaaaatgctgaccgggacccacacttccaacaaaaattcctctgcccctacagcagcagcaaaagcagcagcagaagcaacagcaacagataagtgttttgatgaattgcgagatggatagggcttgagtgcccccagccctgctgataccaaatgcctttaagatacagcctttcccatcctaatctacaaaggaaacaggaaaaaggaacttaaaactccctgtgctcagacagaaatgagactgttacagcctgcttctgtgctgttccttcttgcctctaacttgtaaacaagacgtagtaggacgatgctaatggaaagtcacaaaccgctgggtttttgaaaggatccttgggacctcatgcacatttgtggaaactggatggagagatttggggaagcatggactctttagccagcttagttctctgtggagtcagcttgctcctttctggtaaggtttggctttattttttttaatttagtattttaaaaaacagagttagtgatttctgggtgctctccccaaatctcatcagtgctgatgaacaaggggtggctgtagcaaaggcaccatttctctgtgagtctccagtcaatatgtgtggaaggattgaaatgcaaaggctctgtggcatgaactgattttgctagtttgtcttctgggtgattggcccctgtgttagaaactctttgaggaccgattaaatcatcttatttgaagagatccccttactatcatgcattattttcctgctcctcattctggagtgtttttcttattgattttttttttaaagaacaaaccggttttacctgctttaaagaaaatcttcagtaaaaaatgaaattcatgctgagaaatacaggggcccaattaaggcagtgtatagattgtcactgttaaaagggaacaaagatgcttttctgtaaaaagattttatatctacatcctattttaagcaaagcaatgaaattgtaggcttttttttttttcttgtagttagggtcagggagattggggctattagaatttttgttttattttaaaaaatgtttgccatgtagtaattcataaagggtttactggcccaatgaaacaaaaatttaggcagttaccaaaatctttaacacaggagagtatatgaagcctgttgtagagtgaaggagtggttggccagtgtgttgggttcagcgtgtttattgcttagatactccagatagtggtgtgcctctgtagctcactcagcctatgtgacataggtagaaggcagtatccaaacctgaactacatatcacaaatacatttatcattgccatcagtctctccccttcggtttgaaaacattctaattttaataacgaaaatcgaattgatattggagatgaatttgggaaaattcactaaacttcatggatatagggcatattaatataatttgattcgagtatacataagtatctgctatattttctaggtgtttgaactattttattaaatattcaaaaaacaaatccaatgaaataactgagttgaatacagtttgttttatagctctcaacaaccaatattttgagaatttaataatattctttaagaatgtgtaacacaagttgctaaaaattaaaagattttaggtggcttcagtatttatgtggaaattgtttaaataatgttgacttctccaataatatgtacttcaaataattatcatgattccatttttgatttttttttttctgagtgccattatttaccagtgacatgaaatctggaacttactctataccagggattatagtgatgtgaagcccaggtgtctatagtttctctgaggtactttgtaggttaatacacacacaactgttttcattcactttttttactcctaaagcaactgtgttatagcactttgcaatacaggcttagaagaattgtcataaaatcaaacaaaaaggtatgtagccaaaatacttgttccatgtctagacctcagatccctggaaaaaacagcactgcctttaaaaggcagaggaccaaggagaggaagtaggttcatgttcttgttaggaagggtgacactagcaaggttagtttctgaggtaggtctgttgtcttgatcgtagcttgcattcctagtctaagcctccatgagcatgactgctcaaggcttgataattgcaacaagaatccagctagataatgtccacagccataggagcccgttcctctagtcaaactcctggtagactaaagcagtggagcaaggggcttatggcttaaaggtttatctctctagtccagtgggttgtttcttgtttcttttttctgaacccacagactgaaaaaaaaaaaaagccacttttttttagtgaaggtggctctggatgacagagttgtttacccataagagggctggaggggatgtgtagctctcagaagctccttacaaatactcctagattctgttgctttccttttctgaattgagaatcattgctaacttcagctttcaaacaggttctattatattagcttttccctactcttcctcataaaaccaggctgttctctttaaaaagttgtatatgtagaaaactaacaaaaaaatcactgtgatttatcatagtatcttctacgtgatcaacaatgatctaataggaagtctctagtctcatgctttcatacctctttactgtgtcacttgacttttttttttttttttttgagatggagtctcgctctgtcacccagactagaatgtagtagagtgatctcagatcactgcaacctccgcctcccaggttcacgtgattctgtgcctcagcctctcgagtagctgggactacaggcgtgcgccaccatgcctggctaatttgttgtatttttagtagagacggggtttcaccatgttggccaggctggtctcgaactcctgaccccaagtgatccgcccgcctcggcctcccaaagtgctgggattacaggcatgagccaccacgcccgcccttgtcacttgacattttaaataacaactggattcagagatagcagacatcttgtctggggtggcagaggaaacagttgtaaggtcagggaagtgctcccagatgaaacccccttgttagggctggtctcagaaggctagtgtcaagtctgagtaatcaagggtggaggtctgaaagctgggatcggagacaccctttggaattattctcagagggaggagcttgcttttttcacagatgctcccttccaagcattgtctttattgtttgttaggtctcagcatttccctttcagccctgccctgggagagcttcctggaagagtctagttcttccaaggcgtctctccaggagggaaggagtcttctaagttcatctcaaaagactatgtgatgttctctggggaatttaggtgggtgggctctaaattcttctgaaattatcagtttgcctcctgagcctctatctccccaaaggatatctgtgtgattgtatcacctgcttattctctgtagatggcttactggtgagctcacagaatcaggatttaaatagattgttctaggctggaagggtggaaaaccaaaacaaaaagataccatttcaaaataggtaaatgtctggttctgtgtttgggttcaagaaataagttatgtatatttaatgtgggagagacctggtttgttgaaagttcttgtgaatgacacctaggttttggggatacacaaaagtcatggaagacaacataggctctgcttgctaaaaaggtactgcataagctgtcatatgttgtattagcagaaatatgaagtccaaatcagaaatggtaatcacttcactgaaatctactgctaagagcacatccatgaagcactgaagacctgagaaatttaacagcgaacatagcaggcaaactgaaggaggaaacatggattacaaagtcaaagcccaacttggataaccataagcaagttatttaatttctctaagccacatttttctcatcttttatggatgaaatacccattttccagggttgtgatgagaatcaaatgtgataatgcctgtgaaatgcttagccagtgagaactctcttaataaatgaagcttggggcctggtgctgtggctcacacctgtaatacagcactttgggaggcccaggcaggtggatcatgaggtcaagagatcaagaccatcctagccaacatggtgaaaccccatctctactaaaatacaaaaattagcaaggtgtggtggtgtgtgcccgtagtcctagctactcgggaggcttagacaggaggatcgcttaaacccaggaggcagaggttgcagtgagctgagatcacgccattgtactccagcctggtgacagagtgagactccgtctcaataaaataaaataaaataaaataaataatgaagctagtataatcaaaagagaagtgttgctatgagaaccactgtgctagtcaagactgatctaatctgccccaggatgtaggagaaccacttaatattcatagatgctgtctctttctacaaaacctcagtataatcctgtctctcaaactttgtgctggccaattccaactgaataaacccaaacactttgccaactacccatctaccctcccctcacttatccatttatccctgtttgtatcttgtctgcttcaaccaggcccatctccacaatctacacattctttcctcttggctcttgttcatgctgttccatccatttagaaatggcatctttcatctctactctgcaaacacaattcaactcaatttgcccaggccaactcttcctcctgatgttcttcccctaagtttaggctcctttaccatgcagattgtgtctttgagctttgggcagccagatttagcccaattagcctctaaatctctcacaacagatattatttcttttctattctcattagtacatgtatttaatgtttagtaatttctgttgaatggagttttatggtcacagtaagaaaatgttggtacttcacagcggagctgaaaggaaaagagaacattgtagaaaggatctcagtaacatcgaaataataatattacattgggccaggcacgttggctgatgcctgtaatcccagcactttgggaggccaaggtgggcagatcacgagatcaggagtccgagaccagcctgaccaacatggtgaaaccttgcctctactaaaaatacaaaagttagctgggcatggtggcatgtgcctgtaatcccagctactcggaaggttgaggcaggaaaatctcttaaaccagggaggcagaggttgcagtgagccgagattatgccactgcactcgagcctgcatgacagagtgagactccgtctcaaaaaaaaataaaaaaaaatttaatattaggttggtgaaaagtagtggtaaaaactgcagttacttttgcaccaatctgataatcaattttatatatcttgtaaatgatattcactctcatcttaaaagtttagcttatattaaatgtttgatgtaaataaagttgaaagaaagtttcttctgttaggtgtgaaacataaaagatatactcataaaagtggttctaaccagggccttacttaagatgaggtattgtatgattgttgaatattacctataacatagtcgtattttctattcaatagatatttattgagttactgtgtgccaatcattcattcattcattcactcatctatcctttcaataaacaaagacttattgagggtttcctttgagccatgtactgtcctggaaactaggaatataaataaggataaataattttttccctttgctaagctcacattttagtgggaaaaatgaatataggcggatgaattgtaaaatgttgtgataaatgatttaatagagatattacagcaaataaaggtatttacaaaatctgagcttttcaagggctgtaaaagtttttattgggtccaatgatacaaaatgaaatagcaatatctgaattgagcataaaggtctggtgcagtggctcacacctgtaatcctagcattttgggagactgaggcagacaaatcgcttgagcccaggagtttcagatcagcctgggcaacgtggcaaaaccccatctctacaaaaaatacaaaaattagcctggcatggtggcacgtgcatgtagtcccagctactcgggtggctgaagtgggaggattgctggagcctgggaggtcaaggctgcagtgagccatgatcataccactgccctccagcctaggcaacagagcgagacattgtctcaaaaaaaacaacaaacaaacaaacgaaactaaattgaacataaatatttaattaaatgtctaaaaacgtggaatgtcaactaaagaaaatgagtagtattttgaaaacaacttgtaggttgatttttctgtctttgcaagaactcctaaatagttgtgaatattgccaaaagtcaggtccagttatagttataacttgctcatagccaaatgattttgaaaccaagatgaaaaggaaaagggaagaaaggacatagagggagcaacctatacaaagggggtgtgtataaaatagcagggcaggcttaaggaagctgagtgaagctgtaatgtaggatgaaggtagagaattaaagttggggtcagatcaagaagggcctcacaggccattttaagtaggttgtccctcattctgtacatgttgaaatttagcagagtgtttgttctatcatgtcatatatcagatttatgtcttgaaaaattcactctaataatagttttcaggatggattaacatggtagagaccataggctgggaccaagttggcttcctaacattccaggcaagaggactgtgaggataacagggggcttgagagagatttaggaggtgaaactgcaggagttagtgattggttgtatatggaaggttgagagggagggaggagaataagtcattgctccagcattctgatttggataatggtggtgccattcagtgtgctgaatggaggtgggctgggataaggcaaataattattttgttcatgttgattttgaggctacatgtaaaggaagtttttttttttgagactgagtcttgctgtgtcgcccaggctggagtgcagtggcacgatcttggctcgctgcaagctccacctccccggttcaagtgattctcccacctcagcctcctgaataactgggattataggcacctgccaccacacccggctaatttttgtacttttagtagagacggggcttcaccacgttggccatgtcttgaactcctgacctcatgatccacctgccttggcctcccaaagtgctgggattacaggcgtgagccaccgcacctggccataaaggaagatatttatcaaaatttggctgcccacatctgaagctcagaggaaggggattgggcaagagattgagatgtagaaatctttggtatatggtaagtgaagccacgggcatggctatatttcaagattgaaatgaaggaacgagaaagagcagatacccaaaaatttgatgaagaagaaacaggtaaggagctgacaggagaagcaaaaccaatgacattcctatcctgggactttagagaattgctgctgtagcagccatggaaagaaattttttttttttttttttttgagtcggagtctcgctcagtcccccaggctggagtgcagtggtgcgatctcggctcactgcaagctccgcttcccaggttcacaccattctcctgcctcagcctcccgagtagctgggactacaggcgcctgccaccacgcccagctaatttttttttttaatttttagtagagacgtggtttcactgtgttagccaggatggtctcgatctcctgacctagtgatccgcctgcctcggcctcccaaaatgctgggattacaggcgtgagccactgcgcccggccggaaagagaattttaagaagacagtaagatggggcagcagagtaacagcctccgggcctgacactggagcaccagcctgcaggtgtgttattttacagagagccagctgcaccggcagcatcaccaaaccagagctggaagagagcagctggcttcactcctggctttcaggaaagggaatgtctaaagttgcctcccttatttttggaattttgaactgataaccctattcttacccatctggccagacgattccttaactcgtgttacacctgcagaatgagttttagatctagctgtgacctcttcccccagccccacccccattgtccccttgtgtgccttcaggaatctgatcattcttctctcctgctccttcccaaaggctgcaggagcaggtgtgaagacgtggatgtgccagatgcagagtcctgacacttttcaacacatctgcatattagaggaagtacatacccattgcttggtggtttcatgtctaatgtggtatgagtgtgacaaagagagggagaaaatttggactagccaaagaagccagtcaggcgtggggtttgaagggcatcgtgggcggctgtcatttgctctctgcttgtcacagccccttgcccagggcttgaccagtgaggtgtatgtgctggtcacacccatctcagcagatctgtcagctttcccgcttttgttaaagggtgatatcatgcttcctggggggagcactggaagacaatgctcggccactttcctccagatacaataggcggagtcaggaaggcagtattgacattgctggggctggggaggcactcactgctctgcggccgtcagatggtgaaccagcttaaccttggcacacagggcctgggttgtgcaaggcgtctggctgcagagccaaaggggactccaccctggggacaggagtgctttagacatctgggaatctgggatgggcttcaaattctgatccctgtgtcagaaacaaccacaaaacaataagagtaccagtaataacaaaaatgactaccctaggttgaatgcctttatgtgccaagtgttaaatatgatttttaatatttcacaactttacactataggtattattatttttttaatagacagggaaaccaaggctcacaaaggttaagtgacatgtccaaggttaaaatgtaagtgaccagccaggtgtggtggctcgtgcttgtaatcccagcactttgggaggccaaagcaagcagattgcttgagccaaggagttcgagaccatcctgggcaatatagggagacccatctctacaaataatacaaatattggctgggtatggtggcacacacctgtggtcccagcaacccgggaggctgagatagatggatcgctttagcctgggggttttaggctgcatgaatgtcgtgatcatgccgctgcattccagcctgagtgacatagtgagacctcatcttaacaacaacaaaccggaaaatggcggccatccattattttggatgcctaacatttcaaactttcaagaactgccgtgctttccctctaggtgattctgatgggtctgccaatcactggtcacagaatgtcccagccaactaacaacagcagttggttcaaacagaagatgcacaacccaacagggccagttagactctttccctgggaatttatgagcactttgaaagcaaaagcctctctttcttcatagaggacactgtatccctggagctaccaacttcgctgaccacttgaaggaagctagtctttagtacgagagaatgaggccaataacaaaagatggaccaagacaggcactctgatagcatttgagacgtgggtccaaggattttcaaacacgcagccctgcctctttcagttctgtgagctagtttcttttatttgtttaagctattttgagttagcttctatcccttggaagtgaatcatcctgactgaccacatgtctcagtaggaaatgatggagacaagagttacactgaaaaatgacctgaacccgaatcctgggctctttaaaacacctcactgtgctgccttcgaactagtgtttcatggtcacctcaggttagttcctagaaaatgaaggtaacagcatttcttcatgtggttttggggaagaccttttaaaaaaaataacttaaaaatacttagaacagtgccggctcatagttagcactcgataaaaatcagatgttattaagatttggttataaatgaaactggtgtctcatatgttaccttatgttactcctttcaaagcacatttttatccacgagggcaggcaacccacattccatgcagatgaggctccctggcttcccttggtgtcctaagtctggccttatagtggggacaaggtgagagaggcttacacctgtgggttcttgggcttctgctaaaaatgtggagagtcgggtggagagtcgggtggggagattcctctctgttgctcaacgagctggcaacattgggctcccaacctttttcctgccagcccccagtttcctctcatttctgggtcgtgactgatcacgggctctaggatgatctgtcatttgaaggttcccacctcatttatcccaaacctattgattcctatttcttgacaatttttttacttctagtggaatctgcctcacttgtgactaagcttgttgcatttttggacccatcctggtgtctgtgtgcacatgcgtgtgtgtgtgtgcatgtgggtgtggatgcacacgtgtgagagaaagaaatagctctccccccatttcagcacatatttgctctaattccaccttcctttagtctccattctactttgtgtccaataccccttgcatctggaaaggatgttctaatcttctggggttgatttaaacatccatctattttattaatcattgctaccacttcagaatcgaagaagacggtggtggcagtggtgattgcttgtggtcagcagcttttcaggagacagtctttgcctgcctcaccagcctctcgtggttctcagtcccacatactatgatggaagtgtactcaagtcataccagactctttgcagtttccaaacattcatgttcaagcatttatgcctttgtgtatgctggtttctctttctagcatgcccttgtcacctcttcttcacctgctttacttatttatgattagaggtttagctcaggtgttatatcttctaagaagtcttctttaacctcctcgcatggattagggccctgccttagcctgaggcgaaaacatggcctgaaggccaaggcatatgtgcaggtggattatgtgggataatgatcccaggaagcaagagtgagggactagtggaatgaaactctacaaggatgcattgtcaagctggctgcagcgacagaagcctggtgctccagactttctgaggagccttatgaaatgagacttagaacttcatccgcaaatgaaaaggggaggcattcatctattgctattccctttgttcaagggttatgtagacctaagaacctagcaggttaccataggtgaggaagtaagatatactcgactgggctctaggtgagctactttgagactgcacctgctcaaggatcagaagtggcccttgcaggagcagccagggcaaaagctgggatgaggagggtttgcactggtgcctaagaggtttcagatacaggcaccttggtacttgcctttgtcataatacttagaaaatttaattacaatgtacagtttactggttggttttgcccgctggactatgagctgtgtttggcatttcagtatttccagtacctgacttgatgtactagctgacgaagaaatgctttaataaatagctttgctggctgggtgctgtggctcacgcctgtaatcccagcactttgggaggctgaggccagcgaatcacctgaggtcaggagttcaagaccagcctgaccaacatggcgaaaccccgcctctactaaaaatacaaaaaaaaaattagccaggcgtggtggtgcacacttgtagtcccagctacttgggaggctgaggcagaagaatcacttaacccgggaggcagaggttgcagtgagctgagatcgtgccattgcacttcagcctgggcgacaagagtgaaactctgtctcaaaataaataaataaaaaaaatagctttgctttgtattaaatgttctgagttagggttaccttaagtgtgttgtatatattactgctggcctgcaagatgatttgtatatatatttcataaataaattttttttttattttataaatatattttataaatttatatacatattttatttgtatacatatgtatttttatatgtataaatatattttccatattatatgcaatatgcaaaattatttacatatataaacatttatttgcatctgtttatagatatatgtatatatgtgtgcatatgtatcatatcagtcatgtgatttcatgattagtcctcgttaatatgaggataagaaaaaaagttaatttaaatataatgattgatagaaaaattgcacaggtgatatgtagactcagtaagaatcacaaaagtgatccatgaatgaatgcaatttgagagacactgctataaccagatgagttagccactcgaatcctgtcctttttagaactgtgtatgtgcatgtgtatccaaagaaataacaaaagcattttgggcgtgtaattaatgctatcctagtgacataaacaaagtgaaacagagtttcacagtgatcgacctgtctcaaagcaccgtcacggattctaattttgtttctcccaggaaacctggaaagtgggtatttgttaataaaattatagacaagaccttgggcacagtgggcttcctcacaaaaggcccagctaacgagcaggcaatgcccgtcagtagagaaatggttggtcagttctactcatccattccagctagcatctactgaaccctttttatgtactaggaatctgctaggcattggagttccaaagatagttaagagagggacttgaactcaagcagttgcagtctggtgggtgagaaaccctgccctaataaaggcagatggaaacatggaaactggagtgagcaattctgagagaaaacagggatctcaccaggagggtgacatttgagaagggagaacaggattatggaagatcaggagtggaagtgaggaggaggggcattctaggcagaggggaaagcatgaaaatttgggataaaatgtttaagagacttttatgcagtggtttttgcggctacacaatgggttcattgaagaaggtggcagggattaaaagtgggaagatgggttggagaaaaggtaatttggtttgagattggccaagtgggcagggacagagacacttataagagcctttagggtataggatgaagcggtgtgaggtagtgagacgtgtctggagataagaggaggacagcaggtaggtctgggaacctacatcgagaggtaatacgggtagagaaagaggagactgatgatcctgaaaggatgtgccaaggaaggaggagcttcaactatatcaaaaattggaggaaagaggccgggcacagtggctcacgcctgtaatctcagcactttgggaggccacggcagctagatcacgaggtcaggagatcgagaccatcctggctaatacagtgaaaccctgtctctactaaaaatacaaaaaattagccaggcgtggtggcatatgcctgtagtcccagctacctgggaggctgaggcaggagaatcgcttcaacctgggaggcagaggttgcagtgagccgagatggcgccactgcactccagcctgggtgacagagcgagactctgtctcaaaaaaaaaaaaaaaaaaaaaaaaaactggaggaaagagcaggctaggaagagagactagagaattagcagctgggtgctgttgcgaagcatttttagtgaatgggcagggcttgggcttaggagaaagtgggaagggagggagatggggcgggtaagcatagattcctttctgggagatgtctcacatcctggtaggttcctatttccatgtgctttctgtaagcttaattatagggtgagctgctgaaaggggttaggtccttctctctgccgtcataggctcaaggtactaaaaggatatgcgggggtgtaaagggagtaaggaaagagctctgccatcacaggtactctccttcccctgcatgtggtcccttaaatcacctgaattaggcgatattttagttttataaatacactgtaatgagggtaggtattttcatggagaggccacgcacagttacctggagtaacagaatactggaactgtcagagacataaaagattatctagcccagtgtttctgaaatctcttaacagaataccaattctaggagacttgcataatcttttttattgtttttgagtatcacgtggagctaatgttctatattttgaaaaattctggttcagtttaacctgctcattttacagatgacaacactgaggcccagagaagtcagcattttgttcagattcagtcaactcaatagaggttaaatttcttcattttatttattcttttgagatagtctcactgtgtcacccaggcaaaagtgcaatggcatgatttcggctcactgcaacctccgcctctcaggttcaagctattctcctgcctcaccctcctgagtaattgggattacaggtgcacaccaccacacccggctaatttttgtatttttagtagagatggggtttcgccaagttggtcaggctggtcttgaactcctgacctcaggtgacccaccctccttggcctcccaaagtgccgggtgggtggcgtgagccaccgcagctggcgaatttcttcactttaaaagagcatggaaggcaatgtaaattacagcttaatgcacgtacagtgtagtcagacaggctgagcttgcatcccagccttactactgtatcagttagttgttgccatgtaacaaactactcccaaaactcagtggctaaaccaacatttataattactcccatgtttttggctcattcaaggttcagctgatctatgcttgacacagctgagtagctctgcttcaggttgcagcagctggggcagctctgctccttgctgtaggtatgtgggtttcctggatgactctgcgcacatatcatctttcttggatcagcggatcactcagggcatgttttactcgtgatgttagaaacacaagagagctaagtagaaacaagtaaacaagtggggcttcttaaggccttggctcagaactagcatgttgtcacacccaaagtgatgtgcccaaagtcaagggacgggaaatacactctgcccacaacgaggccaaagcagaaatgtggaagcaaggaaggatggagagttggggccaataattcaacctattataacaactactagctttgcactgtggtgcaactcactcggcttcatctgtaaaatatgcagcatgatagtacctacctcatgggttttttttggagggaggagcaagtaattcaggtagttcttataaaccatttagaacaatgcttaaatttagaaaacacaaagaaaattagtgacagtactaatatttaatccatctaaccatcaacacctgtgcatatgaggtctatcccaccagagtggctataggagggttagggttgacttcgcagattggcctagtgtcagctgattctcttccagcagaagggcttgaaggagtgaccttcggaacagtccccagtcgctcatttataagtcccctttttcctctctcataactgcatcatagccacaaactcaagacccaaccagcatgggcttgcattgtgttgcctggtctccccacccgcctcggccctgtgtatctcacacccagagtcagcagtgcttttcacacaaaccatctgccaagagatgtggagctggagccagaaacacacaacagctgcagaagctcagccacattcagaagcctgtagtaatcgcctaacaggcttggatacagctctgactgctgagtaactctagagtatggaagcccatcagtaaattatgattgcagcatgagtaatacatgagttctgccagctgcttctggaatcaaacaaaagacagtgctgttgccagccaggaaaaagtcacctttaagtgcatcactgtcttctttttcaggctaggagagccggtgactaagactagcttctattagaggccccctttttctctcctagagatctttctaatgaaactcatggcttataacccctaccaagcccatcttttcaccttatgcccaggcagttgagaacacagactccggtgccagataaatctgggttggagccccattcaaaaatgtgacagctgtgtgaccttgggtaagttgtttcacctttctgtagcatgaggataacaatattaccctttaatgagggttacatgatttgaagcatgtcaaatgcttagcaaaatataggtgtataacaaatgttcaatataatattaactatcattatttttttgtatctccctgtgctactagggtaattgctcctaagagtaccctgcctccaagaatctgtataaatgttgttccattccatcccacctctctcaacacatctcatttctttccaactctttctattctatacatattttttgagcttctactctgtgcccaacactgagtcaggtactcagaagatataaacagaaaaaaacacagaaacttgcagctaaggaggtttttgttggggtcacagctagacatgcagtagattgttgttattcatggtgcttatgttctgtaaaccacgaacacgaggttagggtcactgcaagcttctggtcacgacattttcgtcaacacattaatacataaccctgctttatttgtgtcttggtgtaaagacaaaccatttggtctccgtggctgattcattaacattgaactcatagccagaggcactcctgcctgaacaaagcttacctaacacataagttttctcctaaggcatatcacagctttgtgatgtttaagaagtagatggcacttcagcactagacttgggaccattgtaaatggtgaaaatggcaataaagagcacaaaaatattaaaaactaatgcactaaatatatcacaaaaaggacacttgtttatagtatgagggctgagcagaagttctgcttcacctgggaatgtgtttatccagggactctgtgcatgtattcaaatgactgggaaagtgcttttgaggttacaaataaattctagccagtagacaaatttacacatacagaatctataaatgatgaggatacactgtatataaaaatgactatgcaagtcagactgcaataaagtttccatagaaatacagggcaatatagcacagaccagagagaaactgctccagtctagggtaatcaatcaggctccactaactgaaatgagacttttaaggacatttctgacacagaggagacagtagtgatggaagcaggaggaattaaaatatgtggctaaatgcagccagattacccagattggggccagaggatggaaggattttggcttccatcactgtacagtgtaacccagatttgactggattccccgaagcaggcctctcctcactcacacccattacaagcaagagccaacacttagagatgccaaaacaacataaaacagatgcaactccgtgatgttagctagtaacacaactttttttgttttattatactttaagatctggggtacattttgagcagaaagtgcagttttgttacataggtatacatgtaccatggtggtttgctgcagctatcaacccatcatctacattaggtagttctcctaatgctatccctccctcaacccccaatcccctgacaggtcccggtgtgtgatggcccccgcacccgtgtccatgtgttctcattgttcagctcccgtttatgagtgagaacatgcagtgtttggttttctgttcttgtgttagtttgctgagaatggtttccagcttcatccatgtccctgcaaaggacataaactcatccttttttatgaatgcatagtattccatggtatatatgtgccacatattctttatccagtctatcattgatgggcttttgggttggttccaagtctttgctatcgtgaatagtgccacaataaacgtgtgtgcatgagtctttatagtagaatgacttataatcctttgggtgtatacccagtaatgggatggctgggtcaaatggtatttggtatttctagttctagatccttgaggaattgccatattgtcttccacaatggttgaactaatttaaactcccaccaacagtgtaaaaacgttcctatttctccatatcctccagcatctgttgtttcctgactttttaatgattgccattctaactgatgagagatggtatctcattgtggttttgatttgcatttctctaatgaccagtgatgatgagcattttttcatgtttgttggctgcataaatgtcttcttttgagaagtgtctgtttatatcctttacccaattttgatggggttgtttgattttttcttgtaaatttgttgaagttctttgtagattctggatattaaccccttgtcagaaggatagattgcaaaattttactcccattctgtaggttgcctgtccactctgatggtagtttcttttgctgtgcagaagctctttagtttaattagatcccatttgtcaattttggcttctgttgcgattgcttttggtgttttagacatgaagtccttgcccatgcctatgtcctgaatggtattgcctaggttttcttctagggtttttatggttttaggtctaacttgtaagtctttaatccatcttgaattaatttttgtataaggtgtaaggaagggatccagtttcagctttctgcatatggctagccagttttcccaacaccatttattaaatagggaatcctttccccatttcttgtttttgtcaggtttgttaaagataagatggttgtagatgtgtggtgttatttctgaggcctcttttctgttccattggtctaggtatctcttttggtagcagtaccatgctgttttggttactgtggacttgtagtatagtttgaagtcaggtagcttgatgcttccagttttgttctttttgcttaggattgtcttggctatgcgggctcttttttggttccatatgaaatttaaagcagttttatctaattctgtgaagaaagtcaatgatagcttgatggggatagcattgaatctataaattacttggggcagtatggccattttcacgataccgattcttcctatccatgagcatggaatgtttttccatttgtttgtgtccttttttatttcattgagcagtggtttgtagttctccttgaagaggtccttcacatcccttggaagttgtattcctaggtattttattctctttgtggcaattgtgaatgggagctcgctcatgatttggctgtctgtttgtctgctattggtgtataggaatgcttgtgatttttgcacattgattttctatcctgagactttgctgaatttgcttatcagcttgaggagattttgggctgagatgatggggttttctaaatatacagtcatttcatctgcaaacagacaatttgacttcctcttttcctacgtgaataccctttgtttctttctcttgcctgattgccctggccagaacttccaatcctatgttgaataggagtggtgacagagggcatccttgtcttgtgctgattttcaaagggaatacttccagtttttgccccttcattatgacattggctgtgggtttgtcataaatagctcttaatattttgagatatgtcctatcaatacctagtttattgagagtttttagcatgaaagggtgttgaattttgtcggaggacttttctgcatgtattgagataatcgtggtttttgtcattctgtttatgtgatggattatgtttgtaacataaaatttttagcaggtcaaaggaaaagatgatttgtgctgtacagtgtgtaaaataaaacttaatacatgcacaagtagatatctctctgttcttatgactaatttcctttccagttcccagcctactctttctcttctcttccacagcccctactattcctggaaattccagttttgcacatacatccccatgccacttcccccttgcatatataccacttggcagaacaaaaaccaggtagttatctaagcccatctcctctggaaatcttagcaggagctctgtattgttactcaagcatggctttcagtttttactccatccttcattgagccccttccaaggggcttatgcaaatattcacccaataaaatatttccttcatattttggcacaagcaataaagaagtacaaggtcccagatcagttgcccctccctatcattgcctctgcctgttattcctgacagaataagcatttttctcatcttaaacgcatgatccatggtttctgcaatttctaaagaccctagaccaggctctggccacactggatattcaataaatgaatagatttccactaaactgatggctttggggaaagagatattgtataatattttcttccataaaactcataggtaggtttaagtattgttttcttatatatttcacagcaaagtttcataattcgtatcacataagttctaagcattgccttctaataactcttatccaatcacctaaagatattggttttgaaatttaacaaaataattatacactttgtcttgaagaataagcaggaagaatagctgaaaaaattctgaaaaagaaaagtaatgtcttgagaatagttttactggatcttaggtggaatatgctactgtaataacagtgttacagttccaggaatttggatgcacagatcaacagatgaaaggccagaaccagacttgagtttatataaaatttaaataatcttataaagcatacaaatcaatggagaaagaaataacaggaaaactaattttctgtttggaaaaaagggttgtttaaaaaaaccatctcttaccacacaccaaaataaattcaaaatggattaaaatgttaaatgtaaaaaaactcaagccatcaaagggagaagatggaaatgaatatatattgaattttcatatgggaaggactttttaagtttaaaacacaatagaagaaaccacaaaactaaaaatcagcacacttggctatgtaaatatttaaagtgtcaattcaagaataataaaaggcaaagaacaaaaagagaaaaatacttggaacaaatatggtaaataaaagattaaagtacttttttttttttttttttttgctcactgcaacctccgcttcctgggttcaagcgattctcctgcctcagcctcctgagtagctgggattacaggtgtgcaccaccacgcctggctaatttttgtatttttagtagagatgggatttcaacatgttgatcaggctggtctgacctcgtgattcacatgccttggcctcccagagtgttgggattacaggcgtgagccaccgcgcccggccaaagtactttaaaaaacaaaacaaaacaaaacctcattgaaagtgatagaaaaaaataaaaacatcaatagaaaaagagaggaacaagtaattcacaaaaggaggaaatacaaatggcttataagcatgcgaaaagtttaccctctaaaacaaatttaaatcaaatcaaaacaagataccaattttccacgtcaaactagcgaagattaaaaacaagtgaaaaggctcagtaatacatggctgaggttggtgaaatgttcactctcttacatactacacctttttagaaataaacttggcagtgtagaccaagagcttttaaaaagttatgataggccaggcatggtggctcatgcctgtaatgccaacactttgggaggccgaggctggcagatcacttaaggtcaggagttcgagaccagcctggcctggccaacatggtaaaaccccgtctctattaaaaatacaaaaatcaggtgggtgtggtgctgtagttccagctacttgggaggctgaggaggttggatcagctgagcccaggaagcggaggttacagtgagctgagatcatgccactgcactccagcctgggtaacaggacaagaccctgtctcaaaaaaaaaaaaaaaaaagttatgataaaattaagtaaaaattcgaatatgaaacagtatttggccaggcgtggtagctcatgcctgtaatccccgcatgttgggaggatcgtttgagcctaggagtttgagaccagcctgggtaacataaggagaccccgtctcttaaaaaaaaaaaaaaaattagccaggtgtggtggtatatgcctgtagtcccagctactcaggaggctgaggcaggtctcttgagccctggatgtagaggcttcagtgagccatgattgcaccactgcactcccgactgggtgacagagtgagattttgtttaaaaaaaaaaagaaagaaatttgataaagctatatatgtttgtttctgtagtttcccctctaaatagtctaggaaagaaatgaaagttatgcatcaaaatgtcagcaagggttaaaatgttcctttctaaccatttcgtactgtgtttagatagaatggatctagtgtttaaagaaggatttcacaatgatggtatatatttctaaataatttatatttggaatgttctaagacctctgtattatttttgtggttttggagacatcttttatttttattctttttttttttttttttcttgagacggagtcttgctctgtcgcccaggctgcagtgcagtggcatgatcttggctcactgcaacctccatctcccaggttcaagtgattctcctgcctcagcctcctgagtagctaggatcacaggcgtgcaccaccacacctgactaatgtttgtatttttagtagagacggggtttcaccatgttggtcaggctggtcttgaactcctgaccttgtgatttgcctgcctcggcctccgaaagtgtgatttttttattcttaaatcagtaccaattaacaggataaaaataattatagaagaacccatatttatcaggactgctattttgagtacataaaatatctaagactatcatacatgaattaatgcagtattattatggaaaaagattccagagacagtgtctttcctggatatttttattgggacaccggggcattcagatggcctattgaaatgagacaaggagagacagtgagaaatgtttctttcatagtattcagttgatttttaaagtttgggaacaaaaactataaaatgagaactctgagttatttcaaactatggcatttgtgtgctttagcttccttaaaatatacatttttctgattataaaaatagtttatgttcaggtgggaaaatgtagacatacagaaaaatgtttttaaatgtatggtcaccagagttaacaaatgtgcttctttaatgatacaagaaatctatatctatagcaatcaagagggaggtagaaagagagagagacagagaaatagagagatgacagagagagagacaggtttggctgtttggtttaaacatttggtaattattacctttaaacataaacacaattgtacatgttctgttgtatgatggtaggggtagctaaaaaagaggaaaacagtttcaaccataggatcattgactataaaccagagagatctcatggaaagtaaagtcacagaactaatccaggtcttccgaagctgccatattgttactgagtaatgcctgaaataaatacttccttcttttctccggacctcctctcatcacttagacttaaccctgaaggatggagtgaggaatggcagaagtgtgagggtaaataacagaaatgggattagaatgtcatatatacaatatttgttaatgaaaaaaatctggacaagtcatggcttatttttaggatcattaaatagttggaaaggtctaagaatttctggcatcaaaagggcatctttcaaaatgtcgtgtacttctgagtctgtcttttgcccttcactttaccattttccttatgagccttaagagccacagtcggctgagtttgagtcaggtgaagcctacagccttttgatgccctctacaatcttccaacatagcctcctttgttatgtcagtgaccatatgatgcatccaacctgaaagccagtgtcctccacttattgctattttttagtatctgtatccaaatcaattgctagtgcatgcctcatctttccgtaaatctcctattagattgcaggctagtggctttcatacttgctttatggagctcgaggggttccaaaggagatgcctgtgggactgtcatggatggtgagggtgagacccatgcctggacgtctctgggatctttacccctattttaccccaatttcaaccagagtaattatacttttctttaggtgtaacatattgtcttttacataatatttaatttggtaaaacgatgcctctgcttaaataaaaacacattggggaacccctaacataagttgcaggatttgctcagacaaagacagcccagagctggaagtgatggataggtgtcctgtgtgaggagttactggccaagccaatagtcgttagaggtacaggtttgaaactgaactgtgaggcatgggaagttgacttgtattttccactggctgtagactggaaaccagataatcatgctcgtatgtagaggctggtaatgcttagatcgaaggtttgagtgacaggctgttctagtagaggggatggattttaagtcataagctttatgacattgatttttgtcagtggtatggttaagcatgtttgctagaaagcaaagttttaggtagatgaactgttactgtattcatattaacattgtatgtacttggattagagagttaacatcagctcatttactctgtgagatatactgcccacaaactcaaggatttgtaggagtttagggactctattgagtgtacacagttatttccttctaaattgacattaaaaatttaaaattcgccactcaaatctcagcaaccaagttttcgtttcaatcacacaacagagcaaaattttgcttttctttgaacacattctacgttacacagtctaagaactaaaatcaatttaacctagtttctatctcttttatgagccaaaattaggagtatcaaaaatatgatttgaagcctagggctcttgctgactagtcatattttaaaattctgaatctagagatcttagacttcagttcctagagtacatggcaaacttcattttccagtgtaaccctagatgatacatgtatgccatccttagaaggagtcagatatcatcattaaataatccataaactaaaacttgttttcatgatcccctactagaagtcaagtccatttaaagatctaataaaaagaagagaaaccttagcaatgtgctcagaataccagaacataggaggaatataggtctgagttttcagaaatacgtatgctgctgtggctcatttcttgcccatgtttgtattgcttctctgggctgttactagatttaaaagaaacaaaaagggtgtgtaataaattgttataatcccagcactttcggaggctgaggcaggtggatcacctgacgtcaagcgttgaagaccagcctgcccaacatggagaagtcctgtctctactaaaaatacaaaaattagctgggcatggtggtgcatgcctgtaatcccgctacttgggaggctgaggcaggagaatcgcttgaacccaggaggtggaggttgcagtgagccgagatcgtgccactgcactccagccttggtgacagagtgagacttttttttttttttttgagacaaaggattcttgtcttagtgtactatttttgagctggttggcattcattagcccacccttagacctcattttctctccatataagataaaaaatgccaccacaaacattagcttttccttgtgatgggctctgtagggtaggttgccaccttaggagggtctagttgtgactgttttgcaggggaaaaaaatcctgtttctcttcattagtctcaaaattttagggaatcacaaatcatcatcacctttatcatcatgtctttgtaatcatttattgaatattccactatttgccacatactgttaatacagcctccataaaatttacgaaaattttttttcgtatgtatgtatacattgatacatcctcagggaaatgcttagaaataagtaccaccagcttcattttacagatgaccaatctgaggcacagaggctaaataacttaacttgtaagtggcagatctagaattcaaacccaggatggcttgaatccctggactctgaccatgaagcttcctggtctatctcagagcagaccttaatctgatctgagataggcatagcactgcacaggcacttagaagcagagaggacgcctttaaaacatcaccatgatgaaggtgctaatataaattccaagactaaatgtgcagagcccaagtcacttgcattcctgccaaaagattcaattttaaaaatgtttatctttttgttctgtgtgtaccgtaccgtcattctgagatagccactgttaatattttctagataagattgaattttatatccttttctgcggaattcaaatgccctctacgaggtttcctctgtgaattcccagggcagttattttttttttttttgagatggagtctcgctctgtcactcaggttggagtgcagtggcacgatcttggctcactgcaacctccccatcccaggttcaggcaattcttctgcctcagcctcccgagtagctgggactataggtgcatgccaccacgcccagctgatgtttgtatttataatagagacgaggtttcaccatgttgcccaggctggtctcaaacacctgaactcgtgatccacccacctcggtctcccaaagtgctgggattacaggcgtgagccactgcgccggtccctacttacattcttgtagttacctctgacactgagctgcggcttcaattgactttactttaattcactcactcttatgcctctctgttcaaattttgtcaacccagatgtgcagctcagccttctacctcaactaaaactaagaacgggagcaatttctccacccccagacagacacacaggtacagatggacatacagccacaatcataaatacagagacacggggactgacatacatttgtgagtattgtgagtacaacacactgaactgacgactggagacaaagaagcagtttctacagaggcaatgcaaagaacttcacaagtatcagtctcccctatctgttcaagtccttcagctgcatactgtattgcttggccattctttttttttctctttccttttgtgccatccattggaatttcaatttggattatattaaatttatgaattaatttaggaagaattatcatctttccaatgttctacctttctgctaaagagaaaaaaaatctctccatgtttttaaatctttgtttatttatttatttttgaaatggagtctcgctctgtcaccaggctggagtgcagtggcgcagtctcggctcactgcaacctctgcctcccgggttcaagcgattctcctgcctcagcctcccgagtagctgggactataggcgcctgctgccacgcctggctaatttttttgtattttcagtagagacggggtttcaccatgttccccaagatggtgtcgatctcttaacctcagttgatccacccgcctcggcctcccaaagtgctgggattacaggtgtgagccactgtgcctggcctaaatctatcttttgataaaacttcacggatattttcatatgtaccctatgcatttcacattgtgctattacaattgtgatttactaatcagataccctagtatctatggaagataaatcatttaataagtcgctgaaataatttgctaatattttatttgggatttttgatttttcacatgtaaggagtagttttcttttttcagctattttaggttagctaacagaattctactagcttaaaagaatagatacctaatttaaaacaaagttcttatattacataaactcattagcaaaaccagctggccctatggatttttggtgagataagttaggctttttactttttgagttcaactttaggaatttatatttcctaataaaaatcattttatatatatttttaaacttacctgaaaattgtacatagttcccgtatgattaaagcatcttcttaacaagatttacttcgttttactctcaattttagttacaaagagatcccagaggctcactattgtgaattctacccacacctaagaacatcttttagacttctcatttttctctttagttaggtttattttttctctctgcctttcctggttgtattagttcttttgtgtccggaatttattcattccggtgggttcttggtctcactgtggacccttgcggtgagtgttacagttcttaaagatggtgtgtccagagtttgttccttcagatgtgtctggagtttcttccttccagtgggtttgtggtctcgctgacttcaggagtgaagccgcaaaccttcccagtgagtgttacagctcttaaaggtggcgcatccagagttgtttgttccttccggtgggttcgtggtctcactgacctcaggagtgaagccgcagaccctctcagtgagtgtttcagctcataaaggtagtgcagacccaaagagtgagcagcagcaagatttattgtgaagagcaaaagaacaaagattccacagtgtggaaggggatctgagcgggttgccgctgctggctcaggtggccagcttttattcccttatttggccctgcccacatcctgctgattggtccattttgcagagagctgattggtccattttacagagtgctgattggtcctttttacagagagctgattggtccattttacagagtgctgattggtccattttacagagtgctgattggtgcatttacaatcctttagctagacacagagcactgattggtatgtttttacagagtgctgattggtgcatttacaatcctctagctagacagaaaagttctccaagtccccacttgacccaggaagtccagctggcttcacctctcacttttaaaactgttgagcagagttcttgatttatttatattcagtagtaagcaaagtatttgaaactatacctgacacttgaataacacaagtttgagcttcatgggcccacttacacccagctgtttttcaatcacagatggaaaatacagtattcacaggatctgaaactcacataaacagatgggtccaacttttcgtatatgcgtgttactagagtggagtacaggaattgagtatgtgtgaatttggttgtacacaagtggtcctggaaccaatcccctgtgtgtaccaaggaacagctatgtaatgttttagattcactgtagcagttttgaaagtaggattcttagatgggcacggtggctcaagcctgtaatcccagcactttgggaggccgaggtgggtggatcacgaggtcaggagatcaagaccatcctggctaacctggtgaaatccatgtctactaaaaacacaaaaaaattagttgggcatggtggtgggcgtctgtagtcccagctactccggagggaggctgaggcaggagaatggcgtgaacctgggaggcggagcttgcagtgagccgagatcacgccactgcactccagcctgggcgacagagcgagactctgtctcaaaaaaaaaaaaacagtaggattcttattttttattgtctaaaaatcctgtctttttacttttgatttttttctgagaattaataattatttggaagacagctttaacaatttttttttttttttttttttttgagactgagtctcactctgtcgcccaggctggagtgcagtggtgcaatctcggctcaatgcatgctccgcctcctgggttcaagcgatcctgcctcagcctcccgagtagctgggattacaggtgtgcatcaccatgcccagctaatttttgtatttttagttgagacggggtttcaccatgttgccaggctagtcttgaactcctgaccttaggtgatccgcccacctcggcctcccaaagtgctgggattacaggcgtgagacaccatgcctggctgacagctttatgatttttgagaagttggttttctttttttttgttcaacaatatattgttaaacttgatttactgtgttgtggtgtgggattgttttgttgtggtttgagagtattgtatggaaaatttcttttgttgggcttcagtgagttgagagggagaggaagagagagtgtgtgtatgtatagtacagcaggagtaacaacagggttgatattccacagttgtatactagtttgtctgtattagttgttaaaagagtgaaataattgtgtatgatttggtaaataactgctgcatgggccgcctatgttccccctgtcctgccaccttggcttccccagtcccgctaccttagactctctagacttcccagtaatttagcaatgaaagggttaatgctagcccattagggtttttcagatccatttcctggtgctcagatcagtgtccattttaatcggttggtccaggttgaatttcacctttgagcaacaccaaacttatttaagttaggcaaattcaactatataattcttgatcgaaaacatgtagaaaataagtataatataaacaatgcaggtgatttcacttgccctttcacttcatatgccccacactgagcttagtcccaattcttgtggtctctcatacgctcaccatgtttgaaggcatacatactttttatgctgtctggttcctgaacaccactttatctggttctcacccaaagaaacagggatctgtttgtgaaacttacattagcaaaaaagaaaaaaaaaaaaaaaaaagaaacattaatctcttccaatgctggaggaaaacctacctgtttcattggtgaataaatgatatatgtccacatttccctttatgggttattttaaggattgccaagagtccttttgtctatatacgattgcactgatctttgtaacctcgactcctatagaatgtgttgctccactggctatatatgtaattataaagacatatatcttatatatgtcttacataaagatatacatatctttataattatttaaatgttatatttgatttttagtctactttatctgtcaaaatgggagtggtgtggtgctatcttctaaaactattatgttttccttacatttttttgcttttaacagtttatcctttatatatttgatcctatatgatttggagaacaaagatacatagctgttatgcctctactgtggattttactttctagcaacataatatgagagactatgttctactttatgccttcaatcttgagttttaccttgtctgaaactagtattatttttgctttcttttctttcttcattcttttattggtccttttttcttttaatttattcgttaagttctctgcctatctctgtttttaagattttatgatttttgttctaagtgaatgttccacaagcatcatcttggaagatttaattttcttctgctgtctgaaagtatttgtctttctataggtcacttaaaacatttacctttaaatcataaatgctagtcaatcttaacttctaacatattgttttatactttattttttacactttcctgtttttcctttttggtttttgttttctttcttttgcttatttggcttatattttgtttatatttatcttccctggttattttgatgtatacaccctgttttttattttattaatggccaccttcaagtttttcaaaagtgttatttaacctgtacttctctatttctagtattaaatagtgaaagtatattttgaacactcatgtgtcaatgaggaactctgcatactgtaactttctctcatccttccttttcccttccaagtctttgctaatttaccatgaaatctgagatatatgttactttttgcagtagttattttcaagaggaactttgacttaaaatatactttcatgatgaaaatacatttttcagtctaattccattggcctttatggttactagatgtgacaataagtctattgactacttggttagcactgtagttacaatttttaaaaaatattttctcatctttagtgggaagttggaagagactgacaaggatgctagtcaaatgacattttaaatctgaggtccggacttcagaattaagtggatatacttccattacatgatgctgttaattaaatgtgacctaacattggtgtgttttaaaatcctttgttttctttaattaaaaaagaaacaggtataatgggtttggatttttagttataacagtctgcacatttaaactttatttttttgaattgtgcaaagtaacagaacataaatctctattaccattgagatttcagctgcatcttggaagagattggacttcagcagataaacatatgtagagaagggcatccttggcaggagaaataatgtcacaatgtccaggaaaggaaagcttgcagggagtttggggctaaaaagaccaaaggtaaaaatttgcagtagttgaagtgagagaatgaggatatgaaaaggaatgtgagggacaatacagagctagaatggacagacaatggactggatattagcagtgaaagagttgttgacaataacttggagtttttaagcatctgtacttgtgaaggtgaatctttacgatacaatgagagaaagagtgaaggttgagaggagagaagatactaagttcttactggacatgttgcatttgagatgcctatgtaggtgtccagcaggcactttcataacatgcatttattattgggaagacagaattagagacctagatttggaacaggtgctaagcaaagtcctgaaagttggtgagatcactgtgaaaacggaaatggggacttccgtagcactggtcaggccataatttctgggctaaggccatagccacttgctgagttttggcaaggagggtgaatgggaaatgagatccaagagaaatctgctattttagattcatagtcttacatgtggtccagagagtactcgtgtttctactgggatgatcaaagtactaaggcaaaggggttcccagtcaaacaatggatatggagaagctactgtgcccaactttgttaggaaaaaggaagagttatgaattctatcactgttccggatgttttacatttgagatctcctttagtcatcgctgttgcttattttgtctaagccagtttcctcatccgtggtatggaggtataatgtctaattcatatggtggttgtgagaactcattaaaaacaatgcacgttaaagtaactagactgtggaagttacttaataagttaaagctattgttaatgatttttgtaactattcgtgtgtcattgaaacactgctattgtgaaacacaactagcaaacacttgatagtagtgatttgcacactgctctttaaagagccgctctagggaggtacccaaagggagtgcttcaagattgagggagcatgtacaaagctgggcttctgtttctttatcaacccacaggaagcatggtgttatctgtgtgcgttgcttgaaatgagcgtaggtagacctaaaagcaccaggggagggagcggtgattgaaactagagagagcattggcaagagagggttgtccccaagaactgtggcttctgtagatggctcaacagagacggagctgggaaaataaatagcctgaccacactgtccttccacccttgtatgtcctgctggcactttctgctacctgaacccagtgggacataggtagccatcatggatccagggttgagtggagaagggaggagagcagccagggagggggcacaccttgtcagaatgaagagaagaaccgagaaacagcctggttttagcaagtgagactcatacactgtgatgttgaaatttgtgtactaaatgtgacttaagaatagagccagcccatgaccagaatatctgatttgaacatttaatgaaattgcctctctggctttcatgttttagatggcttttcctcaagtgactgcagagataggctgtgtctccttacttccagaacaacatatatatatatgtacacacgcacattgtctacataggaagataaaggagaagttgttttcctaagccattagtgtcatgaaatgcatggcagctgctgtatataggatcatggcctgtcatactgccatacctactggctaccaggtttatatagtcagtaagacataaccccttccatgtggcatctggcaggtttcccagggtagaggaaagcatgagccaagtcttgaaggctgagcaggagttagccagttgaatgtggagagaagagaagtgttggaggaaggcaatgcagacagggagtatagctcatgaaaaactggaaaagaggttgggcgcggtggcttacgcctgtaatcccagcactttgggaggctgaggtgggcagaacacgaggtcaagagatcgataccatcctggccaacatggtgaaaccctgtctctactaaaaatacaaaaattagctgggcgtggtggtgcatgcctgtagtcccagctacttgggaggctgaggcatgagaatcgcttgaacccaggaggcagagcttgcagtgagccgagatcacgccactgcattccagcctggagacagagcaagactccgtctcaaaaaaaaaaggaaaaggagaatatgtaaagagcgtagctcatgcgaagatgctatggatgattcataaagaagagctcccagtgtgtttggaatgatgttactgccatcggaatgaatatggggactggtaggggcccatggggattacacttaatacatttatacctaaagtttctcaagaactctctcttaacgaatgcgcataggcctccgactcttgagatatttaggcctgcagtttgatagaggaaaaacagacataaaatccagttggaatttcacctggcaaatgtttatctgtcgtttggaagcacacaggattttttttttaattgaggcgagggaatgtgatcagacaagctacttcccaaataggtggcacacaatcacagaaataattcacatatggcctggaagacaatagattccaaaattgtagtaaagcaattcctaaactaaatggtacaaggctggagggcctctgagccctcttccagtactgagctaagaatatgtcccctctagtgagctggagaactgtgcttcagaacctagagctcctgtcctgttcgagagggaagaaaagcaacatatagggagggaaaagagaattcttggagcaaaatattgggagagtatatttcattgtcaggttgaacaaacagaattccacaagacagtgttgccaggaatagaatatcgactgtgcacacacttctaaagatgaagaaaatgtaagtgggggttcttgggcttagagacacatatgtgggctctttgggttaggttaggtgagtggtctccctgaggttcagctggcaaagacccaagaagcaacttcttaagctcatctccaaatagccccctgatctccccaaggctgccaccacattgccaggctggttgtgaaactgcttttccagaattgcttgcacgtgcagagaactggtctcctgttaaggtcagccctgtaaaaaagggggcaagaatcaaaggactcttgaaggaaacacaggaactcttccttagctcttgatcggcctgtttcctgcccatgtgggtttgaagtgtgagggagggtaagcacacagcaggacacaaagccatgagccgtccttccttctaagggtgtcttagctccaagatgactttaaaaacagtcttcctctggggatgacacaggccataatttcacacagatttacttgatcaaactggctttgtgccatgataataccaatagtcctttacacagaaatcaatgatttagaagctatcaccctgttttacacatgaggaaactaagacagaacttcaagaccaaagttcttaatgactccactgtcctgttaatcatgtcaggcaattagtaattcacaaaatagtcacctgggtttaagatgtattactttcagttactgctagaattgttccagttcaactcatacatatttaaaatgagtagtctgtcaaacacagtgcttggtgctggggcgttgaagacagaaagctcattgtctaaggaagaagacagacatgtcaatatttaattagaacaatgtcattagattgattagttgtgtgtgccttcctataaataaaaatctttattttaaaattatagaggaaatgaaatacaaaactaagcatgcaaagcaataagtgaatatcttctatggtgctgcttctctcagcccccatgtgcctgccagttttatcagcaacaggtaacactgttatcaggttggtgtatgacttctaagcttagatgtcatcgtactgttctacatcttgttttcttcactttatatttcaaggctcatgcaaacttataataccctattacatgtatgtaccgttatttatttagagatgcttctgttgatgaactttatattgtttacagtttgtggctatatgctgcaatgaatatccttgccatatctttgcatatttttactggtaaatatgaaagatacatttttattataattgttaaagttaatatacagtataattggcttttgtgtgtatacaactctatgagttttaacacatacactcatgtatctgccactaagaacagcgatcaggatacagaatagtaccatcaccccaaaaatcttttttgtgctgcccctttgtagtcagatttctcccagccctaatccttggcagccactcatctggtctcatccctacaggcctgcctttcttagaatgtcatataaatgcagtcggacagtaggtagaagatgattttagcttcttcactcagcataatgccatgttgctgcaagtagcaataggttttttcttttcattgttgagtagcatggatatactatagcttgtttatgtatttatccactgaaggatatttgggtgcttccagtttggggtgattatgaataaatagagctgctataaacattctattttttttttttttttttttggcgggggggacggagtcttgctctgtctcccaggctggagtgcagtggcgtgacctcggctcactgcaagctccgcctcccgggttcacgccattctcctgcctcagcctctcgagtagctgggactacaggtgcccaccaccacgcccggctaattttttgtatttttagtagagacggggtttcaccgtgttagccaggatggtcttgatctcctgaccttgtgatctgcccgcctcggcctcccaaagtgctgggattacaggcgtgagacactgcgcccggccaacattcattgtatgaatgtacattttcatttctgaagggtaaatgcctacaagtgggattgttgggtgatacgtaagtgtatgtttaactttataagaaattgttaaaccaatttccacagtggctataccacccattttaaattacttccatcaatggatgagaattgcagttcctacacattctctttagcactgggtattatcaggttttcttttttctttcttctttttttgttttttgatctgttctaataggtttgtagcagtatctcattgtggtttcacttagcatttccataatgtttaatgatattaaacatcttttgtgcttatttgccatctatacattttctctggtgaagtgtctcaaatcttttgctcatttaaaaaaattgagttgttttcttactgttgagttttgagagctttttatgcattctagatgcaagtcatttgccagatatgtgattagcaaatattttctcccagttcatggtttgtccttttattttcttaacaatgtcttccatagactaaagttttaaatcttaataaaatttagcgtaacaatttcttttttattcatggtgtctatgacagctaatttttggtgtcatagctaacaatcactttctaactccagtgtcatgaagattttcttctatatacctaaagttttgtattttaatgttttacacgatgtatttttagtgaatttttgtatacatgggtggttttaggttagggctctttttttgcatattgatgtccaagtgttccagtattatttgttgaaaacaacttcattgaattgttagacatttttgacgtgagatggtgtaatatagtttaattgttgaaagaatggagtgaaaccagtccacctaaatttcagtctcagctctgctacaaattagctgtgtaacaatcaccaagtatttaatctttctttgtcatagtctccttttctgttaaatggaaacagtcatagtacctactgcctagattgctatgaggattgagttattatgtgttgacacacttagagtagtacctgacataataagtgatgaattagggttagcttttatataacttttcagttattgtagatattgcgagcacgtcctgtaaacatgttttactaattacactgcccatcaacaatatagatgtttctattcaacagccagcaccagatattatgaccctctccattctttgacaatttgataggcaaataatgagatgtctttttagtttgtattttgagatctgtggtcaggttaaacatcttttcaacttttcacatgttgtgagtatatcagcttttgatgagtaacaaggcatccaaaacataatggtaaaacagcaaacatttattatgacttatgcttctgtatgtcatctgggaaactctttggcttaagctggattggtctctcatcctctagcgggttagtcttggcgtctcctcatgatggcctcagggttccatagagcagcagcaagagtgcaagcccagtgggagagcccagtgggcaagcacttttcaagcctctgcttatgccacattggctaatcctccattgatcaaaagaagtcccatggccaagcctagattcaagagatggagaaagaaactccacttcttgatggaatgaaatgcaaaatattgtgaccactttttcatgaatctactgcgactggctgtttgtgtttccttctctgtgaattgctattggttcaacgacttatgaaatttctttatatgttatacatattaactccttaagttttacatgtaacatacgttttacatgtaacagtatttttctacttggtcatttaacttcatttatataatcttttgctgtatagaaggttttggctttttctgtgataaaatctatcagtgttttttcttcatgacattggatggccagaatgtaagctttttgaaggcagaaaccatattttattttttattattttcttgacccacagaaagcagcacagagcccagcccatagtaataaaggtttattgaatgaatgcattcactgaaggccaatctcactcactcatttatttatttattcattcatcaatgtttatggaatacctattataaaccaggcattgtgctcattgttagagatacagcgatgggcaaaattgacttttagatggtgtttagactaaagcatggtaggtagtaatggaacttattatcaatgagacataggttcaaattgtatctttctacttatgtgaccttgggcatatccctaaacattcctgaatttcagggttttttaacctataaaattgagtgtaaatgctttccttcaatagtgtgagaattcaagtggacaatgtttgtaaagcacttagcattgtgtttattatgtattatataataaaaattgtcagcttccttttctacatggtataatctcaggcctactaggaaggctaggtgacttcttttgtcaatctcctcttagcaaatataatcctgaatttcttccattatagactcgtttctttgatttgctcctccaatcgttctccgtgaattgtcactttgagcaattcttgcttattctcctctttgtgcaggcaagtcagtcaaattgccttctctgttgggagcagaagaacagggcactgaggagacactgaattttgttcagtgctgtcttggaagatagatatgcttggttgtgggtgtgggtatgtacgtctttgagcagcataagggtagttgggaacttggcaggtaattgaatcaggagaagagcccagaaaaaggtggtctggttccaaagatgcatttttcccataccgggtatcctggtgctgataaacacagtgcatttagagagcatcccactcctgagacaaagtgagtagggaagatgatgaggcagcactgccaggcttaagggaatctgtaaggtggccaaaactcctctctagatattctcaatttctctgtcctgtaccctttctagctttttagccacctctcctcaaaatcttttttctcttcccccaatttctaccaaactccaggattctccaggcgccctcctgccagatgtatatacattccatattccctcacactaaggacttggctgttaacactgctactctggggtgacagaaagggccctggagagaaatcagcacttgagggctggctctaccactaccctttgtgcaatcaccaactggtctcttttctatatgcctcagattgcctgttataaagtgtaaggcttggccaggcatgttggcttatgcctgtaatcccagcattttgggaggccaaggcaggagcttcacttgagcccagaggttcgagaccagcctaggcaacacagtgatacccccatctctacaaaaaatttaaagattagctggggggaggggtgttgcatgcctgtagttctggctattcaggaggctgaggtgggaggataacttgagcccttgagttcgaggctgcagtgagcagtgactgtgccactgcactgcagcctgggtgacaagagtgagacactgtctcaaaaaaataaggtgtgaggcttgcaccaagcagtctgtaaaacctcttccggtgtaaacaatccttgatttgatggaaccatgcttcctgcacccccactgcctcacagaatggagtttgcatataaatgaatgttcagtaaagtctcgttgtgtggatgctctgtctgttccctggaaataaaaagtttcctgccagctgactgatcctcattctaactaacacatgtgttatttggcctagatggaaaatttccggcgtttgaaggtggcgagaggatgtcattccctccagcagacagacaagggtgccatttggctggaaagcagggatgggaaacgggcatggcctttggggaaactggcttggtacaactcctgggtgagcacaggagtttgttgttagagagtcacagcccagtcacatccaggatgcccctggataactctgaactcccagctatacaataaaaatgttagcaacttcctttagttatttccagtcttgtatattttggtatcttcttgttagctgcccaatatcttcttggaaggaatcttgaggaagaagttattgctcagagacttactacatacacaaaaggaagacagagaataaaaaaggattaaagtgttggaaacatgcctgggaactggatttcttcatgggagacaagaaggcagaaaagatactgaaaatactttaacataagggttgacacagaggaatagtgctggtagttcttagggcccaacagaaagaaattaatagcaactttaagatagagaaagaacattctagaattgagtcctactaaaaactcatttttgaaaaatgagtaactactgctcagtagttaccattttggggaagatttttctgattatcttctcatctctctcttgctttgcctggctaaccccaactttcctttagactaaaagtccacaaaccctccttcaaaacagtcaagtctgataaagtttaccattatggtgtctcataagcatcttgtaattctctctcttagtacctgtctgtatttatgtgtttatgtgattagttttccatgtctgtctcctacatttgcctataagctacgagacggttgtatattcactgctgtgtctccagggccaagtgcagtactgggcacaggggaagcatgcaataagtctgcgtggtaagtgaatgaatggacacataaacaacttaatgagtgctttttgaactgaagataatttttctttttcaggacagcaaaaacaaaaaacctaaactaaaatccaaacaatttcgcaaaatatcctggatagtttgggagttgtctttgcttctttggctcattgccacggccttaattccagaaatgcttttgactcagaccttttcagttcattgccagttccctgatttctgaaatgcctttggccaaggaagtgctaattggtatttcaaatatttagaactttaagatacctacttctgttacaaagatgaaattaccatgaacaccttttgaaaaatttaaccatagctaataccaaatttccaaaaaaccatacagtgaccatacagttagttgttctgaagacatgacgcattattccaaacacaccttagcagaattccacccaatactacaattctgaggtagtaagaagcacaagggaataagcctgcgatgcaataatttaatctgcctaaaattgtctcctagcttgccaacacttcgaagatcagggaactgggtaaatcaggacttgatttcatctgcagctgtatgtgaactggaatgtggaaaaaaaaaaaaaagctaattggagcaagcatgttgtgctgcagtggagtgtattttcattgatatgtttaacctttcatccccttcatctgtgaaaaaatgaaaattgctgacctttgaggttttatgtttttaattaagcaaaatttttttctttcaaataaaatcttatatgaagcccccccgccgcaaaaaaataaaataaaataaagttgagtagctcactgggagtgggtgagggtgtgggtctagagtccattctgttgatttcacctcttccactctcagaaacttctggagcacctttttagaacatgagaaattacagtttctttaaacacagtttaacatggctctgtctctaatttctaatgtaattaaattctataatatgggtgttgattcaggcccacaataatttccataactatttttaaataaaaatattcccatgtcttagttaatggctcattattcatagcaatattgaatacaagaaaatgtaaatataaaaactagagttaaacaacattttgagttcaccataataagatttagtgagaagacgctactaagaaagattagatactgttcaatatagaacacagaaaatacagtgagcaaaacattttagaggattgttatgcttcacttgtgatgcttggttgttaacttggtagacgtcatgccacaatgccaagtagttccttataaacaaggacacacttttatgcaaacattgaaaaagtgtttgaggctgggcgcatggctcacacatgtaatcccagcactttgggaggccgaggcgggtggatcacgacgtcaggagttcaagaccagcctggccaacatggtgaaaccccgcctctactaaaaatagaaaaaaaattagctgggcgtggtcgcgggcacttgtaatcccagctactcgagaggctgaggcaggagattcttttgaacccgggaggcggaagttgcagtgagcccagatcgcaccattgtactccagcctgggcgacagggcgagactccgtctcaaaaaaagaaaaagtatttgagagatctttgttaaggaaaaatagcattaatctctaaaacttataagatgtatgatattaaatatgcatcttgtttcagcaaattattagccttcatgatagaagtatgaattaaactattaatgaatttgatcagagccttttagatatggttgtgatgaaacaactcactatccgtccccaacatgatttggagaggatagcgctataatgtaagaaagggtattaagcagagagattgatattggtatgagcccagataggatctgtcttctggcaatgattctcaggaaatgtctctattagaaaatgtcttgagtggcaccagatatgcagtggcagccatgcctttcatggtgtcagcagcagaactctttcaagaagccacggaccacagttgtactcgttgtcgtggagcctctgctctattctttctgaaaggctgtttggctactttttttttcagcattaagttttaactcctttatttttcagcattgtgagataacatcacatttcctattattagttcaaagaagagagaaagagaaaaatgcattatttggatgtaatttgaaatttggagtagatatagggctgaaggatgagacataaagggacatatatgtccatggctcttgattcttttccagctgccatttttttctctctctctttctgtctctcttttatttatttatttatttttattacactttaagttcttggatacatgtgcagaacgtgcaggtctgttacataggtatacacatgccatggtggcttgctgcacccatcaacctgtcatctacattaggtatttctcctaaggctatccctccctgacctcaggtgatccgcctgcctcaatctcccaaagtgctggaattacaggcatgagccaccgcgcccagcctccagctgcccctttttaagaaatgggccataacacttttttttacgtttaatttttatgtgtgaataatagtcaaattgttcaaaagccagtacacacaagcatatagggaaaagtcttccttttaccattgtgccccaactacccagttcccccgaataggtcatcgttgttcttctttttatgtgtcaccttctagaaattctttaggcagatactagcaaatacaactatagattctcattttaagaaaactaagcaggtgattttcaagactcatcctaggaagctggtaggtatgtcttcttatacccaaagctcacatagaagatccttctggtactgtaaatggggttacaaaggacagagtactggctggtggaagaggtcttccttaaccggcatgctgaacaagggtagcgaagtatagtcaagtccagactcccagaggccacaatttccttttccgtcactgaaagtaaagggagatctctgaaaggagcaagaggaaaaagaaactagatacatacctagaaataatttatacatagcttggttgtcttttcaaatcaactgcattttgtattatttcctaaagctattaaataaaccacggccactgccaccgctgggagctcagagcagatcctgtggttttggcaagactcttgactggccctagaaatggggctggattgaactggagttgaaagaattacagtgtttccttcctcttgatgactctttctggaacatgcctggaatgtgtgagtgtgagagatgaagtggtgttcactcagagtcaggcctgggtatgtacgtggaaggggaggtgtgtgctggtgttatttttggaggctgtaattccactgttaggctttgtagctcgtcgtctctttcaatgtttttactatcctaacttgtattctctgtcctgagatcttaaaagttaccaatgaggctagaagtaaaatggatgcttcaaggccaggcttgggaactcattctagtggagattttctccctcaatctcatgtaatgagttaatattacaataaaatgcaggtgtaactcctgcttacacgaagacttgactttgaaatttttctttctaatcattcagataaaggtttaatttgtaccaagattatcctcaaaacatcactgaatacagtaaacactggcaattgccattaaaaacaaattatatgaggactttatatcaggtacaatgcttgacataagtaggtgctcaaaaattctggtaaatgaatattagccttaaacgctcagcagtcattggtcacttttctttggcattttgtaaaaattgtaatgtttttttccccaaaacattgggaataatgtttttttgccccaaaacagttaaatatgggcaaggaggtcagttcagactcgggggagcacttttgtttttttttttttttgagacagaattttgctctttgtcgcccagtctggtgcgcagcactggaacctctgcctcccgggctcaaatgattctcctgtctcagcctcccgagtagctgggattacaggcacccaccaccacacccagctaatttttgtatttttaatagagacaacgtttcaccatgttgaccaggctggtctcaaactcctgacctcaggtgatccccctgcctcggcctcccaaagtgctgggattgcaggcatgagccactgtgcctggcccgcactttcatttttaaccttattattctagaattggaagccgagcaaatggatggacttcagtcaggcagatctgaaataaaatttgcccatccatccatcccattcatccatacactcatccaacaaatacttaagtcctctatatgttgagattacggagaatattccattgtaaaccaattcctaaattcctcttcctatacagaacatttggagtttatcatttagagggagagtaaataaaataatcacaaattatggtaatctgtatgaataaaacaggaggccaaattagaggtcaatgggatgagagtgtataggtattatagataaggcaggtagagaagccttctatgagaaagtggcacttaagctgagacccaaaggacaagcagaaggtggccatgccaagagtggagaaaaacattccaggcagaaggaacagcaaaggctttgaggtaggaaagagtatcttgtatccaaggaatcaaagaccagtgagcatttgaatcccagctctgccttcaatagctgtggaaaatgaaactagctgctcaatcttttgagccttcatttcttcatatttaaaattgagataatggtgcatacctcacagagttgctgaatttaatgggtattcaataagataacatgtagcttatttgaatcacttctacacaaaggtctctgagactctagttgggccctcatcactcaattgatttttctagtctcctgattgttttatgcacatttgagagccaaccatcactggagctagagaacattttccatccctgatatttccacatttaaagaggagagaatagacacagactctatctgctcatgttagaacctttagaaatcaaaaaagggaggggtggggaggggagagagagaaagaaagagaaatagtgagaaaataacatgagaggattttctttttaaaagtgtacttcctcatttacagaacaaattcataaaatttaaagtttgggtaaggttttgtttttgtttttacatttggggagagggtaaggtttggggctaagtgttcaggaaacagaataaagagaaatgaaataataatcactgagtatgcaatatataacagacagagtggttggcaagttatgtattttatcttatttaatctttacaagaatcctgatggagtaaatgaggccctgagggaaatgaagacttcacttagtcactgtctgtcacttatcttgaggtatttaatgtggaattgtgcaattctttaaaaatgagaatctataaggcataagtttatgtagttgatatatttctttagaatactttattattgtgacagtatcacattagcatcaattgataactaatagttaaatgaataatgataatgtcattattattaattcatcttaatactacatacatttcctgaatacccagctatgtctagtgcatggcttgttgggggaataatgggtagtccattgcaactagggtatgcagtggggcaggagaggttagcagggtctagctgatgaagggtcttgatgccttggtaaagagttttggattttgtccagtggaagataggcacatggtcagaatagcattttagaaagaatcctcacacaactttaagacaaggctttgtgagcaccagtttacccaatggggtcatgttaataaccttagtcatacattattgtctctctttccttttaggaactgtggaaggtgccatggacttgatcttgatcaattccctacctcttgtatctgatgctgaaacatctctcacctgcattgcctctgggtggcgcccccatgagcccatcaccataggaagggactttgaagccttaatgaaccagcaccaggatccgctggaagttactcaagatgtgaccagagaatgggctaaaaaagttgtttggaagagagaaaaggctagtaagatcaatggtgcttatttctgtgaagggcgagttcgaggagaggcaatcaggatacgaaccatgaagatgcgtcaacaaggtaacatgcccctaagttttgggcaggtgaggcccactgaggaacacacacaccttttgtcttggcagctgctccctcaggggcagggcatgcactacctgaatgtagagcttgacgatcttgcctgtctctttccatgcatcaccgtgtctggtacatggaatgttagagataaaggagactacccagtccaaccccttaactagatactgtgcctactttgtgagatgaaatatttcatatgttctaagggcatcatggtacttatggatagttgactgttacatgtatgtaatatgaaaatcatagcaatgaaaacaagtgttcattgccaaactactattttgagctttcttatttgatttttcatgtgatacattgctttgcttgtccctaaatacccttaatggaagttaatattttcaggagaaaattaaatataaataagaattttagaaggggaatatccatcagtaacttaatttaattagttatttggtatatcaactttcttttcctttttttttttttttgggggggtggagtctcactctgtcaccggactagagtgcagtggcatgattttggctcactgcaacctccgcctcccgggttcaagcgattcttctgcctcagcctcccaagtagctgggattacaggcaagcaccaccacacccagctaattttttatatttttagtagagacagggtgtcaccatattggccaggacgatcttgatctgtagacctcgtgatctgcccgccatggcctcccaaagtgttgggattacaggcgtgagccaccatgcccggccagtgtatcaattttctattgccacaataatgctgtgtaacataaccacaaaccacagtggcatacaataatgagcatttatagcttgtgagtctaagtcagctgtgttgattagatggatgtattgaccttggttgggattccttacatatatggtgttgcctggctataggcttagtaggctggccttggctggggcaactttgctcagttccttatactatagcaggctaaggtagtataaggtcatagtgtacaattctcagcttaggttgccaggagcctcatgtgtttctatttttttgtaccactgccatctacatttcatgtacatgagatgtagacatgaggctctttgcaacctaggctcagaattgtacactatcacttctgcttcattttatcaacctaagccagttaagtagctgagcctagtatcagagtgagagggcactacaaactgaaatgacaaagagtcagggatacagggagggatgaagaattagggccctctttgcaggctaccatttttggaaaaggaccatgatttaattttagcagtcgagtacccaggtccagctcagaaaacaccagaattttgccggaggattttgaaagcctcctctaagggaggattattaagacttgctaccaccccacaaggtgatgatgtgatgaagtcttcctcccaaaataaaagtgggccttaagctaaatctttagaccagtccacctgtgtgatggcagttgaaggagatggtgttgcaaatattatttaataattgtattataaggttccagtcctggacaggcaggcagacttctggtgctcttgatgctgtctgctgggaggaaggtacagaattccagctaaggtgacctctctttgttctgcctggaatgatctggcctctcccctatcagccactttgtctgggctgctgattcctaaaatgaaggagtcttttccaaattagtatcatcacaaccacaggagctgtggactgaggacttgtcattacataaaataatgacattgtcagctgtttagggttttttttttttttttttttttttttttttaaagacaagggtcttgctgttgcccaggctggagtgcagtggcacaattacagttcactgcagccttgacctcccgggctcatgctgttctcccacctcagcctcccaagtagctgggactacaggcatgcaccaccatgcctggctaattaaacgaatttttcatagatatgggggtcctgctttgctgcctaggctggtcttgaactactagcttcaagccatcctcccactatggcctctcaaagtgctgggattataggtgtgagcccaccaggcctgacttttagaaagctgatccagttaagtaacacacctctgcacattgctgattggctgtttcttttataatctaaccatctgtagtctgcattttttttagatcaatgctttttaaagttgaacatgcttacagatcacctgtagttcttgtaaacatgcagactctgatttaataggttgtttgggacagtcctgggattatgcagttctacccaggtcccaggtgatgagaatctgctcgaccatggaccacgctttgagtagcagtttagagttagcctctaacttgggtccagctgaaaatatttctttgaatttactaatggtagtaatgaaaagatttgaaggcagcaaactcattttaaggtcaaaagtaataaaattgctgttcattccaaatgaaggaaagggttttcttagcaaaactagaatgttcacctttaaatgacagcagggcaagtgggaaaagtgcacaacagaaattcccaggaatgcagctctccgttgagggaagagaggttgaacaaagggatgtgaggtgtgccaaagctatcatggctgaaagtcagctctattatttttcacatgtgtcattttggatttgacttgtataaagactaatattcttctgctgatgtttccacattctaaaggaagatgatctgagattatgccccagtcatttcgtgggaacaaaatgtgaagtgccactgtgtccttgctgtactgtcctgaggtcatccttgacaatgtataaataagaacatgtaaagcaaactggaccagaacattgggagttaaaaacccgctgtaatgatccccccaaactgagaggctaggtgatcacaggtaaaggatggcttaacttcagttaaataaggcaaaggcagacctggatagtgagaaacactaacgagaagatggcttttagaattatgctcacttgagttttaattcgttctccatcactcaccagctgtgtggcctttggcaagttatttaacttctattggtctcatttatcatcatctgtgaaatgggtataataatacctacaaaattgttttgttttaaataagttggtatatacaagaagcatcgatttacacagtgaacgttgtccctaaaagcttaggtaaagcaatatattgcagaataaggtacatagtaataagaataatagcagcttgtaaatggtgggaatggcatttgatgccgagtgatctgacttcagagccagtatttattaccactacgctaccctttggatatcattctcacttaatgttagcaactctccctgattctgagctcttgttttataaagtacaatgatcctacctgaagtcctaaaaagcaacccagggcacagagtagaggtatgagagtggaagtcagacagatatgggttcgagtctacctctgcaactgagtggtgtggctcaggacaagttacttaattgaagtcatattttttcctcatgtgaaaaaaaataaggatagagattttatcacacatatttggaaattaaatgaggcacttaactattaccaattacattatctgcttcacagtaaatgtttaacaactgattattgtaatttctttgagtaataggtgagataattttccgactcaattgtagaaatttttactatgcattcacatattatggagttttacacaaaatggaaaaataggtatgttctctcctgtattttaacaataacagcatctcaggctgatgaacaggttctgtttttcttgctgaccatccagtgggggaaatctggtttgaggaaagtgaaatcctttatgatgaatcaggaaaaacctccaaaactatgttttcatgtcactattaattcgttattaaaacatcatggaaactcagaaatgcctgcctagggacacagcaggataaaataaacatcaatatattcctgcttgctgctgactcgtacatctgtggaggaagtggaaaatccatttgagatgtgccaaaacacagcttaaattggctcacacactccaaacagacaaactggattttatcaatggcatcatccaaaatagtcaacagcagtttgactcaaacctccttggtgatttcatttgggggtaggaaattatatataaagtttgaaacgttttcagatccaaagacctgtttcaaactgatccattagaagaaacagagggttattttattcctactttcatttgagaaatagctttatattaagaatatcaaacttcccaaacataatttacgaagttgttagagaagagccatttgcacctaaataaccaaaggaatatgttaaaagcatcaagaaaatgggaaaatctgaaacagtttagttcatttatactttcattccacaatttttcttttcttttttttttttagacggagtcttgctctgtcacccaggctggagtgcagtggcgcgatctcggctcactgcaacctctgcctcctgggttcaagtgattctcctgcctcagcctcccgagcagctgggactacaggtgcgcaccaccatgcccagcttgttttcgtatttttagtagagacagggctttaccatgttggccggggtggtctccatctcccgaccttgtgatccacccacctcagcctcctaaagtgctgggattacaggcgtgagccagtgcgcccagccaccacaattattcttgagcctctatttttgccacatgttttcctgaatacttgtatgcctgacattcccctagcaacttcatatgtattactaacttagtctttatcaaatatatatcagatgaggacttttaagaccccactaataatagatgaggcttggctattgtaacttaacgtgcatttactagctagtgagtgttggatctgggaaggtgaagtcaggcccgattctagaagcctggctttaaccatcaccctgtgctacctttcaaaacagatgtgatcttgccctcctggaacacccaatctagtaggggatatataccatgagtggggctataatgaaaaaatgcagggtatttagggagtagctatgagggcatctaacctgtgttccaggtgttgtgtgaggtctctgaaaattcctaaatggaaactgatgaatgagcaggagctggtgaggctgaggagaaaaggaggagaaaagaagaaagaaaactcatgacttggacatgagtgatgagatctggctgaggaactgaatacagttcaaagtggctggaattgagagctaaggatgtggacctggagaatgataagtctggagaactaggggtggaggtcttgagtttgtgtctcaacttccacatttattcactgttgataggccttgggtaagggacttagtcttccttaactccatctcccatatggataaactgtagctatactgtcttcacaggactgtggtgaaattgcacaaaataatcacagatatgaaactacattatttcctgtagtacttacacaacaattaaattgaaaggagatgactgaaattgagctcacttgtttttcatctgtgttttcacttgtgtataacttttactaccacctactttcttctccagaccttatggaataaggaattatatttttagttaagttctgcccatgaattagcccatccaaatgatcttaagcaagttatcttccaacctaggcctcagcagtatcaaatttaaaatgaggtggttggaccttaaagccttctgagtgctaacattacataatctatgaaagcatccagagcgagattccttggttcaaatcctggctctcccatgtatatgctgtgtgatcttggacaggttacctagcttctctgtaccttaatttcctcatctgtaaaattaggataattgtagtacctatctcatagggatattataaaaagtaatttttatttagttggagtctcgctctgttgcccaggctggagtgcagtagctcattacagtcttgattttttttttttttttgagatggagtctcactctgtcactgaggctggagtgcagtggcgcaatctcagctcactgcaagctccgcctcctgggttcacgccattctcctgcctaagcctcctgagtagctgggactacaggcgcccgctaccacgcccggctaattttttgtatttttagtagagatggagtttcaatgtgttagccaggatgatgtcgatctcctgaccttgtgatctgcccaccttggcctcacaaagtgctgggattacaggcgtgagcaactacgcctggcctacagtcttgatttcttaagctcaagtgatcctcctgaacagctgggactacaagcatgtgctaccatacctagctaatttttaaatattttttttgtatggagcgggggtctcactgtgttgcctaggctggtctcaaactcctggccttaagagatcctcccaccttggcctcccaaaattttgggattagaagcatgagccaccgcccccaggttgacaattaaatttgtgtaaagtgcttataacagcacttggtccatagtaggtgctattaaaaggtatttatcgtttttatggcctagtcaagtcacataacatcaatatatgtgtactgaatacaagccaggctcctgtgtcatcagaaagcccaaagtagaacatgaatgttggatttccttcgttagtactcaacagagagcaatcagcctagagacattcatgcagaggtaaactctggacagcagtgaaactctggtgtgataatgcccctaagaaaacaggaggttaaaaagcacagtcctaaataataaagagccacagagtggtggggggaaagctacttggaattgagcctactggggaaccttggttcctttcagaacacaatactgagtgagaagtcccacggtcagctaaacaattctcacacaaaggagcagaaaatataaacaaaccatatagacaggaacaacagcatgaaatggtcagaaaaaaattctcgtaggagtccaggagcatgccacagagagcaagagctgcatgcatttggaggtctaaatgaagcacttggcaacgtgagcagaagccccacaaagacagcccccctcaccatccagtcccctgtctgctcttcctttatggctggctcattttagtgctctggagaaaagtgtccctcatgctcatatcacaaatgtcagcacagcagtgttgctgtttatattagaaggataccgacctcttctaggcacctcagggcttagcctacatcacttaatattactaacaacctttgaaggtaggtatcattacttttcaattacacatgagaaaactgagatttgcagaggtgaagcagctttcaaaaagggtggcagagggtggatccaagcccaggaatgtgtctgattccagcgctcgcactgctggaatgatctaccccgtgctctctctgggtttgcccccaggtcatcatctgcaccaaaggcattcacatacctgaccaccaggggagtctgtgcaaggcacccatgctaggatccgcaggcacagcccacagccgatgaaagcaagcaggcaaacctaaagcccaggtccttctgagcatggttcggaggcatcttttgccctcacagggtagttgtctcagccagtggcgcgcacagcgcttgattagtctttctcaaaccaccatctgaaagccacggatgagatgagaatgagggcacagcgaccagctggttcatcacaaggtcctcagcaggatccctatgatcccaaggcttggtcctggtctgaatctttataggaattcttactttgggggacaggatgttttgctattaatttctaatttaggtgcattctggtcagagaattttgttattaacagagatgtgctttgtggataaacaggcaatgttctggtaaataatgtgtatttcaataactgagcaaggggttaatgaatattcaacagatctctaatagtgttattaaaatcttctaaatatttccttagtaattttcagtctttttgattaatttctgaaagtttccaccgtgttcacggatttgtcagtttctttaattctgacactttttgtttcatgagctttgaaattctgttgttagatgcatatataatttcaggattacaatatcttcctgaacatgacacgtgaataaaatctaacaaggttttatcagttagtagatggttctgttttatcattacataatgaccatctatatccctaatttttagctttataataattttttctgtataaatgttgcaatactagctttatttagtattagtttgctatatatttttatatccctttattcacaatcttatgtgccattatgtcgaatgtatacttcatgaaagagcacacagttttatgtgtgtgtgtgttttagaattgagattctagaatctaagattttctgatctgaatttgatgtgagctcctgtcttttaacatacatttggcataatgtctgccaccttatcctatcttttccacaccatgattttctctggtcctttttttctcattttatgtcttttgtttccttatcttctctcttgccctcttgttgaggaaagttagatagactgtttctcttcctttagtggtgatccttatattgttaacattggcttaacttaaagcctaaagctaatgcctccttatgtcacagagtttggctttctgcagattatgatataagttaagggaattcagaaactcttgttgctggaagaaagttagaagattttattcccatatcttgtccaataagccaagggaatcagtcaatgttgcatggcaagcttgacacagtaacagaaattttcaatcaattggcttattttattttattttatttttgagactgagtcttgctctgttgcccatgctggagtgcagtggcatgatcttggctcactgcaatctccgcctcccggattcaagcaattctcctacctcagcctcccgagtagctggaattaaaggcatgtcccaccgtgcccggctaatttttgtatttttagtagagatggggttttgccatgttggccaggctcgtctcgaactcctgacctcaagtgatctgtctacggtggcatcccaaagggctgggattacaggcatgagccactgtgcctggccttggcttatgattttgtaagtcaaatataaaataattttcccagttacatgtcagtactgtccagttccataactgtgtcagttcatacatatataattaaaaggtagaaggcaagatattagattccatccttgtctttattcttcaatcttccaatatttacaccataagtagtaagtccagcattttgctcattttatttgagcaacgcatggggcattctaaagcaattagaattatttggaacaacagcaacacaaaaggaccaggggaaaagccatttggtaaattttttttctctttcactttggggaaactcagatttcattcatgttttttttttcccactttaagaatacttgggattggagaaggatggcagattcatagttaatatagtttattgttagtatcaggacttagtttgataataggtacagtttgagtgttccaaatccaaaaatctgaaatctgagatgctccaagatccaaaaatatttgagagccaatttgatgctcaaaggaaatgttcattggagcattttggatttcagattttctgatttgggatccttagctggcataatgcaaatatttcaaaatggaaaaataaaatctgaaacacttctggtcctaagtatctgagataagggatattcattctgaactaatcaacacaaagtcctcatctccccaaccactgaatagaaaaattgtgtataggcatattgtttgtatatatttacactcttataaaggaagtgaccatccctttcatcagattcttagaaaggtacataatgttaagaaaggttaaaacgcattagccaccactgtttttcaccttccaaaaaccatctgacacctagcaagtgccagccctcattttctgagtctcaaagctcaattgctcctggagaaaatgtgtgatcccatttttggtatttgttttctctcttttaaaagcttccttcctaccagctactttaactatgactgtggacaagggagataacgtgaacatatctttcaaaaaggtattgattaaagaagaagatgcagtgatttacaaaaatggtgagtatgtgtttcattgctttccccagtatgatgtgagatatcagataacatacaacatattgaatcattttcctattgtggtcttgtgggcagatgtttgaattaaagctgctatgatgcaagctttcaaattctgtgtatgatagaagccctcttaggtgacatatttggttacttaaggatattaaagtggaattcatatatatgaatgtacatggtgtatgtacatacaataaaaccccatcataatgtgagatcccaacttcagccatataaagtgtgagtttctttgattgtgacattgttgattgcaaggtttaggaaattaccacagtaaacatgggaagccaattgttagcagttctggcagtccaactgtgtaatccaaatgtgtctaggtcctagctatggtttcgtaccacccagtgtcagttgcctgatccagctggaatattgatggggatcattctgaagtctgtgagtggataggacttccagattggagtagcgattatagatatctcctggttaattggttagttgacagggttacctatcatttttcacctaactttgcctgccaactatgttcgcctctccctgtagaatgtaagaacttagaccacccccatcttcatgtgtttggtggtagatcccacagactaacctatctgttctatcactatgactttcttgactattgagagagtactgaatagttcagcattttcattcttctcccacatccaatatgtgagagcacattttcttgaccatgtcagggaaagctaattaagtggagaaaccagacaaggaagcaggtatgtttcagtgtgacctacggttcttcactcttccctcttactaggttccttcatccattcagtgccccggcatgaagtacctgatattctagaagtacacctgcctcatgctcagccccaggatgctggagtgtactcggccaggtatataggaggaaacctcttcacctcggccttcaccaggctgatagtccggagtaagtgatggagaggccaccatttgtgatggtgtagttgttaggttgttaggatttttagttgcaaataacagaaactaaccatggcttcttaagcaaaaaccaggcattggttggaggttgtattagtctgttcttatgctgcaaagcaaatgaataagagatagcaatcattagaggaatgacagagaaacccaggtatttagacctgaagacttaaatatttaatattacaaatacttgatacagctggggaaaactcagggcaaatcattttcttttctcagggcaaatcatttctaatttcacatgctctttattgagacatacctgagactgggtaatttattaagggaagaggtttaattgactcacagttcaatatggctggggagacatcaggaaatttacaatcatggcaaaagaggaagcaaacacatccttcttcacatggcggcaggagagagaagaatgagagtgaaggagagggggaagcaccatattaaaccatcaaatctcatgagaactcactcactatcatgtgaacagcatgagggcaactgcctccatgattaaatgacctcttacctcctactgggttcctcccacaacacgtggggattatgggaactacaattcaagatgagatttgggtagggacacagccaaaccataccagacggggacactaaggactcttaataaactgatgggaaagctgaaaagtggctgggtacggtggctcatgcctgtaatctcagcactttgagaggccctttgagctcaagagtttgagaccagcctgggcaacatggcaaaaccccgtctctacaaaaaatacaaaaattagccaggcatggtgatgcatgcctgtagttctagctatttgacaggttgaggtgggaggatagttcaagctcgggaggtcgaggctgcagtgggccaggctggttgaaagagcaagaccttgtctcaaaaacaaaaacaaaaactataaagcaagttccagaaaagataagcttcaaggaagagctgaggctcagttgtggtgggtgtggggaggtaagggagtgggctttctctctaagatgctgcttttaccatgtctcagcttcagcaatgtttctttcacttccaaattttgaatttccaggataaataatcagattggcctaacatatattagatgtctatcagcctagaccagtgagctatagacaagggtggagtcacgtactacacgttacaggcactagaagctcacatttgtacagcataatcatccatataaaaagggggatcacaacgagtaaagcagtctcactgaaacgtgtctgctctagggggatgagttggacctcttgggttagactaacatctgcttaaacattgcctcctgtaaatcccacacttcccaggtcatttaactcttatgtgtgatttttattttcagttttgaaaaatgtaagagttagaactagtaaaaactttttttctccattataactattgaagtgggggcataaatatcaccattacattttcctgtaatttttacaggaacttcacaaatagaaagaaaatgatttgccctgaattttccccagctagatcaggttttcataatattaaatattgaagtcttcaggtctaaatgcctgggcttctctgtcattcctctaacgattgccatctccaattcatttgctttgcgttatgttcccccattcatttaccaaaatgtgttggtcataactctgtgccaagaattgtgttggtgttgagaatacaggatcataagataaatccgtgtcctttgggtcattcccaatcagagtaggcacgtgtataattagctaaataaatattgaaaaatgacaatagaagtatgagaagtgtggttcctctagtttatgctccatgcttagccacctctatggacataaaatatagcaaggtgttttataggcaggactatttgggcttgagtcgaggggaatctttccacgtacccaagacctatttccttctggatgactactgtgcttgacttctattaaatgtcagagcagcctttttgtaatatgaatcttaaaaaatataatttatgatgatagcaaaactgcaatattcagcttctagtagcttgcctcacagctacctttacatgaagtttctgtggacttgggagaagcaagtgacatccccttttattccactactcaggagagtctgaatgtcaaggaagcaatttgcctttatttcatttagctagtttctctggagtctgatataacaccatgtactaggtgtactcagagggtaaatggggtacatcttctaggaaggtcagacatacctatacatgttgatatatagttgtttgagataggaaaaccaaagtgtttttcctaatctctgctctcactgaacacaacacttctgacaccaatgtgcacagattactacgccacttctagaatttctcattcagtaggtcgtggttgggtgggatctggggtttgcatttctaacagattcccagatgatggggatgctactggtcagagaccacactttgaaaaccacagctccagcctgtaaccatacctgcagctccctggacatgccatgctgtcttcccatgccttgtctttgcctggaagacactctccagccttatcttctttgctacttagttggtcctgcagattcagcttgcataccatatcctctgggaagccttcctttatgccctcttctatccaccagacagagttaggtactccttgtctttgtttctgtcgcgatttcctgtttacatgtctgtctcccatattagatgatgagcttttagagagcagagcctgtattttatctttattcaccattgtccactgaatgactgacacacagtaggtgctcaataaagatgtgttgagcgaatgcgctctactcaccacagccttgttttccttaacaaaaggatgtgaagcccagaagtggggacctgaatgcaaccatctctgtactgcttgtatgaacaatggtgtctgccatgaagatactggagaatgcatttgccctcctgggtttatgggaaggacgtgtgagaagggtaagtaaagagacttgataagtaagctgtggatttaaaaagccatcgttgctggatctagaattttagatctcgacacagatgggaatggacgctaaatggcctctgttaggtcagatggtacctgtgtgtgaattagaaaaaggtgccttttcctaaaggttctttaatgccaaccactggaaagttataataaatatacagatccgtgatgtttacagtgtgaatgctgccccctaggtttgtgcactgcacaaacctgcatgattgtgagtgatgtccctgatgtctgctctgtggggcagtttcattatcagtaaaatgggccataagggtatgttcatcctaccatgccacagctgagatttgactgtttcccatattcactagactaggagaaatgaatctaaagaattatgtatttcaaggggttgcatatttgactctgaatcatcttttcttttcctcccaaagcttgtgaactgcacacgtttggcagaacttgtaaagaaaggtgcagtggacaagagggatgcaagtcttatgtgttctgtctccctgacccctatgggtgttcctgtgccacaggctggaagggtctgcagtgcaatgaaggtatgcaccaatcacacccttggacagaggatgttctagcaggtatataaaggagatccagtttgctgtcaatcacaacatcggatatacctggactgcttagctacccactactggacaacaggattttgaatcatggatgtttacatccaatgttaattatactttcacagtaaaaatctagaccgcatagaaagtacttctcataactatcatctggggatctttactaaagcacggattctgatttggtaggcatggactggggcccgaggttctgcatttctaacaggctcccaagtagttccgatgttactggttttcagaccatgctttgagtaggaagaccatagaagacttgttttttttttttggttttttttttttttttttttcagtgaatcataaaatcacagctttagccaggcatggtagcacatgcctgttgtcccagttattcaggaggctgaggcaggaggatcccttgagcccaggagtttgaagctgcagtgagctatgattgcaccactacactccagcctgggcaacagagtgagacctcgtttaaaaaaaaaaaaatcaaaatcagagcttttatgtcagatccagacaggatttggggctcaaaaattgaagaagttaaaatcttacctgccgtggaccttatgcaagtagtactaacatcatctactcagagtccctctgccctttgtaaaataagctttcccatttgaccaggctctgtggagtgcatctgacatccacttttcagtatgcatttcacatctactgttgcatagtagctcaacatgaacctgcagacaaatgtgacagaacctccctaatgtatattaatactgtgaattagccagagctcaaaggcttttcagtgtttatctcacaaagtcagcttttcccatatccggcactaaaggtagctacgatggggtcccagcaacttgataacaatgctccagggcagagcagttcagtagaaatataagccatccacatatagaatttaaaattttctagtgtccacattaaaaaagtgaggagaaataggtgaaataattttgatctattaacccaatatgttaaaaacattatcagttcaacatgtaatcaatagaaaaaagtattaatgagatattttacattccctttttcatagtaagtctttgaaatttcagtttggactagctatattttaagagttccatagccacacgtggctaactgtactggacagcatagctccaggggcttggaggaggaggacaaagaggagagttacacaaaagtaagcttcagccacctgcaatacctcattcagttccctctaaatgctatgtctgccccccggaacatgcagtgagccacagcagtggagaaatcccatctggcctctgaagtgtgtatgttaaggtaaaaggtgactccaggcagggggcagatcccttgtattttaaaaaaaattaaaatgttacgcaaactatgaacactttgctaggacccaggaagcggtgcatgccagcagtctctagaacataaacttcatcagctttgtagtgaatgtgtctctgggcccaggtttttttgttttttttttaattctttttattattattattattattatactgtaagttttagggtacatgtgcacaatgtgcaggttagttacatatgtatacatgtgccatgctggtgtgctgcacccatcaactcgtcatttagcattaggtatatctcctaatgctatccctcccccctccccccaccccacaacagtccccagagtgtgatgttccccttcctgtgttcatgtgttctcactgttcaattcccatctatgagtgagaacatacggtgtttggttttttgtccttgtgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccacaataaacatacgtgtgcatgtgtctttatagcatcatgatttataatcctttgggtatatacccagtaatggggtggctgggtaaaatggtatttctagttctagatctctgaggaatcgccacactgacttccacaatggttgaactagttttcagtcccaccaacagtgtaaaagtgttcctatttctccacatcctctccagcacctgttgtttcctgactttttaatgatcgccattctaactggtgtgagatggtatctcattgtggttttgatttgtatttctctgatggccagtgatgatgagcattttttcatgtgtcttttggctgcataaatgtcttctttagagaagtgtctcttcatatcctttgcccactttttgatggggttgtttgtttttttcttgtaaatttgtttgtgttcattgtagattctggatattagccctttgtcagatgagtaggttgtgaaaattttctcccattttgtaggttgcctgttcactctgatggtagtttcttgcccaggtttataagagtacatttcatgaactcatctcagcccattcctggctcaagaaatcaccaagattttatgaatagaactgttctaatattcttccagactcctttcaacaattactatcctgttcattccatccaaaaagcagtaggaaagcaaggagacatttctaacagtaactacttaaggacatggtctcctttaatagtccaggatttagaatagtcaacaatagattgtacactggcaagttttatgtatcagggctggtttctatctgaggaaataagcaataatagaaatttttgaagcaaatagtggggacaataaagagaacaggggaattccactgtgcaaatatgtgataattcaaagtcattcagaacactttgccaggaagaaagttctagtgtattctagaaactaaaaaaatcaaggcttcatgatattttaaggtcttctgccatcccaacagaaacttgatttcagtagtcagatttcctttatgcttattaatagttcttaacctttctaccatctgctttgagtaagaagttgtgattaagtttttttccagctttatcaaggtctaattgctaaataaaaattgtatgtagttaaggtgcaaaatgtgatattttgatatatctatacattgtgaaatgattactgctgttaagctaattaacatatccatcacctcacacagttatctgtgtgtgtgggtgtggtgagagcatttaaaattgctcagcacatttcaagtgtacaatacagtaatattaagtttagctaccacactgtctattagaactccagaacttacttatcctactgtgtaattaaaagtttttgccctttgaccaacatctccccatttcctccaccctgtagtccctgggaaccactatgctactctgcttctataagtttgactttttcagattccacttatagaagagatcttacagtattggtctttatatgcctggcttatttcacttagcatggtgccctccaggttcatccgtgttgttgcaaatgacaggatttccttcttttcaaaggctgaataatatgccattatatatgtgtacacaccacattttctttatccattcatccatggatggacgaatggtcaagtccatattttggctactgtaagcaatgctgcaatggacatgagaaaacagatgtctctttgagatagtgatttcatttctcttggatatataccagaaatgggattgctggatcatatggcagttctattttgagtgttttgaagaacttccttattgttttccataatgactgtaccaatttacattcccaccaacagcatacaagggttccctattatctacatccttgccattctagcaggcgtgatgtgatatctcattgtggttttgattttcatttccctgatgatcagtgaggttgagtatttttcatagacctgttggccatttgtatgtcgtcttttaagagatgtcggctgggcacgatggctcatgcctgtaatcccagcactttgggaggccaaggcgggcggatcacctgaggttgggagttcgagaccagcctgaccaacaacgagaaaccccgtctctactaaaaatacagaattagtcaggcacggtggtgcatgcctttaatcccagctacttggggggctgaggcaggagaatcgcttgaaccagggaggtggaggttgtggtgagctgaggtcatgccattgcattccagcctgggcaacaagagtgaaactccatctcaaaaaatgaaaaagaaaaaaaaagatgtctattcaggtcctttgtccatttttttatcaggttgttttcttgctattaagtggtttgcgttccttatatattctggatattaacctcttatcaggtgtatactttggaaatacattctcttgttccatacattgtttcttcactctgttgattgttttctttgctgtgcagaagcttgttagtttgatgcaatcacatttgtctatttgtgcttttgttgtctgtgcttttgaggtcatatccaaaaaaatcattgcccggatcagtatcaagaagcttttcccgtctgttttcttctagtagttttacaatttcaggtcttatgttgtgtctttagtcaattttgttttgagttttgaatataatgagatgaggttctaattttattcttctgcttgtggttatccagttttcccaggactatttattgaagagattatcctttccctgttgtgtgttcttcatacttttgttgaatctgttaactgtaaatgtgtaaatttatttctgggctgtcaattctgttccgttggtctatatgtgtgtttttatgccagtaccatactgtttttattactatagctttgtaatatattttgaaatcaggtaatgtgatgtctctagctttgttcttcttgctcaatattgctttggctattctaggccttctgtggttcaatataaattttagtatcgttttttctatttctgtgaaaaataccattgcaattttgatagtgattgtattgaatttgtagataacttagttgtgattgatactaaaaataaagactgcattttagctgggtgaataaaatacaaaatcaaaacaaatcatcatagccccaaaagacaagcttttgcattaatttttggttagaagccttctagtaatgttacagttgaccaaaataaggacacccagttaacagaatccatttgccatgtaccaaattctaagaattgtcctggcaggtttagtgagctccaagggaaaataatgcttctaccctgtcttcccaggagcttattacaagtatcaaaacataatttgaatggcttaaatattctactataaagaaacagtcttaaaaagctaacattttaaattatcttgatttttagtttttagcagtttaaccatgatgtgcctatgcatagtttactttatatttattctgctaagggcttaacaaatttttgaatgtgtaaatttcaacaaattgggataatttaaaccattatttcttcaaatattttgtctaaccctttctctctggtccttcttggacctccagttacatgtgtgttagatgttttgtctcttgggtccctaaggattaaaaatcatttttttccaacctttttcctacttttcttctttagatgggctatctattgatgttgcttcaagtttattgactctttcttttgttatctccattctgttgctaagtccatacagtgattatttgatttcaaatattgtgtttttcagttttagaattccttttgctttttaaaaatagtttctatttccctgctgaagtttctcattgttgcatttgttatgaacatatcttcttttaccttactgagcatagttattatagttgttttaaaattcttgtctattccaacatctgagtcatcacagttggtctctatttattttcttttcctttaaaaaacgggccttaattctccatttcttctttggattgtatcttgaacattgaaaatgttacattatggagactctggaatatgatacattccttttgggaatgttgattttgttttgttttagcaggcaattaacttggtaggattcaaacctcaaactctcactgttaggaatcaggtcaaactcagtttagttcttttatctttagctgggctgctttgagtctatactgagcatgcatggatcaaggatcagccaaagatctgggacttttctctgactctttctgggttttccctctctctccagtggctgtggttttcctgactctgtctctgatgcatcaggccagtagactgcaggttttctttggagttgtagcttccatacgtggtgtcaactgtacctaacagttaggctaaaagctgaaaattgggaaacacatcattcccatcttccaaatttcaattcccctccagaatcttccaggtcttttttcttcctatcccactcttaagtgctttcaggaagttattttctaaatgtagttgtacctacaagaaagttggcatgataggagctcattcaactttttttggaagcataactccccagctttttaagttcctggtaattcagataaattaccccctaccttacacaaatcagcaaagttgatggcttagagagaaaaataaaactaaacacctgcagtcttagtttcctctcttcccctggattaatactggttttttgatgtctctgtttacagcatgccaccctggtttttacgggccagattgtaagcttaggtgcagctgcaacaatggggagatgtgtgatcgcttccaaggatgtctctgctctccaggatggcaggggctccagtgtgagagagaaggtaaagcaaggtaacactgtagtcagggccatgttcagcatgtctgaactgagctttggtagtgtaattcttgtgccggcattctaagatcctcaagcctcttttgtttccatccagaagttgggaatagtttatcctaaatcctaaagcacagcattttaattctgctctactgaccctaatagtaggctttatttgtctttgcactaggcataaaccacgtgctctttgtagcagcttaagtgatgactggccagctgagagctctcctaccttttctgctcccttctctaggaccaaccttttccctggacatgcgtaacagagaaagagcaatttgggatggatttagacaggggatatttttaaagcaatagaaagaataaaacaaatagaaaagattatgctcaaaatgaaattttatgtcattctagttcagaagttactcttcagcaggagtcagcaaactttaacccacagactaaatccagcccactatctttttttaaacagctttatagagatacattttttatattataatgttcaactttttaaaatgtaaattcagtggtttttagtatatttacagagctatgccatcattgccataatctaattttacaacatattcatcataccaaaacaaaccttgtacccattaatagaaacttccattttccaatcatcctaatttctgacaaccatttatttgcagttgaccttaaacaacatgggggctaggggtactgacccttctcgcagtagaaaatctacatataatttttgactctccaaagacttaactactaatagccttctgttgacgagaagccttaccaataacatagtcaattaacacagagactagtatctgtatatattttatgccttcatgacatacctttttcttaatttttttggtatttctaggctacacagtttgtctgtgagttttttcaaattatcctaaatctccaaaaaattttccaatatatttattgaaaaaaatccacatgtcagtggacccatgcagttgaagcctgtattgttcaagggtcaaccatatcttctgtctctgtagattgcctgttcttgacattttatatgctgtaaacaagattgtataatacgtcgtcatttgtgactagcttcatttgccacaccttttttgaggtttatctatgttgtggcatgtatcagtacttcattccttttttatttctcaccatctgttattataaagaaaaaaattttggatcacagccacctccattcatttatagtatgtcgtctgtggctgcttttgtactacaagggcagaaaacatggcttgcaaagctgactgtatttgctctctttacagaaaatgtttgctatccactgtcgtagaatatactttttaaaattaaaagaagcagacatatgtattttcaaacttaataaatatgtattgctttttcaatcatataaatataaatgccattgaaataaatacatatccagtgaaatctacactcacaataatacagctatggcctttttttctgttacttttggaaatcagaacaaatattgggagtgggggtgggatgccagtaagtgttttctcaaagtccttaaactttatattttttcttcttttgccaagcctggactttactacagggcaggaatcagggagtggttagaaagggaaggaaatgccatggggctactaggggattgtattgaacgtgggcagctaacaagtttaaggatttgaattttgtgctttgttccttcccgtctgttcccttctgctgatgctgcaaaaggagtgcattctgatgggagaatctaagacaggttaaccagggtgtcactagggctttcagagagtagctcccttcccagattccactttagcccagcacatccaccttcacccccacccagcttcagaaaatacaaggggacgatgaaggaaagaaatgctttaaaagtgtcaaaacatgtttttcaattcctattcaaatagctacttaggctgaaaaacttggcacgttttccataatctttccaagtttacagatatatcaaggaataaccttgtaagtattagacctctttcccttctcctccacacctttacccatttcattctaggcctgagaagtaggatatcagtataaaatatcattattgaccccgcctcttcccaccaccgataagaaacagtctgtagttactgctgctctgagggcacctctatcgcctacattgtttactgagtgttggacaattttcaaacatgtctcacattcaattacaaatagtccacagttccctgagtccctatggttcagaataaaattggtatatttcagggttattcattctctactgtgtagatgttaggcaagaaatcctgacaccattacctttattgacactacagacatttttccttctttcaatattggcagcaacatttttgatttggctgttgagtggatactgatttggggaagttatatttcacttctttgatgtacttcttttgtgagcaactttattcaccttttcctcttagttatctgctatttgcagacttcccaatgaatgagacatctctcgtatatctaaactgaggtcaatgctgttgaacagcaataccatggggttatttgatgagtggaggaagaactagttttttgtttgttgtatttttgtaatcattcatgtaaaaagaaagagggggattgaacagcaaagtctaggggagatatggccatgataatcattttaatattgagactgttcctccctggtccatgaaaggagcacagcctcatggcaaagagcgtggactctggatttataaagatctgagtctgaatctgggctgtgagcctctgtctcctcatccataaaatgggagaccacaatatcatccacatcacaggtgtcttatgtgatgacaaaacagtaaaatatttgcaaagttcttgcccggtgcatgacttactaaagtagctatttttattattactactgctgctggctctgttaaatattagatttcacagtgctgttttcttccttcaggcatacagaggatgaccccaaagatagtggatttgccagatcatatagaagtaaacagtggtaaatttaatcccatttgcaaagcttctggctggccgctacctactaatgaagaaatgaccctggtgaagccggatgggacagtgctccatgtaagagccattcttaatttgcccttcttaaagcatgagatgcttcagtgtagtaatcaccccactaaatgatagataccattcagtgcttttatcctcctaggctagtgtgttgttggctttgataaaatgccctattcctggagaggcagaactgactcactgcagcctcactgatttcttctgttggccagtactgctctgcatggttgggaatatgcctcctggggaactgacagagctgggtgccaaggatggcacacatcctgcaggactgtccagctggtatggggagaagtacgtgtcaatctgtgcaaagctttgctctcgcagtgtccccatatctctaactactcatatcaggagagtaaggtggtgttgcaacccatgaatcagcagatttacgtgctaccaagtgcaaccaggacatggagttttgatgaccggtccactcctattacgctctttggagcagcagtttaggggagcatagaagaggagagttccccagttctgaaactacaatccacgggatcccttaggtctgaatgcattcattgggtttctacccacctcttccctttgccttcattgctgatgctcacccatggtcaggtaatatcacagcagttattttttgtttaaaaggatcaagctacttttcgaacatgctttccttctctctcccaactataccaaatgcagcagagacaggagccaccccaaatttctcttgtgttgaaagtgatccttaggatattgatgtattttttaatctaaaaatttagaaatacttattatcctatttttctatcaaagatgaccaaaatcagcttgaccagaggcaggtatgagtgaccttctgagggaggaatatgtagaatgtaccattactagggtccacgtttcaatgtccctgattccactcaaacaacccatcaggtagaagaagccaattgatggcttccaaaatcttattggctttttcatgagttaatgaaagtaatggctactatttagtaaggttggccataactatatgtaacttcttacttaacattgcctagtgtctcttttttttggcggaagtgggaactggctgggtgaagttaagtaactaaggaattggtcaaaaatggcaaagaggccagatacggtgactcatgcctgcaatcccagtgctttggaagcctgaggtgggaggatcactttaggccagaaatttgagaccggcctgggcaacatagcaagaccccatctcttaaaaaataaaaaaagaattagctggacatggtggcatatacctgtagtcccagctacttgggtgaggtggggggatcacttaaggccaggagtttgaggctgcagtgaactatgatcactcaactgcactccagcctgagccaaggaacaagactttgttgtctctcaaaaaaaaaaaaatggcagaggtccatctctcttcagaaccctggatttttccagtactccccacttgacagcctctcaaacacttaggaagtcactttgtcctcccacgcagccatctctgtgttagataggaaaggaacaaatcttatgaggaggagtttaaaagaaatcatgcttcaggtgtcttgcttgtaagtgtttaccccgtactcctaaacacacaaatacaacagcaggatctgacagggcatcaatccaaaataaactttcagggctactacaatagctttggaaataagccaataattatattagcattacatttagcttcttgatctctcctaggaaacttcttattaaacaatgagatggggtcaatgttatggacctttgcgtttatgcctccctagaagtttttatttttttgtatttgaccttttcagccaaaagactttaaccatacggatcatttctcagtagccatattcaccatccaccggatcctcccccctgactcaggagtttgggtctgcagtgtgaacacagtggctgggatggtggaaaagcccttcaacatttctgttaaaggtaagttcatttcccagaaaaagggattgtgtccttgatgcattatgtttttgtattgctgcttctagacagaaatgtatgcgaccactaaaatacctttggggtaatttccaggatagtaagcctttaaaaaattatatgcatgaaactagagtgaagaaattaagagtatgaactgtggagtcacacagccccaggtttgattttgtccctaacagctcataatcttgtgggtggccttgaccaaatgaagttacctttttgagtgtctctgtatttgcaaatgaagcataatttaggtacctcttagggttattgtgaagccttgttaaacacatacaatacttggagttgtgtcaggcacaacatatctggtagtgattatatttcacaagaaggttagcattgccgttgtgacttcctgttcattattgtagagaattatttggagaatccctattttgaggattactcacttaataagaagcccaggctatgctatataattaacatgaatgtcttttcacattcagggctgtgggcatttttcctgctataaattagtatttcaaaattcaaattaatctgagtgtttgtgtgtagatttgtggcttgagtggaagaactaaaatggaggtaagtccacgttaacttggctggtgtacgtagctacagcaaggaattttaaatccgcaagttacttaatcacctgtttagacaagaatacctaacagctctctggcatatattctaggaaagatactaggctaagattacttgtaatttctgatacattgtaaatgctctgtaaatagttgctatcctgtattgtttagagaataatgagaagaaaaaaagtctgtacatgttcagacacaatttgttttctgaatatttttgatccacagttggctgatccacagatgtgaacccacagatacaaagggtcaactttatacagtagcacacattgtaagcacaaatcttagtattaaacctggatcttctgactccaaacccagcactatctcttctggaccattttgctttctgagtctcttgtgttacagaggaggagactgtgaggtgaccaaagttgatttgtatttggccccctttcgttacttcattagtaatctcttgggagatctcagaggtaacttctataaatgaaatgctgtaaatactcagaacataatctgttttttaaaggccaataacaacagtagcgtaaatgcaaccccatagatttggattctgtgccctgagaatccatatgaaccacctcagaatcctccttcttattattacttttggttataggaaagagcccaaatctgttttatttggtagaacattcacgtgattaaaataatttcttgcatcttgaatgttcttggaagaaaggaaatgatatgcagacaagaaaaattaccctacttttaagcttctgggaatgtttgctacccatggacatacgtccaaaacaaaccatgtggtgaatacacagaagagtcactgggtctagtttttagtttgtagtgaaagacacggcacacaacatcaatgtgtagaagcttctccagtcctaagtcactgctgtctctttgctgtcacattgactggcagccataaaatgtaaatagccattagggaatttaatcaatttaatcagcatcttttattatagtatttacaaaaacagatactaggctttaacaccagtgtacagattgatacagtcactttggaaaactggcaacttgtactaaacctaaacatttacttagcctgggaaccagcagttccacccctaggtatatgctcaaaagaatggctgtattatgttcaaaaaagacatcttcaagaatgttcagagcagttgtattcatagtagccccaaactgaaattaactcaaatgtccatcaacattagaaaggatacactaatcacaaattgtagtatattcatatgtattagtttgctagggtgccataacaaaatactacaggctgagtggcttaagcaacaggaatttattttctcataattctggaggctacaagtccaagatgaaggcatcagcagagtttatttcttctgcggcttctctccttggcttgtagatggccactgtctccctgtatcttcacagggagattaaattaggacacaggtacagggtcttccctttgtacttgtgtcctaatttaatcctcttacaaggacaccagtcatattggattatggcaaaccctaataaacttattctaaattaattacttctttaaaggccttatgtccagatacggttacatcctgaggtactaggggttaagactttaatgtgtgatttggggggaatacaatttagcccataaaatcatgcagaggaatgttaaacagtaataaaaaagaattaatttccgcaacagtatggatgaatcttgcaaacatgataaccagtgaaagaaagtacatgctttatgattccatttatataaagctaaagaacaggcaatactaatcttcagtcacagaagtcagaatagaggctacctctgggtagaggatattgactggaaaagggcacacaggtgccttctggagggctgggaatattttctatcttaatctgagtggtggttacatgggtgtacacataggtaaagtcccttgagctaaatacacttaagatattcacgctttacaatatgtatgttccatctcagtaaaaatgattaaaaggcaaaaaataaaatagtagattactaagaggaagcctttgtagcaatttttaaacccttgtagaagtatcacagactgacattaatggctgtaataaaatgtgcatctgctggtttaaagaaaggggtggccttattttatcatacaaggaaagcattacttgaacaaatttacttacagcactgccctcctttctagcctaagtgaaatgtgtactcagacttatctaacttaatattggcatgatctgcctccagttaggggatactgcttcttactggctttattatcctgaccttggacaacttcctaagtcgtcacttagtcaatagaatttactttaggcctattatgtttcagcccctgttctaggcactgggaatagagcagtgaataatacagggggaaaaagactcaccatggagcttacattcccacagggagataaacagtgagcaaataaataagtagaatgtacagttcacgaaaatgctgagtgtcttggagaaaattaaagcagaaatgggggtagagaatgctggggcagggctggagtggtgactgtaattttaaatagggtaatcaagccttcctgagaagatatttgagcaaagacttgaaggttatgtctaaggaaggtgagccaaagcattgagacagaaagaaaaggaaaaattactgaacattgcaatgtcctctgaaatctgaaaggttctgcattgtataatacacactcttggggaggaaaaacaaaacgagttatgcatttctaagaaggctgggccaagggaactatagagctcattggaaattcacttcacaaacaataactcagcacctagtcggtgctggtgaacaaactacacagtctttgccctaatggaatttagagtgtagtgtggtgtttcacaacctttttattatcatcccactaaggagctcttttagaaattgtattccagaactctccctcatcaccataagattttattatcacagatgtactttatatctctttatgtactatggctctttggcgggctgcaacccattgtaatatctaaaatttttgcatcctccaagaaccaattttcattgtttctggggcgctgtcatccccattgagaagatgtggtctttgagatggggagattgttctagattatctgagtggacccattccaatcccttgagtcattcaaagtagagaaactttcctgacaatagtcagagatgtggtggtcagagaaggatcagagaggcctgatgttgtagactttgaagggataggaaggagccttgagccaaggaatgcaggcagtctctagaagctagaaagaacaaggaaacagatggtctcctaagcctccagaaaggaacacagccttgctaatgccttaattttagcacagtgagatgcatgtctgacttctgacttctagaactataataaatttgagttgtttggctgaaagagagagatatatatatatagagagagaatgaattatgatctagaagaaagaccaatatcaaataatcaaataatcatactacaaagagtaataacccctaaaaatcaccatgaaggaaaagtagaggttctgtgaaagtatacaataccttaattcagtttctatgatagccacctgtgaaatattcacatcagagctaagaattaactgggagaataatgggaggtggagcattccttgcagaagagagacatccacaatcaatctaaagaaaggaggttcgtgctttgttagttggatgaagtgaaaggtcagtgggactggagggtactaggtgaggggaagaggaggctggagagtgggcaggggcttaatcactcaaggcctggctggtcacgatatgaatttttggttttatcctacatgtgatgagaatccattgaagggtcttgagcaaaggggcacatttattttaaggaagcactttgaggataatgggttggggaagcaaaagcaaagcagagagcttagagagcaggtgatctcactgagtctgagcagaaaactttaagaggactttgttggacatgtaaaacatatcttctacctctacctaagaacaatcacaaaacctcaaagccgaaggactaatctgccttctgaaattgtatttagttcttccaaagcccctgaatgccccaaacgtgattgacactggacataactttgctgtcatcaacatcagctctgagccttactttggggatggaccaatcaaatccaagaagcttctatacaaacccgttaatcactatgaggcttggcaacatattcaaggtaagctttggacaggatagatgccagctggggatgtggcaccaggagaattatttttctccaaatctagaaattcccttctccctgcctcaatcctctacctcaaggtggtggctgttgcagaggattctgtttcagagtattcaagagagagtgcagggggcccctgagctctggggctaactttctgaagtcactgtgcgctctagaacacagaaccagctcacaccatgagttactatctatatcaatatttctttttggatctccagtcctgtttttagttattctatcttggctggtcatggggaaaggcacttgtttatgccatgaatatggtagcaggaaagtccagagcctgctggaagggcagagaggcttaatctgcctaaatcctgggggtgattgttgctgctgtattgagttgtttattccttttctcatttcatgtcttgccctgtcctgcagactcttaacacagagagatttttgaaggaatttgaacctgcaaagtttgggctgtggcagactggaatgggctcgggggaggacaaggacaggcaaagggagctacagacccctcccctaacttcctgaaagaaaaaaataattgaacaaaatgtgacaaaatgccaaaagttcatgaaaacagttgaatttattttgaaacacaaattacaattatatttgttgtatgataatgtaaaatcacaattttaaaaagcaaagagcattatcagtgaccatgctgcttcaattggactattctgtaaaaagacctgccactaacatgcttgtaggcagcatgtcctcctccgcccatacctttgtcttactatgcctatgatttccttaaaatgaccctctattcactatatggagataattaagaaaactatggaaaaaaaaaaagagaagaggaggagggttttgggctgaataacactagctgacctgggtagaccgaataaaatggtattattactgagtccttcacatactattgtagattctatcaaaattcagaattccagggatgtcaggctgatttgctgaattgctgtttccaacatcaatggctaggtcttttgctgtcatatggtggtaataatccatcacctttgtctacaagtggacatccacaaagtggtcttctaagaactgttaaacacatcccagttttttttcttaccaagtaggaatttatcatatgataaggcagaaatttatctttgcagtatccatggagaaacagaggctgactaaagcaaataggtaaggagaaaagagacagataccatttgtttatgggtgctattttcaaggacttcagaatgcttcattgtaatagtatgaccattgcaaatcagttttctggtcattttgagcaaacctcctaagcatctttttctctcgatagcttgattgcaatcagtgtacatacttgaaaacagtagcaattaaattattctaattgagtattcccccaatctggtattccatatagatttgtgaggttttattctacaaatgaaaagacaaaagcaccagagcagaaatgtgtaagtggcacagaaatacacactttaatgtgtacattgtaacctggaaacatttcaaaagcctaattttcctcatattgggaaggatgaggccttgaagatggaattgcctctctgtttcactaagacgtagttttgaaaacctaaaattagttcacatcgcaataacaacaaccccggcttaaggaatgtaagagaatgccaacttaagtttcctggacgttttctcttctcagtgacaaatgagattgttacactcaactatttggaacctcggacagaatatgaactctgtgtgcaactggtccgtcgtggagagggtggggaagggcatcctggacctgtgagacgcttcacaacagcttctatcggtcagtggaagccaacaggcatttattcatgagctgggtgggagggggaggaaggggaaagaggaaggaagaccaggaagggtggtggtgggtgagtgggtgggtggggatggaggtggcaggagttcgcttttgaatgggtgggaaagtgacaggaaggctagcaacttcaagccaaactgttcctttatttgggttggactcctggtctgtctccctgggggaggaggtctgcagcactctgtagggacagagaaggaagcagatgagccttcaggaaggcagggcctcccctaggagctgggatttacacagcagcaactgtgctgagcttcagctcctgcattttatcactggcttcctgtttccatcttaagggcccagaccaggctcttgccacaggcatattttagaagtcccagtttatttattttcaaaaataatttccaatttttcaaagtaattcatggtcagagtcatgacatcaaatagaataagaagcttttatctaaagaacagcattctcctgctccaccctccacctcccagtcctgcttcctataggtagccactttcatctccttaagctatttcttatatttacctcccttttctaaatcagtggttctcaaacctaagtgtccatcagaatcactcagagagtttgttaaaagatgtttctgggcctcgtccccagagtttcggattcaatggttttgaggtgaggatggggccggggttcaaaaatttgcatttctagtaggttcccaagtgatgctgctggtcctgggtccacacgttctagataacatgtgtaaaattacttctggacttctcagtggtgtttggtattgactggccttctattgcgttaattaactctgtgaagcctccttgatgctaacctgacctccagctttctgttacccaggtaccctccattgaaatactggagtgatcttttgtaaggttccattcctggttctttgaattgttcactgtgtataaccattctgttactctctcttggtcagtactttatactttcaacttcatatatatttgatttatatcacctaggaaagtaagaattatcatcttccctattttacagattgaaaagtagagactcagagtacttaataacagtaagatgcatcaccatactaaatcttcgggcttcatatctttgtcttttagagccaggatcttgctctgtcactcaagctggagagtgcagtggtttgatcaacactcattacagcctctatctcctgggctcaagtcatcctcccacctcagcttcctgagtagctgggactacaggcacaccaccacatctggctacttcaaaaaattttttttgtagagacggggtcttgctttgttgcccaggctggtcttaaactcctgcctcaagcagtcccccagccttggcctctcaaagtgttaggattacagggatgagtcaccactcccagtccaggctccatatccttttgtttctccaattattatttctacctagaatcccaaaggcaccagcttattatcccagttcacatatttgcctgtgttttactccatttactaaaagtagaaggatatgttatgattgagtgaaaaaaccaggaagaacatccacttttcttctgcagagattgtgcacccttaacagaaacatccttccttcacaccacccacctagtttttatgttactagcagcatccttaaagaaccaaatgagactcaaaagctactctgagacttatagaagcattacacacaagtaagaaatggctgcttggggacccacctggttgtgaatataaaaaataaacccagaaactatatagagaggaaaaagggacctctacaaccatgacccaagggatccctgatatgtcatcatgttactgctaaaaggcaaatggtagttaattctctctcaagtcactgttggtgagtcaagaggggaagagcataaactgactcagatggaaagtatttatggaacagaacataaaacacttcacagccccacactgtactgtcttcagccctcagaatgtgttgcagccaggaggtctctcagaatatttcaaagtagttctcaggggtaggcgggaaggggattattgaaggttcttcttttcccatcatttgaattttgctgctgtttgcttttcatttcgtctggcagttgcactgtttatgtgtgttgattgagatggtgaaggccagggagtccgggaggggaaggaagagaacactttctgaacatagtgcagaaaggggcagacagggaggcgtatggggtaatcatgttcccaaagggcgggaaaaggggaaatgactatttattgagttactcttctgtaccaggcacaggattaggaggtgtaaatgtattctccaaaatatcaactccccattctcctttgtcattgcaaacctgcctaaaccactctgggtggctattttggaggttaaacttcagaggttaacaagaggagatggcatcacctctctccatttgcaaaggttacagagaaagggccatcagaccttttgcataatgccaagaaaatgcatgcctagctgctggttctcactagtctgagggtagtcagaaccaggctggtgggacttaattcccagtagatggaaacagacccttcctctcacctcgaaccaagagtaagagcagtgtttctcaacctttaaaaaaaaatgtattgctcatccccagtgagctgtttcagatacgtttatcctagtagatcctgcctcccgtgaaattttaataccacagatatgctctatatctgtttctgtattatggtcctctgtaaacaattgtagtaatctgaaattttctcatacactaagaacaaatttttttgccccataggagtgattgtgtccctactgagaatgcatgaattagaggatctctatcctacgttttggaaggacttcatatctggaatttaaaaatcaatttactattattaactgaaaacacactatttcctcctttgtccagtgacataagacatctcgaaagaaggaagggagggaggaaaccagtgttaatagagcccctaacaccttccaagcattttcacatccattttctcacttattactcctgagtctggaagatggatattttaattttattttacaggtgaacttggagagattatgaatttgcccaaggttgcaaaagtaaagtggcatgttcctgtctctctgattttaaaacccatattgtttctattcagtgatgtcttggtagcccaggctcctgtgggtgattatggccaggcatcacgtagtcatagcggataccttgatgtgatcagagcaggaataggcctggccctgccaccacagctgtatgatttctgaaaatcttgctaaggggaaggaacccctaaattgctttacaatgtattgctcaaaatggtaacagaaacggtaaatactctcccataatcccataaccttggcaaatctactgttttgatttttatcagtttccttcctatccttcaccattgtagacataacttttagcatgcctacatgtacttgaagtctctttattgggctttcatacttatcctagttatctatttttccactgaatggctatatcataatttattaaagcagtttcctattttgagtgtttaggtttcttccaattgtttgctgttataaataatgtaatgaatcattttggtagggaaaaaagtatcatatgggccacttgcttgtgtttctttgatagcttatgaggtggtatcttattctagaagccaaggttactcttaaaaggtgccctttagcgctgtcattgactccacccttgtattagtctgtacttgcattgctataaagaaatacctgacactgggtaatttggaagaaaagaggtttggctttttaccaagccaaacagtaaaaacagtaaccattggctcatggttctgcatgccgtataggaagcatctgcttttggggaggcctgagggagcttttactcatggcagaaggcaaagtgggagcaggcactttgcatggtgaaagcaggagcagaagagtgagggggggcggtgctatacactttttttttttttttttttttttactgtttcataatttatttatttttccatggaaattatttaacattttattttctgacaaagctcctgtttattttattttttattttttattatactttaagttttagggtacatgtgcacaacgtgcaggttagttacatatgtatacacgtgccatgttggtgtgctgcacccattaactcgtcatttaactttaggtatatctcctaatgctatccctcccccctcccccggcaattgaacaatgagaacatatggaaacaggaaggggaacatcacacactggggcctgttatatactttcaaatgaccagatttcatcagaactcactcggtatcaggaggacagcaccaagggggatggtactaaaccattcatgggaagtcacactcatcaaccaatcacctcccaccaggccccacctccaacactggggattacatttcagtatgagatttgggtggggacactaatccaaactatatcagccatatataaaaataatgatttttctggattctcctaggactccctcctccaagaggtctaaatctcctgcctaaaagtcagaccactctaaatttgacctggcaaccaatatttccaagctcggaagatgacttttatgttgaagtggagagaaggtctgtgcaaaaaagtgatcagcagaatattaaagttccaggcaacttgacttcggtgctacttaacaacttacatcccagggagcagtacgtggtccgagctagagtcaacaccaaggcccagggggaatggagtgaagatctcactgcttggacccttagtgacagtaagtaattcatgctgctccagcctcatctgagcaataaggggctaccgccatgcagacttagctaacatcactgcaggactattggaaattatgaaagaaagttagttgtgagagaaggctaattagtgccccccacctaatcattttaataacttgcaatatataacatatatttggatttgcaataattcaggcaggtctgtgctaaaatttaccttcccttggtgtgcagttgtttatttagtaaattagtaacaagaagtttttctagggcttgttgaaccatttatggggtagttttgaagaattatcatatatctacatgtacacagatgtcagttaattccagatgggtcttacctaaccataaaaaccaaataactttgcttgaaaccccttgaaaacaggtaattttaaaagttaaaagatttatctaggagtaataaaatcactttttttttccaaagtattttgcatttcaggcttctcaatttcagattggtcatttaaaattaatgggaatttcttgggtttctttgtagtattgaaagtctattcattactaaactaagcagagagttttattttgattcactgaaattagaactgtgtgcatttggaacccttggaaaggtaaactatttcttggccacacacaactaccactgaagtcaggatcatgtggtctatggccttaccaccctgaacacactggatctcattgatcctggaagctaagcagggtcaggcctggatgggagattatgtggtcccttgccacctcccagagtctgaggctgtctttgcagctggttctccacttcctcaggaacaggtgtggaagctggctcagtgtttctttggccactcttttattgcatcagtgacttatgaaagtctgaattgttttgtcagtgtttaggaattcttcatatataatgtttaattctgtgaaatttccaaggtgcagaatcatgctaacagtaacacaacgaacaatcacattcctcccatccagaattaacaactgttaacattttgtcatatttgctttcagcatttgttgttgacttatgtaataacccactacaggtgtatcagtatctcctgcaactgttatccctatctatttctattcccctctcccaagagacaaccaaaattatgagtttgttaagtatattttaatttaatgttgtatgtatatattttttgagacaaggtcttgctctgttgcccaggctggtgagcagtggtgccattatggcttctgcagccttggcttcctgggcccaagcaatcctcccacctcagcctcctgagtagctgggaccacaggcacacgccaccacacctgactttttttaaaaatttttttgtagagatgggatctccctatgttgcccaggctggtctggaactcctgggctcaagcaatcctcccgccttcgcctcccaaagtgctggaattacaggcatgagccactgtgccaagcccaatgttctataattttaatatctctgaaagtatacacatgcatacatatcattcttcattttttgaatggacattatgaattttatcgatccatgtttatttagctttgatgcatgtaattttaacttctgtataatattctatcttatgaatgtatcttgtcattcatcctctcccttttagagggagatgtaggttttttcattttttactatcatgaacaaaatgcaatgcccattcttatgcatgtctccatgtgcatagacaggtgtgagagtttttctaggaacaagtccggtggtggaactcatgggctatttccctctaaagtggttagtcagtgtgtactatgttcaggagtgtatgacagtgccattttccttatacccatctctatgtctatatcctttccctatatcactcgatagtgtcacacctttttactttgcgtatctcaaaagcaaaatatggtgcctcattgttaatttcaattttgatttccttgatagctagcaaaggtgagcatctttttatgttaattgtcctcttttttgatatacttattgatatactggatgtcctcttttttgatatacttattgatatcctttgctcatttggaataggttgtctttcttactgatttgtaaaaattatttgtgtaatctaaatactttgttatgtgtattgcaaatatgttctcctaatccctttattgtaaccttgtttgtggtggcttttaacccacagacacttgacattttgatgcagctggacctgtcagtatttgcctgtgtgatttatactttttgcattttggaattattccctatcccaaggtcataaacatattctctgtgtttttcctagtagttctagtgttgttttgtgtatttaggtctttaagatataaaaatgttattttggggtgcagtatattttaatatttttattttaatcttatttattcacatatggcatgtcagtggtcccaatgccacgtattgagtagtccccatggtgagttgtgatgatttctgtatcatatgccaggttctcatattcattttgcatctatttctggatgttctgttcccttccattgatctgtttgttcctgtaccatttccagcatattaactataaacttgtgaaatgtcagtaactatgggatgaatcactatttcctatttcaaaattatctgaggtgctcactcacctaaactacataagtttcatcctcattagaatgatacactctcaaaatcacactatcattatcatatttataggattaaacaaaaactagttaatagtcactgggagtcgacttgccttggatgattgtatgaagtttgatggagggtcaatgctggtggtggtagtagggatgtgagattggcagggtaggagttgatccctatagggtcaggaaatccgaggaaggaggatgtgaatgagaacatctcatttttacctgaaaatatttgttaatatgctgtgttgtcattgatcatgtatgttcataagtaaaattaatacttccagttataaagtttgtgttggtttccagcctagcaattacatctggtccaggggtaagaagtggagtgaattagatttggcgtatcaccccaatcatatgttaaaaataatatatgtgtgttatgttttcctgttggaaaacatttacatggggagtatttgacccttacaatgactttttgaggaaagtagagtaagaatgattatcacagttaacagatgaggaacctgaggcacagaggagggtaagtgacttgcccaaaattatggaactagtacggcatggggattaggattctaatccacattttagttctatttttccccccaccatgctacaaatgtcttgcacttgtctctttggatgggcgacccactgcttcaaagcaactatgcttctagaggttctttaagtagtgatatcccgtttctaaattgtttaaggtctgattagtgtttcctaaagcattttagaatctattgtagagtcacccagagaacctgctaaaatgtagattgctgggtccagacccgctgaatttaaatcaaaggtttattgagctatccctaagaatgactcctttcaggcataaaatggtaagttggtagatgcaaatttatgatttttagttggcacaaaaattatattcattatttttctaacaagcttctaaaagacactgctgctttttgtgacaggcttagaagaccactggtttatgaagttgaattttttgagccacaactatacaaatattaactatgtgatcatagtaatctgaaaatgttggtatttctattactccttcaatctcatgtgggaagaaaggctattgtatatttttataaaaatatacaaaagacttggtactggatgtaaagaaagttaagacatactgttgattaattgtgatttttggatactgtaccatctgctagacatagaacataacaatcagatttggaaggttctaaatccaatacctaattctcataaattgccacagtcccctaaagagtaacaagggggagtcaacataatgaaaagaagaaatttaaaatagaaaggatgtaccttgagatacttctcaaaggttctaaattgtttataagcagtaactttcatgtggaaaaacaatggtgtatggaatgaaacagcctatgtctactattcgcctactgggacaagtacaaaccccttaaacttttgaagtctcagttttctcatctctaaaatgtggatcataaaaaatctcagtactgtgtggttatacaagtcaagagagtgtctgcatgtggaagcacattgtaaatagcctcataaatgtaaggtacagttactattaaggacaagagctcgaatccattcttttcctggatcaaataggcttagcctttattggatcacgaacttcccttctagcctgtgccctttagagtttgagtgagaatgtagtgatgctgcggtgcctgtcatcttcacatgtggaaaacctcaaggcatctctttctcatcctgcccgtgtccctgaatggaatgtgattccacttttccccaaatccctataatactttgtctactaaaagttattagcacattttctcatgtatacactgacctgcctgctgctccataaattgagggcaaggactgaccacatgacactaagactatggactacagagccagactgccaggagttgaatcttgtttcttctacttaacagtagtgtcaccatggctaagtcacttaatctctccagacctcagcacttacagaaagattgctatgaagaggaagtgagttaatatatacaagagactagatcaatgcctgccatattgtaagcactatataaatgccagccctcagaagctttccattcttcccagcatcaagaatagtaagtacaggtttgtggaataacagaatttctaaggccttcatttagtgtcaagatgacagatagatgatatgtgttgccatttctctgtctgtgccactctttcaagtctgcgtggagtccagtagccactaccaattgattggggtaccatatgagaaaacatttgtttgccttatatgagctgacatgaactctatctcaaaagcataatgatctaggccatggtagtatatcttaagtgaatcttttttctttttaatttctagttcttcctcctcaaccagaaaacatcaagatttccaacattacacactcctcagctgtgatttcttggacaatattggatggctattctatttcttctattactatccgttacaaggttcaaggcaagaatgaagaccagcacgttgatgtgaagataaagaatgccaccatcactcagtatcagctcaagggcctagagcctgaaacagcataccaggtggacatttttgcagagaacaacatagggtcaagcaacccagccttttctcatgaactggtgaccctcccagaatctcaaggttggttgaatggacaagtatttacataggattaccgtgcagccctataggcagctggtttatcaggacaggcctgtgagatgaaagcctatgaaaagtcggtggttgaatggacaggcatttacagagaggtccttaatatcaaaatgcctctgagaaggatccctgttggtccgttttctattattgaaccttagaatagatcagtctatcagcataccccatccagcaatctaagaagaaagctctgaggaatatgaattttaattcctaggagaaagaagaatgtgggagctgcttatagaaggcaagctatgcaagagctccagtaggaggctccaagaaccatgctccattcttcctcaaacactcctttttttagcttggatgacattgtgcaattctgagtcttcttctactttactgatgcaggttattccatgtccaccactaaccccaaccccaggaaaagtatgtgatttgagctagatagagatcctctctggatgccatactgtgcccaccatttgtgattgataaagtctgttgagtgtaattaagtgaacaagggtcccatgtgggtggagctgcagcaggaggattgacttcaagtctgtgcagaggcacctcccggctctctgtgttgtgtacaatgtgtgccagagaatgtagatggaggcacgttagaggcaagttttgaaaatttatgatttggattacagtctgtttttaaagaaaatactataactaaatctgaaaacttcttggttctcttggaggattacctagaccttaagaaacaaaatcaaacaagtcgctttaacagtgctgattctttggaacatttttgaaatgctcaaggaatgaagagtctgccaaatatagaaaatcatggttttcaggtcacactcttagtgaatgccccatttttgtaattacttgtgttttggcgaaatgtaacttcctaaattcaagctatacataaaataccaagagaaaacttttaaaacaagacaaaaccaaaagtttctcaccattctagacatctctgtatctgtacatatatagagatagaagaaaagataaatgagaagagagggatacttttaagaggacgagatcatgttctatgtgctattgctaataaaaatatatcgagtttaattttatttaaataaggaaaagaaatagatttgaccatagtctttaatagtttattttgacctgagccctaaatttaatttttcctctgtcttttcctgtcttcctccctccctctctctcttcttctattgggtatcattaggttttcttcattaactcattaaaacaagacaaacaaaacaaaatacctgatagactgtaagctcttagcatcattgaactttaaagcatttctaggtggggaaattgaggtttagggaggtttagtcactctctcaaagttatacctgtagtaattctccctattattcaacattgttcatttgcttgggattctacttggaaataaaagttgaacaaatgacaactaatgattagcatattgctaattgtaacagcacttttgcatgttttttttttttttaatcttattacaaccctgtgagtcagactcatctccactgagtttggaatataaatgagtagcccgaggtcatatagtggttaggtggcagggttaaggctgctgttaagttcccattacactgtgtcttctcccacatacggtgtgggtctgtttctctatgtaaactaaactacctgcttcacctctgtcttcctgcacagcaccagcggacctcggaggggggaagatgctgcttatagccatccttggctctgctggaatgacctgcctgactgtgctgttggcctttctgatcatattgcaattgaagagggcaaatgtgcaaaggagaatggcccaagccttccaaaacgtggtagtgtctcatcttcctactagctaataagggcaagtccaagtacaggcagaaccttcactttaaagatatggaccaggaaatttacttataaagtaaatatttcccttaggcaagcctcatcttctctttggctttcattatgaaatgggagataaaaagtatgactttttaatttcttatccaaaccagaacaattttgagagtgaaaagggtgctcttagtaaattatgcaggaaactaggtctgcccctgcctgctgaaatgagacatatggtcatcctagtagtaagtccccagagatgatatcttgcaacagaataaattgaacatttttggtaaggaaggacagagggtaaccagacctcagtgagataggtaatgacgtaatatattagacaagttttcctcacatttgcctatttccagttcccatttctttctagtaagtccctcaatcttatcacccctcgtatgtgtaagaattgtatatacctgtgtgtgtcttccattcctgtgtaccctcagtctgaagtcagagttcctggcacttggtactgcctcattttttttttcatctaggaattctaaccagtagcaaaggcctataaaaatcacactttaccaagaggcatcttatttgagttcttttggtatactaaagcctgaaaatgtatctagtttgtgggttcaggccctgtaaaattaatttgaaccagactttatcaattctgtatataatgcattgagtgcaatgattcaaatgaggtgtaccccatgtgcatgagtccccgagtttcccttccacggaggacaagaggaacttcactatctgactccatgccagagctggctcaattcaggctgtcgctggagaagaagggccagcaagggggttgggagtgctgagcctgtcaaaataccggtgctttttcatggtagcaccagcagctatttgaattcaggagaaagagatactgtgttgggtttggctctaagcttcaatcatcttgtggccagagtggacttagagattctaagccttactacgagagagaaagagtgtgcactaaaaatagagtaggatcaagataatgctaagaaagctctcactgaggcgcatcctgtggctgccccacataggctctccaagttagtttccaaaccagaactgaacgcttgctcatttcacaacactgtagggaactcacgtacaactaacgcaaggatggcaaacacatggaatatgtactgttactccttcctccgtcaccctttacagacattgctaatcaacaggcttttctggggaggcccagaattgtgcccgtgcagccctgtgggcagctggtttatcagggcagtcctgtgtgatgaaaacctatttccctttccagtctagaattaaatacagtatttcttttttcatctggtgtggatgccaaccagaagacattatgccccttagaattatgaaaaatcctgacacaaaatgatgaaataattatttttccagagggaagaaccagctgtgcagttcaactcagggactctggccctaaacaggaaggtcaaaaacaacccagatcctacaatttatccagtgcttgactggaatgacatcaaatttcaagatgtgattggggagggcaattttggccaagttcttaaggcgcgcatcaagaaggatgggttacggatggatgctgccatcaaaagaatgaaaggtcagtggttgaccagatagagtcagcattgcgtgagggtgtggagaaaacttgatttcctgctcattctttcctctatggtcttacaaaaaattggcatggtatcagacatagctgttatttgcaactgaaggttatgcttcctttgaagttgagcctgtgatagtcaggatatcaatacaaaggcaggagccatttaaacatcactgtcttgattcattgggatgagatactatagattcttggtcatatatggctaacttttgcggagcatcattgtttctcttaaagcagtgcttctccaaattgagtgtgcatcagaatcacctggaaggcttgtttaaaaacaggctgttgggccctaccccacaatttctgactcagtctagggcagggccagagaatctgcatttttcattagttttccagtgatgctatcttgtgggtttggggaccacattttgcaaaccacagtcttcataggttaactgtatataagttcctggggacactgttagaaatgcattcacttgggtttcttctactccttgactacatctgagtttcttgggtagcatatgaaaatctgtgttcttaagtggctttctcaatggttcctctgtacactcaggtttgcagagaaaaccactgacttaaggtcataagaactaaatcttttccagctttgttcatctcaagactgtttggtacctacccatctaataatatttgataatatcttcagagaaagcagcatgactagttcactggcaaattagctagctgtcttctcttctgcatgaaagagcagtttgtataagacttgactgtgaggctgcactattgattttacaaaatacaggcttggaatgtggtgcattaaagcagagaatatgatgaactattatcattgtgcagctccatcttaagagctctctaaggatgctggcagatttttctttttttttggaccacactattgaatctatgaattacctctaaatcttattaaatcatctctgctttctgcattgttaggaagactaacaaaacaaaatattatctatgattagaaacagcaatatgtttctttaaaaacaatacaaactacttgcaaaacagccacaaatcccttttctgttttgctactttagtcacagggagttttggggagcagtgaggatagtgagaggagaggggtgtagaatcttatgaaggcagtttttattgggatctattgtgagcctgattttctaccttgtgcccatgtgaagagggaaaatagcttaataaggcaccagggcagataaatcctgcaggcaaagcagtgcatccaaagaagggcagttactgaagtggacaacctcactataaagaactttaaaaaaatattcccaagatattgaccctccatgaggcttctgtagtatgaacagagcacttgacttatgagtaccattattccctcatgagatgattgtcacagtttctaagcatgagcagccatgtttatggccaccagcacctcactcctttccttgccacccaatgtgtgtttttttttttaaagcagccatagctcattgtccctgactcaagactgatcagtttatgcaccaaccaatagccttctcttcattctggtgcctgctgtgttctccctctggttaaagtgctagtggagagacaaggcaaaaagaatagaagcagatgcaactcagtttcctgattcccatgcaacttccataagataccatttggatttgatttgtttagctcaatcaaccagattgagactggtttgtaaaaaataagttacagttagtgaacaaagaggcatgcattattggtgatgtttcatggaaactttggttctattcctcagttgtctctggatggtagatttagctggaagagctaaaatctaaaagatgatacagctccacctctaccaagtcatttacctgaggatctgggagcttcaacaagaaaactttagagtagtggttctcatccaggggtgattttgcccatgggggcatttggcaatatctggatacatttttgattggctattggcatctagttagtagaggccaggatggctgcaaaacatcttaccatgcacaggacaggcccctgcaaaggaattatcagcccagtgtcaatagtgccaaggccgagaaactctactttagagtaatctctttggttgtatacagttgatggtgactgagggtagctgaaggttcttagggggcaggacgggacagctgattctgaaaaggtgtaacaaagaagaatcacaacccttgactttcttcccagaatatgcctccaaagatgatcacagggactttgcaggagaactggaagttctttgtaaacttggacaccatccaaacatcatcaatctcttaggagcatgtgaacatcgaggtaagatgctcttttcctgtctttcctgccagagtttttataaaacagacaaattccatatggatataaggaaagataatgatcttaagaatgttgcctattttttttaaagttgcatcttctatctgaatgtctgtctagtcccatttatagactgtgctgtggtttgccttgtttttggagggaggtgccgaggctggactatttagcctctgatgtggttcagccattactgcccaaaggtattcatggctcctacctgccccatccttggccatgcagaggttttctccactaccactactattatagtaggggagcccccaccatcagcttcttaattgcctacctttacatttttcctggaaacccagggaattggtattctgaatgttaaaagccatgaatgccagcaatctagtgtaatatgaaaactaaggatggttggattttaaaaataattataagaagctttcatgcgatagtgctttgtttttatccagaatgctttcatgtacaattacaatggagctttacaactatcctgtgttgcacatgcatttaaagttaaatttatgttattaattcaaatgtttattgagtactttctactgtaatgcatgtaattactggtgagtgagtaggtaacaacaaaaatcctctatgggtttacctctgcatgcagcatggccttgtagttctgaatctctgcttaaacttcacttctcgtggaaaagtttgctcccacaaaaagctccatgcagtaattatttacaaacttgacagcctcttgttgactttgcagcacaaacaccaacaatagaaaagagactacttccatttcctcaatttattaaactaaaaatactggtgcttcaaacaatttatcattctatgatccaataagggtgtaattctgaaagccagatcatgtcccttaggttaaataatgaagtaatgacatttattttttgagctacttcctgaaaacagtaatgagcatggcacaggagtgtaaatgaaagttacacacacacacacataccacacacacacacacaccctgctgtccttgctgatagcactcccacaaacatggtgagtgttcttaaaacccgcctgactttctgtacaaaccctacaaatgacacagtacaaaagggcaaggattctctggatgcccagggaaagtggtgttatgacaggaagccaagtggccgtggtggacagactaaaccagttttctggaaaaaggctaaaactacaaagaagactgtgctgaggctttagtgttgaccccactgcagatctaagagaatgctggctcttaagggatccaggcactttgcactaggaggagataagaagagaaatggccagttgatccagttctaagtttcagcttttgttttattctgaggacaataaaatcttgaggttacgtttacttcatctggttgcagttggtctttagggagagaataaaccatgatattaatgcagcttccttcttgggaaaaaaaaccacaacaacaaaaatatatcccttaaaattttgcttcgtcatcacattagcacatagctggctcttaaaattttaagataggccgggcgtggtggctcacgcctataatcccagcactttgggaggccgaggcaggcagatcacaaggtcaagatgtcgagaccatcctggccaaccaacatggtgaaaccctgtctctactaaaaatacaaaaaattaactgggcctagtggcgcatgcctgtagtcccagctactcgggatgctgaggcaggagaatcgcttgaacctgggaggcggaggttgcagtgagccgagatcgcaccactgcacttcagcccaggcgacagagagagactcagtttaaaaaaaaatatatatatatatgaatatatatgtatgaatatatgtatgtgtatatatatatatgaatatatgtatatatatgaatatatgtgtatatatatgaatatatgtgcatatatatgtatttaaggtaaattacctttatctttattaataaatacatatttaaattattttaaaataattcagtaaagatgtgagaaagcacatgtataccataatttaggtctaactttcattatagtgcaacaggtttcaatattacttttcttttttgctagaatttcaatttcttagaagatctttcaagcttttttttttttttttttttttgagatagatagatagatagatagggtctcactctgttgcccagtctggagtgcagtagcacgatgtcagcccactgcaacctccccatccctgggctcaagcagtcttcccacttcagcctaagtactcccaagtagctgggactacagggatgcaccaccatgcttggctaatttttattttatttttattttttgtagagattaggtctcagtatactgcccaagctggtctcaaactcctgggctcaagcaatccatctgccttggcctcccagagtgccgggattacaagtgtgagccactgcactgggcttcaagttctaattcatacatcattttaaaaacatggtttgcccaaaaaattcttctttaaaaaaaaccagtaaaataactttaactttacatttttagtaggtataaatgtcgatgtttttagcaagtaaattccctttaaaaaaattttcgcaaggggataatttattttttaaaaattccaagaaaacaaaagtaacaaaactgggcaaataacgttttattaaaaaaaaaaagagagagagaaatgatgtggaacaaaaaagtgacaatgaaccataagtttttctaggaactattgttttattttttcctaaaagcttgagttttctggtatcttgaagcaaaatgcaatctttgaaactaacctctggtggccagagacccaatcagcaatatggtgacttaggatgggttttgaggaggagtagaaggcaggagagacaattacctgttgtggctccttccacatggatatttaattgttgaaaaataataacaacctcaggaatagctagaggcagactagaataacatgcctggctcatgttactaagctccttgatcaaaatggaatgcaaatgaaaaggtgacgtgaagaacgtgtctgagatctggaagagcatgctttgactcactctactgttattactgagtgggtaaaagcatttcaggaagccctctgtgtgagtgcaggtttggtaggaatggagagggggtgggaaggagcaaaaccaagcgttgcagcctggccccttttgagtattgcaggagggtgtcacccgtcttcctcctgtcccccagtgctccctgggtggtgttgctagatgtgttttttagacaaaatggagtttataggcaatttccacagcacatctcttaaatgtcatagctgttcagggccactgatgagtcgatgctctcttccttccctccaggctacttgtacctggccattgagtacgcgccccatggaaaccttctggacttccttcgcaagagccgtgtgctggagacggacccagcatttgccattgccaatagcaccgcgtccacactgtcctcccagcagctccttcacttcgctgccgacgtggcccggggcatggactacttgagccaaaaacaggtttgtccggaggacttcgctttggatatctttcctgtggagttccctctaaagtcagtttcaatatgtttgtagggtctgtcaacctctcttctttaactccttcttaaaatctccctcattttaatctctctgtgaatagtccatctatttaaagaaaaattagtactgacaatatgtttatctagcaattttcataattatgaaaattgtataattttcttctatctaatttcatatatgcaaattttataattttcctaatacgtagcgaggtaccttaagctctcttagcctggtttgcctctaaataatgtgtaataacagagacacactacattacagctggaggatttaacaacctgtgttttttatttgttcgttttctgaaattcttctgccaagatgtggtgtgtcatttggcagaatccattaccagggaattttggaggggaactttaagggaactggattgtgactgtttaaaatccttttttatactattgttttctttcctgttccccaaagttttcagccctggggctttcattaggctgaaaatacataatgttttcaaaaatttcagtttatccacagggatctggctgccagaaacattttagttggtgaaaactatgtggcaaaaatagcagattttggattgtcccgaggtcaagaggtgtatgtgaaaaagacaatggtaagtgccagacacagacactgatcgcatcctttccgaggtactcccctgtctcctgatgttgcttctgagactgtcagtgctctgtggtgactgaagcatctgactgtatgtcccagtagatactgtgtgccctgggaaacattctttctaaatgttggttcctaacatgattgcagcatctgcattaattaataatgaagaaggcactgtcatgtgtgaccaagtgattgaatgttcaaacctagtggtttggggtcttggttctatccagtccagaccccaaggcatctcactcaggaacctctgaggagcttgcacaatcccctttcatgcacagctgacacagcaaggaaaaaaattaacatattttccaaaagtcaagaagacaaactaaatggtttctaaatcaccaggaggctctacagagaaattcataacttctacaggctcatctaagatttctctcttcactgaaacctcaatggtcactattcaaacccaaataaaatccactctcccaaacagtaatattttatctttaagtacaagattgcaggagaacctaaccatacagtcttagaggaagagagatactcattctgcttttggtgcccagtctagaatcacatagtcctagaagtaccgcatccctgcatgttacagctgtgtggatgaaatgtcaccatcctctcttttccttgggtgggcagaatgcaggggccttagggatgacaagccctgcagcctttccatgtgtctggcagatctactctggtggatggctctcccttttttaggtctgatgaacattacttggtcccagctttcctgggatggctccagttgtcataagatatagacaatctttttgcttttgtgggcacaccaaattgtctcttagcaaggctcaggttccggcatttattctcaattccaggcttctttttttcccatcatacttattttagttactgagaagataaagtaaaacaatactcaagaacattttgaaaggaaatcacccataattcaccaccttggcatatatatttttttcattttggcttattgcctttcacagcatacatccttttacatagctacaaccacagtgaacgtaatcattttggatctttccactctcctttctgatgagggtgtgaagctgggtccctttggctcttcgagggccctgcatgcttatcaacatcaacactttcagaagccatgtgtgcctccctgagggctggcttccaggtgatgcttttctccctaaccttttcaggcatactcaaagcagatgcttctctggagcaggggtgggcttgttttcttaaagaagcagaatccatcactcacctacctactccagctttcccaactcctccctcaccacctggtgtcctcaaatctccttcctgaaatccttttccctgctttactccagcacttgggggatgtgggtaccctgggtgagaaggtggagggataacacaggataactccacaatctacccattctatttggatgctctcctcagcctcccaagactagcactggtttgcttggcatttcataaagggcagtgatttctgcaatattggggttatttacagggggagagcacctatcaggtctcaactctatcttacaatagactaaacagggtaaaggtgttctttagcaccttggggctggggaggaaagggccaggtttgagggaagggggaagaaagaaggattggagaggagcaagttccctgcaagaaaggtgcagtgtggcaagacactcctagagaacacagtggctaccttctctggcagccaattttaaaatcagattttcaattctcattgtacttcaaagcatctgcattttttaaagatccccagatgattgagtcctatcctgtggatattctgattcaattggtctagggtgagaaccctgcattagggtttttttttttttttttaagttacccagggtgattttaatactggaagtattactgcaaactactatactaagcaatttggggtttcactatcatagattaatatatccatcccgtcatcatggatttgttagtacaatgtttcatgcttgtgctagattttggggtaacataagtcagacacagtctccaccttcaaagagctcgtagacatatgactcaggattgtaacagctgataaatgcaaagagcaaggaaagcatagatgctacgggaacacaaagaaggtgcactgaaccaagctgaaaggaagttaaggagggcttcctggaggaggtcaaatcctgagtttcatagtaaatgttagataggcagtgaggatgtgagaataagttggatgagctggaggacacagtacatacagaacccctagaggaaaaggaaagcatgaaacctttaggagatgtttaagtaattcactatggctgggggtgtattgcagagaggaagggagagttaaacttcagggttggaagaggaagcaaggataaagtcctgaagggccttgaattccagctaaggatttgggatcttggaaccatagggacattaaagaattttaaggaatagaactacatggtcaaatttgccatttagcatgatcatcctgactacagggtagagaacagacaattagggagggagatcagttaggcagagagaccaggagagattgttgtcatcaggtgtggtatgatggtggactgaactgaggtgatacagtagacagaagtgacgagatccaaaagaagtcaaataaaaaaataaatgaaaaagtgcacaaggaacttaacaattaggaggtgtgaggttggaagccagcaggctgggagtgaatgagggcaaaaagaaaacagataacactgtagagagagttagaataacagctgggagatggggtggtgtggacagagagtgaagggaggaggtgtggatgtggaggagaacaataaataggtagatgtgagaaaaaatacttccatacttgaacctaaaagtacaaaattaccatttagaatttatgtttagaaatgtatgcatcagaatattgccactccacaaagaactgggagacaattgcacattcaggaatcgtccttgggatctagggcagggctggtctcataaatgcatgacctaggagaacacctgctctggagagctgagaaaggtccctcaagtgctcctggttttgttccacccactggctaatctaggtggagatgccactgtgaaagtctggacaaatctccgggagggagggatcaacctctcaatgaccaaccctatgattcttgaatgagtagataggaagggagccccaaatcatagagactttgaggaaactaggaataaaactttaaagtcaagctttacaatgtccaggcacatctgattttgcctagcctgggatcagtaaaacaagatatggggagagcctggaggcagtcaggaccaggcatcgaaaggatcagtatgtctccaaacccaacataaactacactagctacaaatcagctcaatctctactgttacacatgcacactgttccccttgtccagagatgctctttcctctcccatctacctaatgacacctaaacatcttatagaaccatgctgggatatcccgtcctctggagaatctccctccatcatctccaggcgtagttgttctcttcaccctaccccagtttcccttttccaccctgcttcccttttccatattattaatacagttaaattctcactcagtgtctatgcctgtctcccctttcaagcctcggagtgcctctgagggctataaggtgaataaggaatgaccgactaccatgcgtgcacactcacacttccattcatataacgctgctggaccccgaaagataaataggacttatactgtttgtttgcatgttttgaaatttgaaaacacatgtagctgggacatacacaaagcaatgatttctgagtctacccagcaatcatttgtggagccacagctcaggcaggctgagagcctcttaaagaccctgtcccagttaagtgaaatctcactttgttctctccagggaaggctcccagtgcgctggatggccatcgagtcactgaattacagtgtgtacacaaccaacagtgatgtgtgagtaaacttcttattgccaagggattttttttccctcccagaaacatatacatttgacagaggttttaaaaagatacaggaatgtcctgtagctctcgggaacaaaggtaactaaaaagctcaggaaataaattagcagaataaagccacagagtagacagtttccagaggagtgcagaatcacttgtggcaggttttgggtttccctctgcatactgaagttgtgtattcctcatgtgcttcaagttgcgaattctcggactcaacaggaagaagggacataccggccttcctgtggctcctctcccagacctagatcagaggaagcaacccagaatagctgctggggacaaaataaggccagacagtggcgggggtcgtctctgcttgcagcctgcagtgatgcatcagaggctggcggtgaaaggaaggattggcttgagatttaggtcatcttgccttgtaccccatttccaggaggaaaaaccaaggccccgagggtggtgacttgtccaaggggttttgctgatgtctgggcatgaggagggggtgggcaattgctgtgtcctcactgtatgcaaggtgctttttatgtttctctgcataattttgaggcagggattattgtccccacttttggaagaatacactaagaggtcccaagaggttcagcaactgtttccaggtcacataagtattgggtggcagagattggatttaactcagatctgtcaagctccacaacaaatttcatctgttttggacagtaccaccttgtagtctctagttaaagtgatttgggggctctggcaaagtgaacactgtttctttgttgtaacccttccattgagctaagaggagagaaacctacactgtgtgcaagggcctatcctaggatgtagacatttaacatctccttttctcagaaagggtgggtctccctggcttttggggccggaaaatgagcggtgactctgtttgctgattgttggtttcacacttgtccctcctgcagatggtcctatggtgtgttactatgggagattgttagcttaggtgagtatctatgtttatctaccaggtgagactctaggcaaagtgagtggaagcctctagcactcccttgctgcataattccacaggatgccgtttgtatgtggttctaccagatgtgacttggaaatagaaacatagtgtattaattcccatatttttctttttaaaagccttatacctaacgtcatatttaacactaatgacctggaggccatgaactttattatatattaattggctccgcttgtacaagttgccaggttaacttctaaaactcttagattatgcagctattaaaagtcacatttttgaaagccatttaatagcatgtgaaaatatgtaataatttcatgtataccctgatcctagttttatcaatattgcatattttaaaaaactggaaggcactacacagaaaggtaataacatttattcttcatgctttttaatgtggtacatatacaccgtggaatactatgcagccacaaaaaagagaggaatgagttcgtgtcctttgcaggaccatggatgaagctagaaaccatcatcctcagtaaactaacacaggaatagaaaaccaaacaccacatgttgtcactcataagtgggggttgaacaatgggaacacatggacacagggaggataacatcacacactagggcctgtcagagggtagggaacaaggggagggagagcattaggacaaatacctaatgtatgtggggcttaaaacctagatgatgggtcgataggtgcagcaaaccacccaccatggcacatgtatctcagaacttaaaatttaaaaaactgttctacaataaaccaacatgcatggcttttgtaattaaaaaactggccataactatcattgataaaatatgagttataaaactatggacttccaatcagaaaaaaaggttaatcttattggtataataaaggttaatcttattggtataatagatgtgctttgtgtggggagacttagaacaggcactaaggaagcctgtggtggttccttcccctgaagcaatgatcatgctttggcatagtctatagtgtaagcccagctttgatgtgcagtgagtttgccaagggaggcatgcaggatgctcaccctctcttgccataccatgtcttcctcctggccccttatatttagaaaccctggacaggaagcattgcttttcatgccagagaggacttagagtggcactgtttgtcttccaggaggcacaccctactgcgggatgacttgtgcagaactctacgagaagctgccccagggctacagactggagaagcccctgaactgtgatgatgaggtgtaagtcaggcctcatcctggggctattttgtcttaccttccccctgtgtgtttctggggccagctgactctagcaaagtcagccggtatacactatacacaaacacctacacacagagatcccaaataggaacccctccccttttattcacctaatactgttatataatacacaagaagtattagctttacaggcatagaaattcaggaggaatttaatgactcttgggaaggttgaaatgaggaagggcaacaaatgcagaaaagctctgaaacaaattctttaaacatacaacactatccttggggataaagatttcaaagctgttcattaagattaattaagaaggatacattttcgggctggcaagatggctgaataggaacagctccagtgtgcaactcccagtgagatcaacgcagaaggcaagtgatttctgcatttccaactgaggtacccggctcatctcatagggactggttagacagtgggtacagcccatggagggtgagctgaagcctcacctgggaagcgcaaggggttggggaactcccttcctagcgaaggagggacggtgccatgacgaatggtgcattccagcccagatactaagcttttcccacagtctttgcaacctgcagaccaggagattccctctggtgcctatgccaacagggccatgggttgcaagcaccaaactgggtggccatttcggcagacaccaagctagctgcaggagtttcttttcataccccagtggcacctggaacaccagcaagtaagaactattcactcccctggaaagggggctgaagccagggagccaagtggtctagctcagtggagcccatcaagctaagatccactggcttgaaattctcgctgcaagcacagcagtatgaagttgacctgggggaggacgctccagcttggtgaggggagaggcatctgccattactgaggcttgagtaggcggttttcccctcacaatgtaaaaaaagtcacagggaagttcgaactgggtggagcccaccgccgctcctcaaagccactatagccagactgcctctctagattctttctatctgggcagggcatctctgaaagaaaggcaacagccacagccaggggcttatagataaaactcccatctccatgggacaaagcacctagtggtaagggtggctgttggtgtagcttcagcagacttaaacgttcctgcctgccagctctgaagagagcagtggatctcccagcacagcacttgagctctgctaagggacagactgcctcctcatgtgggtccctgacccgacccctgtgctccctgactgggagacatctcccagtaggggtcgacaggacatcttatacaggacagctctggctggcatctggcaggtgcccctctgggatgaacccaggcagcaatctttgctgttctgcagcctctgctagtgatatccaggcagacagggtctggagtggacctccagccaactccagcagaccttcagcacaggggcctgactattagaaggaaaagtaacaaacagaaaggaatagtatcaacatcaacaaaaaggacctccacaccaaaacctcatctgaaggtagataaatccacgaagatggagagaaaccagtgcaaaaccgctgaaaattccaaaaaccagaatgcctctcctcctccaaaggatcacaactccttgccagcaagggaacaaaattggacgaatgagtttgacaaactgacagaagtaggcttcagaaggtgggtaataacaaactccttcaagctaaacgagcatgttctaacccaatgcaaggaagctaagaacgttgaaaaaaggttagatgaattgcaactagaataaccagtttagagaagaacgtaaatgacctgatggagctaaaaatcacagcacgaatacttctagaagcatacacaagtatcaatagctgaatggatcaagtggaagaaaggatatcagatactgaagatacacttaaagcatgaagacaagattagagaaaaaataatgaaaaggaatgaacaaagcctccaagaaatacgagactacgtgaaaagaccaaacctgaaagtgatggggagaatggaaccaagttggaaaaccctcttcaggatatcacccaggagaacttccccaacctagcaagacaggccaacattcaaattcacaaaatacagagaccaccccaaagatactccttgagaagagcaaccccaagacacataaatcgttagattcaccaaggttgaaatgaaagaaaaaatgttaagggcagccagagagaaaggtcaggttacccacaaagggaagccaaacagactaacagtagacctctctgtagaaaccctacgagccagaagagagtgggggccagtattcaacattcttaagagaagaattttcaacccagaatttcgtatccaaccaaactaagctacataactgaaggagaaataaatcctttacagacaagcaagtgctgacatattttgtcaccaccaggcataccttacaagagctcctgaaggaagcactcaacatggaaaggaaaacccggtaccagccactgcaagaacataccaaaatctaaagaccatcgacactacaaagaaactgcatcaactaatgggaaaaataaccagctagtgcagcataatgacaggatcaaattcacacattataatattgagacccatctaacgtgcaaagatacacataggctcaaaataaagggacagaggcatatttaccaagcaaatagaaagcaataaaaaaaagcaggggttgcaatcctagtctctgataaaacagactaaaccaacaaagatcaaaggagacaaagaaggacattacataatggtaaagggatcaatgcaccaagaacagctaactaactatcttaaatatatatgcacccaatgcaggagcacccagattcttaaagcaagttcttagagaactgcaaagagacttaaagtctcccactattattgtgaggagtcttaacaccccactatcaatattagacggatcaacgagacagaagattaacaaggatattcaggacttgaattcagctctggaccaagtagacctaatagacatctacagaactctccaccccaaatcaacagaatatacattcttctcagcacctcatcacacttaaagctgaccacataactggaagtaaaacattcctaagcaaatgcgaaaaaacggaaatcataacagtttcttagaccacagtgcaatcaaagtagaactcaggattaagaaactcactgaaaaccacacaactacatggaaactgaacaacctgctcctgaatgactactgggtaaataacgaaatgaaggcagaaataaagatgttctctgaaaccagtgagaacaaagacacaacataccagaatctctgggacacatttaaagcagtgtgtagagggaaatttatagctctaaatgcccacaggagaaagcaggaaagatctaaaattgacaccctaacatcacaattaaaagaactagagaagcaacagcaaacaaatgcaaaaactagcagaaggcaagaaataactaagatcagagcagcattgaaggagacagggacatgaaaaacccttcaaaaaaaatcagtgaatccaggagctagttttttgaaaagataacaaaatagactgctagccagactaatgaagaagagagagaacaatcaaatagatgcaacaaaaatgataaaggggatatcaccactgatcccacagaaatacaaactaccatcagagaatactataaacacctctacgcaaataaactagaacatctagaagaaatggataaattcatggacacatacatcctcctatgtttaaaccaggaagaagtcgaatcccagtcgaagaccagtaacaagttctgaaattgaggcagaattaatagcttacctaccaaaaaaagtccaggaccagacggatccacagctgaattctaccacaggtacaaagaggagctggtaccattccttctgcaactattccaaacaatagaaaaagagggatctttcctaactcattttatgaggtcagcatcatcctgttacccaaacctggcagagacacaacaaaaaagaaaacttcaggccaatatccctgatgaacattgatgcgaaaattctcaataaaatactgggaaacagaatccagcagcacatcaaaaagcttatccaccatgatcaagtctgcttcatccttgggatgcaaggctggttcaacatatgcaaatcaataaacataatccatcatctaaacagaaccaatgaaaaaaaccacatgtatctcaatagatggagaaaagccttcaaggaaattcaacaccccctcaggctaaacacgctcagtaaactaggtattgatggaacgtatctcaaaatattaagagctgtttatgacaaacccacagccagtatcacactgaatggacaaaagctggaagcattccctttgaaaaccggcataagacaaggatgccctctctcgcccctcctgttcaacgtaggattgaaagttctggccagggcagtcaggcaagagaaagaaagaaagggcattcaaataggaagagaggaagtcaaactgtctctgtctgcagatgacatgattgtatttctagaaaaccccattgtctcagcccaaaatctctttaagctgataagcaacttcagcaaagtctcaggatacaaaatcagtgtgcaaaaatcacaagcattcctatacaccaatagcagacaaacagagagccaaaccatgagtgaactctcattcacaactgctacaaagagaataaaatatctaggaatccaacttacaagggatgtgaaggacctcttcaaggagaactacaaaccactgctcaaggaaataagagaggacacaaacaaatggaaaaacattccatgctcatggacaggaagaatcaatattgtgaaaatggccacactgcccagtgttatccccatcaagctaccattgactttcttcacagaattagataaaactgctttaaatttcatatggaaccaaaaaagagcctgcatagccaagacaatcctaagcaaaaagaacaaaactggaggcatcaagctacctgacttcaaactatactacaaggctacaataaccaaaacaggatggtactggtactaaaacagatatatagaccaaaggaacaagacagaggcctcaggaataacaccacacatctacaaccatctcatctttgacaaacctgacaaaaacaagcaatggggaaaggattccctatttaataaatggcgttgggaaaactggctagccatatgcagaaaactgaaattggaccccttccttacaccttataaaaaattaactcgagatggattaaagacaaacgtaaaatctaaaaccataaaaaccctagaagaaaacctgggcaataccattcaggacataggcatgggcaaagacttcatgactaaaacaccaaaagcgatggcaacaaaagccaaaattgacaaatgggatctaattaaactaaagaccttctgcacagcaaaagaaaccaccatcagagtgaacaggcaacctacagaatgggagaaaatttttgcaatctatccttctgacaaagggctaatatccagaatctacaaagcacttcaacaaatttacaagaaaaaaacaaccccatcaaaaagtgggcaaaggatatggacagacacttctcaaaagaagatatttatgcagacaacaaacatgaaaaaagctcatcatcactggtcattagagaaatgcatatcaaaaccacaatgagatgccatttcacaccagttagaatagcaatcattaaaaagtcaggaaatgacagatgctggagaggatgtggagaaataggaatgcttttacactgttggtgggagtgtaaattagctcaaccattgtggaagtcagtgtggcgattcctcagggatctagaattagaaataccatttgacccagccatcccattactgggaatatacccacaggattataaatcattctactataaagacacatgcacacgtatgtttattgcagcactgttcacaatagcaaagacttggaaccaacccaaatgcccatcaatgataaactggataaagaaaacgtggcacatatacaccatggaatactatgcagccataagaaaggatgagttcttgtcctttggacggacatggatgaagctggaaaccaacattctcaggaaactagcacaagaacagaagaccaaacattgcatgttctcactcataagttggagtttaaggatgagaacacatggacacagggaggggaatatcacacgcctatcggggggtgggggctaggggagggatagcattaggagaaatacctaatgtagatgacaggttgatgggtgcagcaaaccaccatggcacttgtatacatatgtaacaaacctgcatgttctccacatgtatcccagaactgaaagtataataataaaaaaataaagatacattttcttgcctagaaccttgcttctgctaagattactttcaaaagtaagatttattccaagggtaagaataatgaactgtagtgataccagcattcccagaactatccgtggtagaagctaactggcatgtttgaagactgcaaggctctaggttgagcagataatttattgtctaaatggagctacttctaagagtgaaggagggtgttaatctcactggagcaagaagcatacataccatcctggaaaaacctggacatagttgaccatcactagacagtccctaaaattccaccttttgagattcacttcataaggggtgagaagattttttagtctttaagaaacttatgttaaagtgtaagctgttctgggatctgtgacaccctaagccaatggttgatagccttccatgcacataaggttccccagagtcatttgttcagcatgtgggctcttggtccccactgtcagtcattgattctgtaagtttagggcaggttccagaattctgcattttaataacagagtagttctgagcacaactgagtaagcactgtcttaggtcagtgtttcccaaactatgttttcacgtgttgtgcaagatataaatacatgatgcaaggggaaaggagttctgcggtcaattactttggaaactttgtgttaaacctgttgtcttagtcatttccggctgctgtaacaacataccataaacatggtggcttataaacaacagagatgtatttctcacagttctgaaggctgggaaatccaagatcaaagcgctagcagatttggtggccatgagccatttcctagctcatagatggccatctttctgctgtgtcctcacgtggcactaggggcaaaagagctctttgaggccttttgtgtaagagcacgaatcccattcatgagggttctaccctcatgacctgatcacctcccaaaggacctaccttcaaacaccatcacatggtttcaacacatgatttttgggtggcatgaacattcagtccatagcacctggttaaacaggcatttttttgtttttaatgacagtgcttctaaaagtcctgcctcttaaagggactttatgtgggtggcattttacaagtttgagcatgggccctttaagagacactaacattttgaaatatgcagcattccaaggcaaatgctgctctagacacatacccagttctttctagatgattgcaatagctgagaccaaggtcctgcagaaacagtaccgagggtaggaactaaatctatgaggagttgaaatgagactggcttagggaggtgggagtcctcatagaaacttcctaggggctgtactttggttaagcttcataaccatgcattgggtggcttcattctctcctctcttttcctgccgtgcctaggactgaagcacagttatagaattaaccctttaattctttgctttcgaaggtatgatctaatgagacaatgctggcgggagaagccttatgagaggccatcatttgcccagatattggtgtccttaaacagaatgttagaggagcgaaaggtaagtattaaagtcaggcaggagatctttaattggaatacctgatgtgcccagggtggttcataaaaaacattgaaataattgaagaagttcttcttggcatggccctaagtattatagaaacaaaggatgtccctccacccccgcgactttgaagaagttacaattttggggggaaataagatttctatacaagatacagtcacgtacacactagaataacatacagaattagcctattagagttggaaggaattttcgtcatatagcctgaccctttaattttatagatgaagaaacagactcagaagtgggtgacttgaccaaggacacacagcaagtagacaacagagcctgacctgcaggttactataatgagggtcaggaactccataaaaatttctagaagtaagttggctgtaccgatctgggagtcaaaataaaagtaaacacagtttaaagaaatagtcatcaaaacccaagtggtaattcaactagagatgcaggtgagatcacacagatgtgaaaatgagattcagacagaggaaggaacccagaagaaggaaccctagggaagctgaacacattaggaggtaccaataagacactgtgagaaaggcaagctcagaaactgaggatacagtatgaaatcttacttgcagaacgcaaggggatgcattttaggaagaaagtcatcaaatacaacagagggactgaggacagaaaagtatcccccaagtgcttagtatatgagttgcaacaaactaagaaaaccaaggtattgctgtaactgccgctggcagaggtggaatcaaagcagcctatgtctctgaaccattttcattcttccagacctacgtgaataccacgctttatgagaagtttacttatgcaggaattgactgttctgctgaagaagcggcctaggacagaacatctgtataccctctgtttccctttcactggcatgggagacccttgacacctgctgagaaaacatgcctctgccaaaggatgtgatatataagtgtacatatgtgctgtacacctgggaccttcaccactgtagatcccatgcatggatctatgtagtatgctctgactctaataggactgtatatactgttttaagaatgggctgaaatcagaatgcctgtttgtggtttcatatgcaataatatatttttttaaaaatgtggacttcataggaaggcgtgagtacaattagtataatgcataactcattgttgtcctagatattttgatatttacctttatgttgaatgctattaaatgttttcctgtgtcaaagtaaaatattgttaataaacctaacaatgaccctgatagtacaggttaagtgagagaactatatgaattctaacaagtcataggttaatatttaagacactgaaaaatctaagtgatataaatcagattcttctctctcaattttatccctcacctgtagcagccagtcccgtttcatttagtcatgtgaccactctgtcttgtgtttccacagcctgcaagtcagtccaggatgctaacatctaaaaatagacttaaatctcattgcttacaagcctaagaatctttagagaagtatacataagtttaggataaaataatgggattttcttttcttttctctggtaatattgacttgtatattttaagaaataacagaaagcctgggtgacatttgggagacatgtgacatttatatattgaattaatatccctacatgtattgcacattgtaaaaagttttagttttgatgagttgtgagtttaccttgtatactgtaggcacactttgcactgatatatcatgagtgaataaatgtcttgcctactcacgtctcat

SEQ ID NO: 14 - DNA, 228047 bp, Homo sapiens
  source 1..228047: mol_type = genomic DNA
gagggcggggccggaggtttcgattagttgtctctgccgctggggaaggtaaagcggcgacggcgtcctcaggagctgtggggtcccctgctagaagtgggggactcggcggggtgagtagtcgcgccgccacccgcccgccaagccttcttacccttacatcggccccgcgtccacccagcttctcctgagagtggagacccacccagtccccccgggcggacaagagaaggggcgggggcgccggttcccccggaacggggcgacgcggtgaggacgtcccagcccggagtagcccctcctcagcgctcccctgcgcctctggaagggcttcccccgaggggctggggctgtcttttggggtgtggggaggcgaaagggtgtgaaagaggggcggcgggtcgagcccgccccgcggggttcccctcagcggcgggtctgcggcgtccccgccccgccgctcccgcggcacgagctccccggggcttgcggcgaggtaagccccttcccgccggcgccgaggaggggcctgcgcgccccagccccctgcccgagttcggagggagcccgagactcgccaggggccgtcagtcgcggcccgggcccttctgaccttggctgcccgcgagggtgggctagcgaccgggcgccggccccgcggctccgcaacctcccccggacaagtttcaggcgatgctgtgaagttcacgactggcatagtgcggggaagaagaatggccccttctcagaccttcataccttttggaccctcatagaaatcggattctgggatttggaaccgtctcccagaacgaacaggtcctccttgcattgacacgttttgtgcccacgttggggaaaaaaataacctgaacatatttcagtgtaaaggcagatcttccttgagggttttgtttttcgcttcatttgagtgttaaagaacagatgcctgaataagaaaagcctgaccttagtatctctacagtgagattagacgggtgctgtgatatttaagtagttgcagatcagtattctgttagcacaatctattttaattggctggaatttaagctgattttagaaagtattgttgacaccgaatgatttctttctgtgcatctgaattaggtttgtttgaacgtaatggttatatagttaatgtaaaagattacacaaattaatttgtctgagagcgtttgtcagaaacaggagacagagatgtgtatagaacaggattatcgttttaggtaacatctgctggaacatttccagcttgtttctttcttgctgtagggttacaaaaaagacatcttcaccgaggctattcggaattacatgtgagtgacacttagatgtaaatttgtttttatttccttcaagtgttttaaaatgttttgttcacaaaatgtgaagaggctatatttacttgttcctgtatgttagtgttgaaggtgatagtatgatcttatgattaacaatccaattagggtccattaataatagatttttaaaaaaggcgtgctgcttttcgagaatatgataggttgagtacctagcaagacttctaatttctttttattaaaagtactattttaggattgagaatttttggcgttgacactgaaaccaggaataaggaagcctgcagcagtcttagcagtttgacaccaccagtaggtgtttctgttgacaaatgcagagaagagaacatttgggaaggaaatctttttttcggggcgggggttgggggggaggtgagggtggttgaggggggaaggagccagaagagagaagctaatgctgccagcactgtatgctgagcatttcacaagtacaaggaaacctaattagggaaaaattccgtttggctctattaaataatagaactacaaaagaggcatactaaataaagttaaccattccaagagtgttagatattatctgccatttcagagtagttgggggttcctcaattggagagggtatcaaatctctttgaattgtcttgcctttttaacatagtcaatgcagcgattaatttgctagatgtatatatatcaaacagttgagtattccagttttgttgtttagcatatttcctaagcctaaattttttaaaatcaaaatccgatatattttttttaaatttgaaatagaattctttgtccagagagtaattccttttttcctggctcagtcttaaaatttattcatgatttaggggtttgtgattggtatttttttacccctttttctcaggtttttgatttttacttatgcaagttccctaagtctgcctttgtttatattgtaattttcttggaattatttaaatcagagtgtggcatctattgtgtcccctggggttttaaaaggaaaggctcccattgaaagaaattgcagggccgtctcgcatagatgggtaatagaaggttgactgattgcgaatcagatgtattcggttgcaaatatgctgcttggggttaaggcagtttcagttaacgggaaccagattttacgtggtgtttctactttgaaggtacagtattgttacattacaaactgaaagacagaggtggagaaattcctttaagtatcacccctagccttgtttcaccactgtgtccaggaatctatgagagactgttaacaatagctgcattgttggaaatgacagtggcttctcttgcagaaagttaacctttcattatgattttcatttcagtttactttgtaaaagaaaatttagctttatctgagaaattggctgtaagaaatttgcaaagagagcaaggaaaataggttttcttcaacgtgtctgttaaaattcacattctctccccttccgttttgataactggtggtgatctttatttcctctagatattaggtatgctaacacagtacctgatttttggcagttactgtgggaatatgacttttttatgtaataaattgatgtcaaataataatatgaggcttttaggaataattaattcacatgcatagatctaaaacatgagggaaatcttttagatgacccttcactttggtacaagaatagcacaatttgaagtattaagttgctttctaagtagaaaaagctatttactcagaattgggtaattttagattttaaagttttttttttttttttgcaacatcaaataatttggcaacatcaaatttcttgttaaaggaggcgacagaatctcacagattctttatcatctgatcatggcatcagttggactacatttcaacttaggacaataatgcaattaaaagactacatttaaactttctgtttggaggtttttctaatttgctttcaatctcaagcccaatgttagaaatcttttgttggtgacgcacaattttagtgttcagattttaggttttgatcgtttttagaatttttttttatgtgtgtagagcagcgcatggatgactgaattaatcaaagatctggcctcatttctcattcaagtttgtacatttcttcacactgagatacgagcttgggtgcaattctgttggtgggcgtgaaagctgagggtaaggaccttctacctagagactgataacatttaaatatttcagatttgggaattaatagaaagttatttattaggttaaaaggaactagcccattcaggtatttgaaaatgattgtcaatactttgaattaagctcttagaaacattggggtttgagacaatcctaatcagggtcaggttttgggtgtggtctctcttttgggcagtcttctctgtaataattataatactccatctattgagccttactgcatgccagacactgtgacacgtaatttatttgcatgaatacatgtgtgttctcacaacagctctatgaagtaggtcttcttacctcctgtatacatgtcaaatgggctcagagaaataaagtactttgctcagattacccagctagtcatcagaaacagcaaaattgccatccaaactggtctgacttgaagccgtgctcttcaaaaccatgctttctgcttctctttaggaaactgatttcccaagcatatttatttttgacaccgggtctcactctgttgcccaggctgaagtgcagtggtgtgatcacagcttgctgcacccttaacttggcagactcagtggatcctcccatctcagcctcctagtagctggagactacaggcacgtgctcccataccaggccaatttttctttatttttaatagaggcggggtctcatgatgttgctcaggctggtcttgaactcctggcgtcaagcgatcctcctgctttggcctcccaaagtgcttggactacaggcatgagccaccgccaggcccaccccaagggtattttgagttcctactgtatattatgcctcgggtgtactgaaggtatatgtatgcttcttggagttcatgggctacattggcaaggctgctggacctttagtcacatgggggactgaactcagatccatcaggactgctagataggacaattggaagtgcagacttttctaaccagagggtcagacttttctaacagaggttctgtttcttcataaatgaaggctgtacataatcatgccaaaaatgaggtagttgtttctaattagctacttggtatttcatgtttctggatattgcattataacttttgatggactttgattacatttgctacactaataaaggcttcgaagatactccttgaattcaattttgtggcttagatatacccttgaagtaaaatggcagccattataatttgcagatgggcacctcttgtgtaattatgaccagtgaaataaaatctggaggtaaagtctatagagatatattattgtgtgtgcgtgtttttttgagatggagtctcgctctgttgcctaggctggagtgcaatggcgtgatctcggctcactgcaacctccgtctcctgggttcaaacgattctcctgcctcaacctcccaagtagctgggattacaggtgcatgccaccatgcccagctaatttttttgtattttagtagagacggagtttcaccgtgttgcccaggctggtctcgaactcctgagctcagacagtccccccgcttcagcctcccaaagtgctaggattacaggcatgagccactgcgcccaccgcttgttgtgtgctaatacagaggttggactctgaaaatttttctacatgaaagtagaactttctgctatttaaagcttcttgtgattaaaacaaattttctttacatttttaattttttttttcttttttttttgagatgagtcccccactctgttgcccaggctggagtgcagtgatgggatctcggctcgccgcaacctccgccccccaggttcaagtgattctcttgccttagcctcctgagtagctggaattacaggcgcctgccaccacgcctggctaatttttttgcatttttagtagagacggggtttcaccatgttggccaagtggtctcgaactcctgacctcaggtgatcttcctgcctcggcctcccaaagtgttgggactacaggcatgagccaccgcacctggcggtgatttttttttaaaacaagacccatcattaagagaactaaacagttatgtgccctaaggaacacttagaagtccatgttaggaaaaaagaaaacttaacatctttttctgtaatcgattaaaatcacttttgttacctatttaagttagaaagtgctgatgaatactgtagagcctcagggccagaaatatcttggccaaagcaggaccatatttctacacaggtgggacctgtgtgttaattttgttgatttcttttcttttttttttttttttgagacggagtctcgctctgttgctcaggctggagtgcagtggcgcggtctcggctcactgcaagctctgcctcccgggttcacgccattctcctacctcagcctctggagtagctgggactacaggcgcccgccaccatgcctagctaatttttttttttgtatttttagtagagacgggtttcaccatgttagccaggatggtctcgatctcctgacctcgtgatctgcccacctcggcctcccaaagagctgggattacaaaattttgttgatttctttataacgtaatggaggtgtactttacataccataaaactcacctttttagtgtatgattcaattatttttaagttaatttatggagttggtgtgactatcattacaatccagttttagaacatttccatcaccccccaaaattctctcctgtcaatgagttttttttaaccttatttacttgcttcacctagacctctcctttttttgagacagggtctcactctgttgcctaggctggagtgcagtggtgtgatctcacctcactgcaacctccacctcccaggctcgagcgatcctcccacctcagcctcttgagtagctggaactacaggcacatgccactgcacctggctaatttctttctttctttctttctttctttttttttttttttttgagatggaggctcgctctgtcacccaggctggagtgcagtggtgtgatcttggctcactgcaacctctgcctcctgggttcaagcgattctcctgcctcagcctcctgagtagctgggattacaggcatgtccaccatgcccggctaatttttgtgtttttaatagagacagggtttcaccatgttggccaggctggtcttgaacccctgacatcaggtgatctgcctgcctcagcctcccaaagtactaggattataggcatgagccatcatgcctggcccacctggctaatttttgtattattagtagagacaggatttcaccatgttggctaggctggtctcgatctcctgggctcaagcaatctgcccgcttcggcctcctaaagtgctaggattacaggtgtaagctaccgtgcctggccaacctagatctttttgtcatcagatactgacaaatgaaatcatgtagatcttaaaagatgtctttttttttttttttttttgagaccggatctcaactctgtcactcaggctagagtgcagtggtgtgatcacggctcactgcagtctccacctccccaggctcaagtgatcctcccacctcagcctcctgagtagctgggactacaggtgcaggctgccatgcctggctaatttttttgtattttgtagagatgggttctcacagttttgctcaggctggtcttgaactcctgagttccctactttggccattcccctactttggcctcccaaagtactgggattacaggcatgaaccactgtgcctggtctaaaagatgtccttaaaaaatatcttctggagaccaggcgtgggtggctcacgcctgtaatcccagcactttggcaggccgaggcgggcggatcatttgaggtcaggagtttgagaccagcctggccaacatggtgaaaccccatctctacaaaaaatacaaaaatcagctgagtgcagtggtgtgcacctgtaggcccaacctcctgggaggctgaggtgggaagatggcttgagcttgggaggcagaggttgcagtgagccaagatcgtatcactgcactccagcctgggcaacaggagtgaaaccctgtctcaaaaaaaaaaaagaaaagaaaagaaaaaaaatacacttctcggccgggcctggtggctcacgcctgtaatccctagcactttgggaggccgaggcaggcggatcacctgaggtcgggagttcgagaccagcctgaccaacatggagaagccatctctactaaaaatacaaaattagccgggcctggtggcgcatgcctataatcccagctactcgggagcctgaggcagaagaattgcttaaaccggggaggtggaggttgcggtgagccgagattgcatcattggactccagcctgagcaacaagagcgagactccgtttaaataaaaaaaaaaattttcacacacagtatcatttcataatgctttttgtattttcaaaagttcttgcctatgcataatacatagcggaatttaaaggatcataactgcaaatgatataaattaccttgtgtttgtggcttaaattttattttcatttgatcttttttaaaccagcaaataaaatacaacattcttggtgatatgttgggaatgcagggaaaataaatgaaggtaaaagtaatgtaattattgtgcaagaaaaagttactttcaaatgtaagagcacagggaaacaattggttttcttgattttaagctaatgacattgtgcattttgttgtttggacctctaatcccccttgacagatccatgcctaatgcgcgtgtcgtagagcaggcttcatcaaatttaggtatttagacactgtgtctacttcagactggattgtgatgggatttgcaaacagcttaacatgcaaggtactgtaactgccttttcctgcctgcatcattttcttcttagttaccttctagggtgggctgaggagtaaggccagcttaggaacgggaagtctcatcagcacaggctgatccccacttgtgcaggtttcctcctttgctcagtgtattgcttgggtagacggacactgcttagggatgttatttttttgggtacatataggagaggaatgtaatggtttggttagaagtaaagtgttttggaaaatgtatctaattttctttgcttttagatgaacatttctctatggaaagtgacccttatatgtaccaggcaggtaaatcaataactccttgtgtggttggttgtgtctggatttttaatggcaaacaggttagacacacggcactggtctgatattaatattttactgtcagttcaatcgtaactggtttgaaataggcataggtaacatgaagtgccagtgtaacttgattttgatagtaagaacaactttggtttctggaaattaacaaaacatatataaataatatatattgtttaaaaggattatgttattttaggtaagttgcaattttagatatcagttttaaactgtgtattttgtattatgggccaggcatggtggctcatgcctgtaatcccagcactttgggaggccaaggtgggcggatcccttgaggtcaggagttcgagaccagcctggacaacaaggtgaaaccctctctctacaaaaaatacaaaaattagctgagtgtggtggcacgcacctgtaatcccagctactcaggaggctgagtcgggagagtcccatgaacctgggaggcaggggttgcagtgagccaaggtcgcaccactgtactccagcctgggccacagagtgagactctatctcaaaaaggaagaaaaagattttgtattatgtttaaagattaggttcttggaagtatgagattgtattttgataattaaagtaaacatatacagtctcatgaggaagatatgacagataaaaaaaggtggtgagtaatagttgaagaacaacttactgacccggatttacctgattaccctgacattgctgattttagaaactaatttcctgatgagtagaatctttcaaagattaccagaggctgggtcagatgtgacatatcctagaatttatccacaccctcagacacacaccccaccaaggtttgtcagccgcttatgggatatattaactttaattgctagtaattattattcctaatattaccactaaattcaagtttagcaatgcaaatgaaaagaaaaaatttgattttaattgtacttactgaaaatagttggggtagacaaaagctaattttgtgcaaataattattttatactttatcaattatttatttctcaaataacctgtcctacatcctgaggatctgtccttcattcatttaacaaatattacttaatgattctgtattgtgtgccagactttgctggagactacatggagtgataaaatgtaagtaggccctgccctcaaaaaattaattaattaatttttgagacagaatctcactctgtctcccaggctggagtgcagtggtgcgatcttggctcactgccacctccgcctcttgggttcaagcgatttttgtgcttcagcctcccaagtagctgggactacaggtgcgtgcctccacacctggctaatttttgtattttcagtagagacggggtttcactatgttggccaggctgatttcgaactcctgacctcaagagatccacccaccttggcctcccaaagtgccatgattacaggtgtgagccggccaaagaatttagtcttgagatggaggcagaggagaactgcagaacactatgggagtgtacttgacccttgaacaaggtaggggttagggtgctgaccctcacgcagtcaaaaatccaagtataacttttgacccccccaaaaacttaactactaaaatggcctactgttgactggaagccttattggtaatataaatagtcaattaacacattgttttgtatgttatatgtattatgtagtatattcctacagtaaagtaagccagagaagaaaatgttattaaaatcataggaagagaaaagatacttactattcattaagaggaagtggatcattataaatgtgctcatcgtcttcacattgagtaggctgaggaggaagagggaggggttgtcttgctgtctcagcaggggcagaggtggaagaggtagagaaggtggaaggggaggcaggagagggaggcacactcagtgtaatttatattgaaaaaaaatctgggtataagtagatccatgcagttcaaacctgtgttgttcaagggtcaactgtatgtaacagggtagggttggagagtctgtccttgggggaagaggtgggaaggtcgctctgaggaagtaacatttaagtgagacccgaagaatgagaaggacctggtctagttggggaaataagttttccagacagaaggtgcaaatgtgatgaggcaaggtgagagagctggggtttttgcacaacagaaccttttaaagaactgaaagagggctgggcatggtggctcacacctgtaatcccagcactttgggaggctgaggcaggcagatcacttgagcccaggagtttgagaccagcctgggcaacatggcaaaaccccatttctacaaaaatgcaaaattagccaagtgtggtggtatgtgcctgtagtcccagctactcccagagagtaagctgggaggattgcttgagcccaggagctggaggctgcagtgagccgtgattatgccactgcactccagcctgggtgacagcgagactcttgactcaaaaaaaaaaaaaaaaaaaaaaaaagaactgaaagaaatctaaaacgaccagaaaatagagaaacaggcattgaagcacaagttggcagcaggggccaggtcttgaaaaggtttagtaggccattttgctgggtttttgaacttgtcctaaatctcctgggaaacggttgaagattttaaggaggggtgtgacatgaaatgaaatgctacaaaacccaagaattttagttcaatggaaccttggtaatttaccagaaaggtcataatctctgcaaagtaaaatattcttcccttgtttcattaaaatttttgtaactcctttcttgattgattgtcgtctgcggtactcctttcattgtttttgtagaaattccctttaattttctaaaggtaccttttcttttatccctcactgttctgttaaccttatataggaatgtcatttctatttataactgaattagaatattttttctaacagctttagctctcttccatatttaaacttaaaattctttgctgtttttttccctccagacacctttaatctgctcgaagtatttaatgttttaacgaaatgtttcattaagtttgctttattcttttgttcttccaaatacagtgtcttagatctagtttaatatttctcagcatttatgctatttcatgttttatgaaatcacatgtgagcacccagaatgtttttagaaaattttgttactattgtataggagcactactcttcatcaggagcaccattttcaaatctggttcacattctgtggccttatcttttacattaaattggtctctgttaaacattttatgttcaggtgggcttatgtatatataagtgctataaaggtgttattttttatatcctgatttgtttctttctccgacaataaatgcccctacatgctgaattctttttaggaaatctttgccatactaagtttgtgattgccttggtgattgtgtgagcattcattcaagtctttcttggtgtaaagttgttagctcatgcctgtaaagaatacttttgcccactgttcctctccacatatacgaagaataactgcagcatcacctctttcaaatagttccttggaaatctacatagtgattcaggcttgaattgagttcgcttttgccatgagttattttctttcttttctttttttttgagacggagtcttgttctcttgcccatgctggagtgcagtggcgcaatctcggctcactgcaacctccgcctcccgagttcaagcgattctcctgcctcagcctcccgagtagctgggattacaggcatgtgcccccacgcccggctaagttttgtatttttagtaaagacggggtttcaccatgttggccaggctggtctcaaactcctgacctcatgatctgcctgccttggcctcccacagtgctgggattgcaggcttgagccaccatgcctggcctgaagaggtacactcaacaggcacttaaggggactgggaaaggaaatgactcttgagtgcttgtgaagagtcttaaaggaagtccagaatgtcaggtgcaggtaaagggtttacaggcagagggtgcattaaaagacaaggatctggctggccgcggtggctcatgcctgtaattccagcactttgggaggccgaggcaggtggatcacgaggtcaggagttcaagaccagcctggccaacatggtgaaacccccgtctctactaaaaatacaaaaattagccgggcgtggtggtgtgtgtctgtagtcccagctactcaggaggctgaggcagtagaatctcttgaaccctggaggcggaggttgcagtgagccaagattgcaccactgccctccagcctgggcgacagagcgaacctccgtctcaaaaaaaaaaaaaaaaaaaagacaaggatctaaggatgggcatataaagctgggagaattgcaagaagtaatgtttatttatgtattacatgctttgctttgatgcttgtaccctagctatatcccaggatcttttctactgtaagctccgtggaggcaaggagtgttgactgttgtaccctcagtatgtggcacattgccttgcacataggaagtgctcaataaacacttcccttatcaaaggtgcccctttttgcccccccccccgccccccaccatttcctcatgtctgtatcttcttccttgtgcagtggtatatcaggtgcctatccagtggatcctcctctctgcttaccctatagttatgcctgtcctgtgtctagttacctgtgtaagatatgtaattgttataattggatccacactggtaaatgagtaggtgctaatagctctctgtggggctccagaatcttttctaccaacatttatggtatggcagatgaaggggaagccaaaggtgacaactaccagagtgacatatctgagctttttttcatgatttattgcatgaattcattgaaatgctgagttctattccataataggtgtgtgtgtgtgtgtgtgtgtgtgtgtatgtgtatctacattgtacaatacaggcatactttggagatagttttggttttagaccaccaccataaagcaaatattgccataaagcaagtcacacaaattttgtggttactgagtgcatataaaagctttgttggctgggcgtggtggctcacgctatatcccagcactttgggaggccaaggcaggcagatcaccagaggttgggagttcgagatcagcctggctaacatggtgaaaccccatctctactaaatatacaaaattagctgggtgtggtggctcccacctgtaatcccagctactcgggtggctgaggcaggagaatcgcttgaagccaggaggtggaggttgcagtgagctgggattgcatcactgcactccagtctgggcgacagagtgagatttggtctccaaaaaaaaaaaaaaaagctttgtttatactatactgtagtctattaagtgtgcaataacattatgtctaaaaaaaaaaagcacatactttaattaaaaataatttattgccaaaaaatgctagcaataatttgacccttcagtgacccataacctttttgctggtggtgggttttgccttagtattgatggtgactgactgatcaggatggtggttgctgaaggttgggggatctgtggcagtttcttaaaataggacagcaatgaagtttgccatatctgttgactgttcctttcattgtaggttcttctgtagcatacgatgctgtttgatagcgttttacccacattagaactatttctccaagcctgctgctgctttatcaactaagtttatagagtagtgtatttttgaaatagtcatttcaaaaatgtttaaggcatctttaccagtagatttcatctcagaaaaacagttcctttgttcttccataagcagcaactcctttgtccattcatgttttatcatgagatcacagcaattcagtcatatcttcaggctcctcttgccttggcctcccaaagtggtaggattgtaggtgtgaaccactgcacctggccatatcatttttttgtgtgtgttttgggtttttttagacggagttttgctcttgttgcccagactgtagcacaatggcactatcttggctcactgcaacctctgcctcccgggttcaagcaattctcctgcctcagcctcccaagtagctgagattacaggcatgtgccaccacacctaggtaattttgtatttttagtagagacggcgtttcactgtgttggtcaggctggtctcgaactcctgacctcaggtgatccacccacttcagcctccatataatctttgtgtctttaaatgggtatgtctttccttctgctaggccgttagtgctggtatttgagttaatctagttaggaattggtgtagccaagtccaaggttgtactactcaccaaatgacagccaataagttaagagacaaggtgttggcgcaaagaaagcaaccttatttggagagccagcaacctgagaagatggtggactagtaatgtccgaaagaaccatcttaatatgaattttcgcctccttttatgttagaggaagagggaagagggaggaggttgaggtcaagagatgactatgatgaccacagacatctaggtggcagtgagggtctgtggaggttgtgaaacttctttgtccttggtcaggtcacaatactataaatctttaacatggctgggcatggtggctcactcctgtaatcctagcactttgggaagccgagtcaggcagataacttgagtctaggagttcaagaccagcctgggcaacatggtgaaacaccgtctctatcaaaaatacaaaaattagctgggtgtggtggcacacacctgtagtcccgctactcaggaggctgaggtgggaggatcacctgagcccaggaggtcgaggctgcagtgagccatgattgcaccactgcactctagcctgggtgacagagtgagaccctgtctcaaaaaaaaaaatcattaacaacgttgttacttgtgtgtacactgcccctatctcttcaggggttttcagaagggactatttgctttaaactataaactgaatttctcccatagttagatggtttcactgggtggtggtgggggggcttagaagcaaaatgatgttagtcatgctaggcttccttttcactgttacattgggctggatttgagtttttttgtgttgttatggttaacctagtgtaccccagttttcaaattctcttagagatactttgtgatcagggtgggaattggtttaccagaacagtgtctgttccagtctaaatttcaggtctccccttcgaagtgtgctttagtgagggtctctttacatactcttgattttctcccgtccctttctcagtgatattctgctcttactgttcctggaagtttgtttgcttggaggtggggaggggtgataggatgtggtctctgttcttgattaagcctcagtttcaggcctgactctcaggatcttgccccttccctggctgttgtattgggctcaatgtggaatcctacccctctcccaggacttgggcccccacccctcctccctgctgctctgatttttcactattgtcttaagggtagaagtaaccattgtcctttctgtcacagtgaaggcttgtcttcctgagtggagataggggagagtgatctgagggtagtgtccagcctctcaggcttagctgctgcccacccccaggtttgcatcacaatgagcctacctcaggactctttagagctctgagtgagtggggtgggggagttggaggaggaagaccctacaggaagttgaggtatcatatcctcaatttctgtgacccccagtggtttcacactatcttttcagcaagccacattggatttcacgcatttactgactcttctacccgttctttttggtgtccagctgtactctccaacaggcgagcacatggtcgtctcctctctcccttcaggtactctccttagtttttgagccaactggttgctctgttggtttttttgttttgttttgttttgttttgttttgttttgttttgttttgaggcggagtttcgctctttcgcccaggctgaagtgctgtggcgcgatctcggctcactgcaagctccgcctcccgggttcacgccattctcctgcctcagcctcccgagtagctgggactacaggtgcccgcctccacgcccggctactttttttgtatttttggtagagacggggtttcaccatgttagccaggatgatctcaatctcttgacctcgtgatccgcccgcctcggcctcccaaagtgctgggattacaggtgtgagccaccgcgcctagcgctctgttgggtttaaagaaagtcttgaatttgaaattagttcagctctttttcattgtagttctcttattccagggtttaagccagaaatttggttactcttaaaattttaacatgagcgtttccttaagtctaagcttaattattattcctgtcctcctgaataagaccaagagtttggaatgatttactccttaaccgtcagcccctcttccatgttaatgttatttatgtgttagttttgccttatttaagccaccttacaccaataaaaatagtgaatatttactcatgtgcttttcaggtttctttgctcaccattcttccttcactccatttcttccttcttggttcagtttcttccttctttattaaaaaatgttcttaattatttcagtaagggccccttaatagtaaatttggttttggtgtttgtgaaagtgtctgtacttcactttttcccttgaatggttgttgagctgggtccagaattttgggttaattcctttccccgagtactttgatgttattctcttgtgttttgacaaatttgtaaattttttttaacttttaagtttggggctacatgtgaagttttgttacataggtaaacacatgtcacaggggtttgttgtacatattatttcatcatccaggtaataagcccagtacctagtagttatcttttctgctcctctccttcctctcacccttcccctcaggtagagggggatagttaatgttattcttttgtgttttgacagatttttaaattttgtttaacttttattttaggtttgggggtacacctgaaggtttgttacataggtaaacacatgtcttaggggtttgttgtacagattatttcatcacccaggtattaagcccagtacccaatagtcattttttctgctcctctccctcctcccatcctccaccctcaggtagtccccaatttctgttgtttccttgtgttcataagttcttatcatttagctcccgttaatttttagttttttggtctaggctggtctggaactcctggcttcaagtgatcctcctcagcctcccaaagatctgggattacaggtgtgaaccactgcacctggcctagttttatttgctaatgacaagtcaacagtcagtttagttgtaatttcgttgtaggtaagtaattctctctcctcttgagctacttttaagagcttttccttgtttatttatttattttttatttacagtacttttgagttgctgtttatttccttgtttttttgatcttcagggttttttttttttgcgatatctctaggtgtggatttgttttatgtatcctgcttttatttgatgtattccattagtctgaggacccctgatgtcttcagctgtgggagaaaatcttagccattatcttttaaaatagtttcgtctccattttccatttatggaaccattatttagatatgttttgggatttttcatcacatccttcgtgttgtttaatttacatttctatctcttctggctaatctcttgacatctatcatacgattcactaatttcctctttggctgtgcagttaatttgttaacttattgagggtttcactaaaaacatttggctatatatagtcaaatatataaatattgatatttatacaaatatacaaatatatatgtgtgtacaaacatatatatacatgttttaaagataggatcttgctgtgttgcccaggttggtgttgaactcttggtctcaagtgatcctcccaccttggtcccccaaagtgctgggatgtacaggcatgagccactgtgccccacctcgaatatattttcaaatttaagaatttctgttacattttctttcaaacctgtatttaaattttctttcaaatcagcttttaaattttcataagagcattttctttggacatttaaaaatatagttatgtttaagtcctctttggattattttcttagctgtaatttttgaggaatgaaatctcccatttggcttcccttcttccctccaagatttttgctgtttctccgtgtggtgtgcagtatttgacaatttaacgattgtttgcctatgcccgggttgtggaatgctcttttggtctagttttgcatttgtctctgatgggaccctttgggttcactgcgtctagagaggttttggtctattctcagatgggtctccagcacctggaaagtagtgtaaattttgactccatatttgtgtagaacagacttggggttttcccttctgtttgggtcactttttttttttttttttttgagacggagccttgctctgttgcctaggctggagtgcaatggcacgatctcagctcactgcatcctctggttcccgggttcaagtgattctcctgcctcagcctcttgagtagctgggattacaggcacacgccaccacgccctgctaatttttgtatttttagtagagacagggtttcaccatgttggtcaggctggtctcggactcctgacctcaagggatctgcccgcctcagcctcccaaagtgctgggattacaggcatgagccaccgcatccagcctgtttgggtcactttctctgcacagcgctgggctggtgcttgtagcttttctttttattttttcactcaaggacagtcctttatgtctttgtctttgtgctagtggttcacctccagcttctttcccatgcacaggcttcaggcaactgataatactttggctcagtatctccacccaaatctgatctcgaattgtaatccccacatgtcaaggggagggacttagtgggaagtgactggatcatgggggcggtttcccccgtgctgttcctgtgagttctcatgagatctgatgattttataaggggctcttcaccctttacactctgtgccctgctgccttgtggagaaggtgcctgcttccccttctgccatgattgttaagtttcctgaggcctccccagccatacggaactgggggtcaattcaacctttttcctttataaaataaattacccaatcttgggtagtatctttaaagcagtgtgagaatggactaatacaggaaacttctccagtttcctggtcctgtaatcatttgcatttgcagcccttgatttagagggcaggggtgagcaggtgtttatcatatgaagaatctcatttaatacgtttttctgtctttgcagccactcctttctattctattttcttcctgactgttgatcaggaagtagttctaccagttaagaacaagaaagtaggcttgtaatcccagcactttgggaggccgaggtgggcagatcacctgaggtcaggagtttgagaccagcctggccaacgtggtgaaaccccgtctctactaaaaatacaaaaaaaaaaaaaaaaaattagccagggatggtgggcgggcacctgtaatgggaggctgaggcaggagaatcgcttgaacctgggaggcagaggttgcagtccgtgagctgagaccacgccattgcactccagcctgggcaacaagaacaaaactctgtctcagaaaaaaaaaacaaaaaaacaaaaaaacaaaactgggaagtagttgtaaccacagacaacccccaccttgaacaggttatttaccaaaagttcttttggacattgattgtatagaacacagttcacattatctgataggaactatgttatttaaaaaatggatttgtttcccaggtgagcctgaggagtctgttctctcctttatgcagttgaaattcatatagacttgtgagttctttgggactgtaatcaatatacagtatgtgatttctgtgggaaggtataatacattttaacgttctcagtgaagaagggagtatgctgttttccaaccccagtcggtattccctggtgtgacctgccagctaccagaccccaacagttgttacaaactctagccactgttttcaaatctgccactaaatatcaccactcatactcagcacatgaccttgcctccacttcactgagaactttgagccatctggttgattttcttcacacttctaccagtttgtcatccctgcttctccagagttgccctctcctcctgtctcaggggatgagatgcttcttctgctgtttgaggcagtcctttgccaggagccttaggcttcactgctgcttctttggcagtcttttctcatcagttattccccttcattctccccattctgttcccagtggctgtccacttggggaggaggggtgaagattttgcctccaggagacatttggcagtgtctgcagacatttttggttgtcacaattggggggtggtggtgatgcatgtgctgctagcatctaacgggtagaggcgtgtagatatcctacaatgtacaggacagccccatgacaaaggattacctggtccacaatgtcagtagtgcctgggttgagtaatgttgctgcatcctcagggtctcacttttgactccttcgtttttctctgcccattatcttatgcctaagattctcatcctaggaaaccttccctgaaccacatgtccaatcctctcctagctacctaacttctccccttctcactgaaacttctgaaagagcgatttacacgtagtctctcattcactcttcaaattttagctgttgctttctggcttcccacccccaccgctgcttaaactgtttttgctgagaatgcctgtgacctcttgtgtgctgcatctagtggattcatttagtcctaattttacttgacatttttgttgcacctgacactgttaatcactatccccttgaaccaatgtattccattgtcatccttgttctccatgtccttctcttgtatttctttccctccctcctgtgtgggcttcttgatgatctacttactccttacacactgctgttacctggttttgacttcttagccaagaattatcataggtcattgtctccatgaagtaccttagttaccccaaggatttcagttgcacttatatacagatgtttttctaaatttctaaattctttttttttttctttttgagacagggtctcactctgtttccctggctggagtgcaatggcatgatcacagctcactgtatcctcaccctgtaaaaacggggtttctctgtgttgcccaggctggtctcagaactcctggtttaagcgatccaactgccttgacctcccaaagtactgggattacatgcatcagccaccatgcccggcttaaattcttccatgacttttcccctccaggctttagtgtctcttgtaatctgctggaaatctacacctgaatattctataggtaccttacgctcagcatgtctaatgtgaagtacatcttttcctcaaacttcgttttctgagatccacctgggctcccaagacagatagtggggtcttgtccagttcatatattatctacagttgccaatgtgatataaaatatgatttaggtcatatcacctacttgaaagtctgcactggtgctgtcttggtaacagaaagagaaagactgaattcccttattttgcccatcaggctctccttgatatagtctctgcccacccacctctccaacctcacatcatctctcttctgcctcatacgctatgctccggcacgtataggttcctatacaattttgtttcatacttgatgtctttactttttgtcttttgcctggaatgcagtatttttctattgaatatgtgggttgcttgccttctgagtggtgagattccccattcctcatggaagctacagttaattggcaccttgccccacttctgtggcctcaacattatgaggagtaaggatgtctgaattatttcagagagccagggcttggtaaatgctgcattagtcttgttgaaagaaggtagggaggggacattggcaagggtgtttcacagctcttcagttgtttctttcctcagtccctacttcctctattttattacctttcaggggttcttctggaaaaatgtatctttggagggagagcctcttttctttatttttttaaatttatttatttatttttgagacgaagtctcactctgttgcccaggctggagtgcagtggcacgatctcagctcactgcaacctctgcctcctgggttcaagcaattctctgcctcagcctcctgagtagctgggattacaggcgcccgccaccatgactggctaatttttttgtatttttagtagaggcaggatttcaccatcttggccaagctggtcttgaactcctgacctcatgacccacccgccttggcctcccaaagtgctgggattacaggcgtgagccactgcgcccggcctgagagcctgttttctttgggttttgccatctattttaacttgcttcagtgctccttggaattcctcactgatctatgtgctgagagcatctcctagattctcagggctgctctggattaattttttatttctttcgcttatttcactgagttttggtgtgggaggaaaggtaaatgtgtgtttggtcagccattttaaagtagagcttcagtgccctgtcttcgtgggtttcccccttttctctattgcagacatcatggccgagaatgtcttttaaagtgaatcattgtgtacacctttgatcattttattaagatactggccttatatcctgcccttcccccctgccgccccccagaatcactgggtggtgatggtagatgattcacatgggaatgtgctacacttgtgaaagatgtagaggaaatactgctgattctcctgaaggaaaagtctgttaatttttctctgttggccattctggccgcatggtttctccttattgtttttttgttggattttaaaaattactagtaagattgaacatttataagattcatttgttgcccatttatattttttcctgcattttcttttcatgttaataaaagttttttccccttaatacgattcccttaattctttttttttttttttggagacggaggctcactctgtctccaggctggagtgcagtggcgcaatcttggctcactgcaacctccacctcccatgttcaagcgattcccctgcctcggccttccgagtagctgggactaccggcgcatgccaccacgcgcagctaatttttgtatttttagtagagtcggggtttcaccatgttggccaggatggtctcgatctcttgacctcgtgatctgcccgcctcggcctcccaaagtgctgggattacaggcatgagccactgtgcccggtccccttaattcttttgaagtgaaataagcagatgctgccaaatgtaagatatggcccggtccccttaattcttttgaagtgaaataagcagatgctgccaaatgtaagatatgttgctcagtttttagtgtagatttattatgttctgattcttggaaaatgaaaatctactcctggttttttggttaatacatacctcatgcggtggctgtgaaaattaaactaaataacataggtgaagtgcccaacacagtacttggtacataataggcagcattaaatactagttcctgttattcattctttcttctttgccagattattaaaatgactacagtactccacaccttagacaaaaagttgtttttactgaacccttgttcgatgaaggacagtatgccaaataccttgagggatacagagatgttttaggctgcttcctgtccagggataaatattagcatactatatatatagttacattttgaggctttttttttgagacagagttttgctcttgttgcccaggctggagtgcaatggcgcagtcttggctcactgcaacctccgcctcctgggttcaagcaattctcctgcctcagcctcccaagtagctgcaattacaggcatccgccaccacgcccggtgttttcttgcatttttagtagagatggcgtttcaccatgttggccaggctagtctcaaactcctgacctcaggtgatccacttgcctcggcctcccaaagtgctgggattacaggtgtgagccactgtgcccggcctttttttttttttttaacatgctgttgtgaaaaccttttggtcttttaactgttactttatttgagcacagaacactttaaagtttggttgccacatttaatccatgacacctctgtgagagtagttattagttccattttatagatagggtccctgaagggtggcaggagtaaaaatagggtatattgggatgtagaagaatgctaaccattattgtttccaaccttggtaggtatagagtaaatacttgttgaatgaatgaatgttcttttataagttgtgtattaagcccatacctaaatcttatctctacttcttttcttttttatttttgagccggagttttgctcttgttgcccaggctagagtgcaatggcatgatctcggctcactgcaacctccatcttccgggttcaaacgattctcctgcctcaggctcccgagtagctgggattacaggcgcccgccaccacacaccgctaatttttgtatttttagtagaggcggggtttctccatgtttgtcaggctggtcttgaactcccgacctcaggtgattcacccgccttgcctcccaaagtgctgggtttataggcgtgagccaccacacccagccaatatctctacttcttatagttttattcaaccccttctatgtttaatttaattgattaatttttgtgagacagggtctcactctgttgcctgggctagagtgcagtggcatgatcttggctccctgcagccttgcctccctggttcaagcaattctccagcctcagcctcctgagtagctgggactacaggtgtgcgccaccatgtcctgctaatttttgtaatttttggtagagatggggttttgccatgttgcccaggctggtctcaaactcctgatctcaaaatgatccacttgcctcggcctcccacagtgctgggattacaggcctgagccaccatgcccggcccccttttatattttatctggcaaaaataagcattaatgtttagtggttgatagggaggacattggaagtcggaagagagataacccacactgttttatacataataaaaaggcattaagggaaggtatatgtgctgatactgatttaactttttgcccttgttctgattctttgcaagactacttttctggtttctgtaacaactgcaaagggcttcccaagtttggggctagggtaaatggctcaatttgttgcactctaaggatgattgtattaatagatttttcattctaatctctggtagagtacggaaaatcaattataattaggctcagactcaaggggaaaactttaggtagatgaatttcataatatacaaactttaatagaataagtgattactgtctcagagtttactctgtatttagctgtctgtagttggttgtcttagatagtgaaatatggtcttttagtaaaaatggtaagacccctgtataggatttgaagtaggacatctatgagcttatttcaggtagtaagtagtattaacacatcgctttcactctccacatggaacactgcattatttttttttattttttttgagacagagccttactctgtcacccaggctggagtgcagtggtgcaatcttggctcactgcaacctccgactcccgcattcaagcgattctcccacctcagcctcccaagtagctgggattacaggcacacgctaccacgcccggctaatttttgtatttttagtggagatggggttttgccatgttgcccaggcttaggtattctttttctgtgtttctcctcaagtgtatggttctctagtttgtgaattcactgggtggttgtgatgtccagtcagtaaaatgataaacatgaaagcactttgaaaatgatttaatgtcattgcatggaaatgttatagtatcattgcatcactatttataatagttctcaagtttttttttttttttttttttttttttttgagactgtgtctcgctctgtcacccaggctggagggcagtggcacaatcttggctcactgcaatctccacctcctgggttcaagtgattctcgtgcttcaacctccctagtagctgggattacaggcgtgcaccacgacgcctggctaatttttgtatttttttgtaaagatggggttttaccatgttggccaggctggtctcgaactcctgacctcgtgatccatccgcttcagcctcccaaagtgctgggattacaggcgtgggccactgggcctcaagtgtttttaaccacgtttgagtgccctcttctttttggtcacacaactttactgtaaccccactaattttttcagatgtagttcatatactatctcctgtataaaacataacctcttcagtctgaaaggggtactgtttcctttgaacatttatagctattttgatttgtacagttcatttggtcatcatgagtctgaattgtcacatcttgccttttgtcttgataagttaataatgtaggatcttaagatgtttatctcttagtgagaccagcaaacatttattaggacaataacacctattgtcctaatctctggacataaagtttttgtgtattaattccagtgttcacaactggattgtaaggtactttaaagaaaagaccatgatgtgtatgtacttcctggtttcatgaatgttttctttatatataataaaatgtagcagtgggtaagattagtggatgtatcattaatgttaaaattgagttttaacattttcctttttagaaccagtctagcacttctctggggtaactgaatttttgttaaaattggtccatatatatttcctgtcttttttagtttgtttcacatactttgacttatttcctacttatttctcctccattaaggtataaattctctccttaaattgcttagccttggattttcacagattcttttgaaaaacctacgttttcataggcgtgttgtctttgtaagatctaactctgcagtgatttattgagctcgttttgttttacttattgagcatcaagattgaaagaggaaagtaatgtaattttcattatttataatgcatttggctttttaaagtgttttgaggttaaaaccaatagcagtctagcactagttgaaggtattttgaagaggtggttagtatccttggggctgttaatcaggaggtagcctttatgtagagacttgaaggaatagtgttagcagggtgttcttgtaggagctccccttattcgatggtttggagtccataattggaaaattaattttaaaaattggtaaagctctaagcaatcaaatacgaatgcacatataactattttgccataaagcatacttttctttcttctttctttttttttttgagatggagtcttgctctgtcgcccaggctggagtgcagtggtgtgatctcggctcactgcaacctccgcttcccaggttcaagggattcttgtgtgtcaacctcccgagtagctgggattacaggtgcctgccaccatgcctggctaatttttgtatctttagtagagacatggtttcactgcgttggccaggctggtttcaaactcctgacctcatgatctgcctgcctcggcctcccaaagtgctgggattacaggtgtgagccaccgtgcccagcctaaagcatacttttgattaccagtatttgtttgtttgtttgaggcggagtcttgctctgtctcccaggctggagcgcagtggcgtgatcttggctcactgcaatctctgcctcccaggttcaaacgattctcctgcctcagcctcccgagtagctgggattataggcgcacactaccatgctggctaatttttacatttttagtagagatgaggtttcaccattttggccaggctggtcttctactcctgacctcaaatgatccacctgcctcattatatcatttgaaaatgatataatgtcattgcatggaaatgatataatatcattgcatcactataatagttctcaagtgtattttttttttttttttttttgagaccatgtctcactctgtcacgcaggctggagggcagtggcatgatcttgggtcactgcaacctctgcctcagcctcccaaagtgctgggattagaggcatgagccaccatgcctagctcattgccactattttgacgtatgtctaggatctttctcagttgactgaagttcggtgtcatcttgtataatccatcctatgtgtgcagtaggttcagtttcgacgacttgaaagtagagcaataatttagataacctatgaaactagtgcagaataatagatttttatagttgtctcctgtcttttaacataatctaacccacatccgatttgacaggcacattttttaagtgactcatcacctttgttgaatcttgccaaagcatccaatgtaatttttacaaaattggcactttcttgtaattggtttgcacactatttaaatgaaaaacatgtaatgattgttaccagaggaattgacagttttgggtaagaaatgcaactgacttttggatacaaagcatccagcttaatataagggagcagaagtgtgaagttgaactagatagttaaccattagccaaaaacatttgtactgatggcaacagccagatctctgttttccagaggtaatgaggagtttgatgaggagtttggtaactgttaggttgaggactgttaagaggcctgctggaggccagtatggcacttcagtgcacagtgcaaacccgcttctgtaatgcattttatactttttaaaaattccatttcccatgaataacatgcttttttatgtaacagaagataatcgtaacaattatcatgtaacagaagataactgttatttggaatgcttggagaaaatcactgtttaagatttctgtaaagccttttcctgtccaagatttctgtaaagcctgtttctgtcattgcctgaaacatcattatgcagcacgtgactacctttattttagcacttctcatttggagttaaccctttcacctttactatgaggtcttcctctgaaaaacttttgtatacaacatctgatccacagttgatacccaacaaactgaatgaaacagaagttctggccacttaagtagatgtcacaacccaatctttttctttctttctttctttttttttttttgagacggagttttgctcttgtcacccaggctggagtgtggtggtgctcactgcaatctccgcctcccaggttcaagtgattctcctgccacagcctcctgagtagctgggattacaggtgcccaccaccacgcccagctaatttttgtatttttagtagagacggggtttcaccatgttagccaggctggtcgaactcctgacttcaggtggtccacccaccttggccacccaaagagctgggatttcaggcgtgagccaccgcgcccgcccgtcacaacccaaccttccgtcacaacccaatcttgatgtggtgtagttttcattgatgtgctactgaaaaataagctgttattatttataaactcagttcagagaatattttaggataattatactcagttgagtatattatattccatatgtcaaagatgctgtgctatgtctacagagttctgagcttaataatacatagttcttgtctgtggacatgtatattgttggtacagtgggaatatatgaggaggagagattaattcaagcctgaaggaatttgagaggatttgagagtagataggacctgaactggacttggaatggtaacaataattaggattttttggcagatattttactgctttatggcattggatagtctggatctccttcaaattcttttcccttcttttctgtcaaatacacctagtcttcctacttccatctctagccttcttcctctgcaataatctttattttccttaacaatctattgcttttggccattttcctcttctttcttgcccttggtgtaatgcgttattgttttaaccctaaccctgtgcttctggaaatatgcttttctatcttctacatagccacaacacttcatcagtatccttcttagagcatttatcgtttctttgcactatagttacatacagactccatcctctgctggaccttaacttcttgagggcaagttgcacctttatagttcttaaagtatctagtatatagttttctaagtagtaggcaccacatactattctcttacatttagcttctttcctcaaactcaactcctcttctagacttgcctttttctgtgcatagtactagagttctttcaattccccattctggtcagtgagttctgcttctgtctttgaaatgttatttgtagccccaccattttttccactgtcgtcattgcatgccaattaaaagataaatatttagtgcatattgttctaagcactgtgtaggtgctaggaatacaaatataacagatccaattccttgttcttagaatcctagtcggggattattttggtactttgttgagcaaatgtttattgaacactttctctgtgcggagctctattgtaggcatagatgtattatatcattttccacaggctgctcatcttcaaggggaaaacatggctactggatttcctctgttctaaggtacacttttcttcccattttcttctagcatctctgaaatccagatgcgtctaaaccctggtatgtttaatgtttttttgtttgtttgtttgtttttttttgactgagtctcgctctgttgcccaggctggagtgcagtggtgtgatctcggctcactgcaacctctgcctcctgggttcaagcaattctcctgcctcagcctccttagtagctgggattacaggtgcatgctgccatgcccagctaatttttatatttttaatagagatggggtttcaccatgttggttgggctggtctcgaactcctgacctcgtgattgacctgcctgggcctcccaaagtgctgggattgtagacgtgagccaccatgcccggctttttttttttttttttttttttttgagatggagtttcactcttgttgcccagagtggagtgcaatggtgcgatctcgactcactggaacctccgcctcctgggttcaagagattctcctgcctcagcctcccgagtagctgggattacaggcatgcgccaccatgcctggctaatatttttgtatttttagtagagacagggtttcaccatgttggccaggctggtctcaaactcctgacctcaggtgatccacctgcctcagcctcccaaagtgctgggattacaggcgtgagccaccgcacccagcctgcttaatgttttttattcccccttcaagagctgttaaagtgatgctgcttacaactagtagttgtaactatagtataatttctaattactatactgtatactatagttgaactatagtatatattaatggtaaatatgatggacatgtgtagaattgtgctgtcaaatgtggtagcttctagctacatgtggctatgtaaatatgttaattagacattaaatttattaaattttaattaaaactaaaagattaacttgaacccaggagtttgagaccagcttgggcaacatggtgaaactctgtgtctacaaaaaatccccccccaccccaaaatcagctgggtgtggtggcacatgcctgtagttccagctactgtgggagttatggtggaggtggggctgaggatcatttgggaacgggacatcgaggctgcaatgagctgtgcattattgcaccgctgcattccagcctaggcgacagagcgagaccctgtctcaaaaaaaaaaagaaaaagaaaataaaggttcagttcctcagttgcactggccacagttcagatacccaatagccacatttgactagtggctactgtattagacagtgcagatatagaacattcccatcattgcagagtgttctgttaggtagcactggtctagaatgtggttccacagttgtacctggagggttggaaaagctttggttagtttacttcctggcattattattacctgtatttccttccttcagggaggtcagggaacttttctgtcttttccttctgcctttagttttaccagggcctgggacagtaagtggtaggtacgcagaaataaaaaacaactggagcattaaatagtttagataaaaaggggaaaggctatacatgtgcataacaggaaatagcttagctggctttattcaacgtgtatcctggtgtacttttttaagagggtttttagaacaaatttcatcacattgaaaatttaagaacttttatctaggtttgtatcagttttgttgtcgtgctgctataaagaaatacctgaggccgagcaccatggctcatgcctataatcccagcactttgggaggctgaggcaggcggaccacctgaagtcaggagttcgagaccagcctggctaaaacatggcaaaaccccgtctctactaaaaatacaaaaaaaaattagccaggcatggtagtgggcgactgtaatcccagctactcgggaggctgaggcaggagaatctcttgaacctgggaggtggaggttgcagtgagccaagatcgcgccactgcactccggcctgggcgacagaacgagactgccttaaaaaacaaacaaacaaaaaagaagtacctgagactgggtaatttataaagaaaagaggtttaatatgttcatggatggttctgcaggctttacaggaggcatgactgcttctggggaggcctcaggaagctttctttctttttttttttttttttttttttttgagatggagtctcgttctgtcaccaggctggagtgcagtggtgtgatctcagctcactgcaacctgtgcctcccgggttcaagtgattctcctaccttagcctcctgagtagctgggactacaggtgcatgccaccacacccagctaattttttttttctttttccgagactgagttttgctcttgttgcccaggctggagtgcaatggcacgatctcggctcactgcaacctctgcctcctgggttcaagcgattctcccaccccagcctcccgagtagctgggattacaggtgtgcgccaccatgcctggctaattttgtatttttagtagagacagagtaattttcgtatttttagtagagatggggcttcaccatgttggccaggatggtctcgatctcttgacctcgtgatccgcccgcctcggccttccaaaatgttgagacaggcgtgagccaccgcactcggcctcaggaagctttcaatcatggcagaaagcaaaggggaagctggcaagtcttacatggctggaggaagcggggtgccgtaggggggaccgtactacacacttttaaacaaccaggtcttttgagaactcagtatcacgagaacagtacccaggtagatggtgttaaactattagaaactgcacccattgtctaatcatctcccaccaggccccgcctccaacattgaggattacaattgaacctgagatttgggtgaggacacagatccaaaccatatcaaggttctttttatttatttatttattatttatttattttttggagacagggtctcactctcttgcccaggctggggtgcaggggtgtgatctcagctcactgcagcctctatctatccaggttcaggtgatcctcccacctcagcctccagagtagctgggaccacacaggtgcattccaccatgcccagctaattttgtattttttgtagaagcggggttttgtcatgttgcccaggctagccttgaactcctgggctcaagtgatcctctcaccttggccttccaaagtgctgggattataggtgtgagccaccattcctggcttatctaggtttttatcccttattaagtgggattcaaggaggcccatcatgtcagaatgctgtgggttggcaggaggcatcacaatgaaattttccatgttcccaaatttgatattcacagtactacatataatttctcagggaagatagggttggacacgatggaaatattttggtgaaccattcgttcccttgggtttctttctcatttggggagtgtggtttacaatgattggagcaaaagtttcctgaatctttttcttgtttccattttattgcatggtaaaacacaatttatccactttcttgtcaatgagtatctagttagattcctgttttttggctaattcaaataaaactatgaatgtttttgtaccggtcttttggtgggcagttgctttcctttctcttgggtacatacctaggaaggagggaagttgctgggccacagcatggccagttttctaaaacagttgtagcaatttatgttgctttctttttgaaaggacaaaagattaaagtttgccattaggcatttttactgtccgagtatttccatcaagcctgtgtgagttaagtcattaattaccaaacatcacagacctttggggtcacttgcagataaatctgaaaatagtatagacctaccatatcattcaaaagaccttaaaagaatataaaaactaagcatcttatctctccctctattgtcaatcttgatttactttcaagacacacggtctttgaagaaacttgttcatgcctttgtaaatggattgtgttgagtactgcttcctgttgcttactgttatgggaatgagtgtactttgcctgtcagtgatattactagctactatttgagggcttgcagtgtgtaacagaataaaggacaatgcccttttgaaattctagttcagcataagtcagcaagtttcaaactgagttcttgatatttgcaaggttctgtgctaggcatctccatgtccaaagaccaatgagaatgaatctcctaacctcttgaccttgtctaatggggataggaggcacataccatgatacaagaccaactataattgtcactagaattggaaataaagtgctgccgggcttccatatcacagcatatcacattttatttgggttgcagagaggggaaggtatccttgtaaagtaagcttatccaacccgcggtctgtgggctgcatgtggcccaggatggctttgaatgtggcccagcacaaattcgtaaactttcttaagacatgagattttttttgcggtttttttttttttttcttttttagcttattggttatcgttagtgttagaatatttcctgtgtggcccaagacaattcttccaatgtggcccagggaagccaaaagattcgacacccctgctgtaaagcttcatggaagggttgtggtctaagaggtccaccttgaaaggatttcagtcgcagctgcaatatatgccaggtgaagggaattgcttgatggaatcatgtagcaggaacatatagtctataccaagtggttctcagagtgtggtccccagaccagcagcatcagcatcatctggaaacttgttagaaatgcaaactcttgggctccactccagacctactgattcagaaactcagaaatcccagaaacctgggttttaactagttctctaggtgattgtgatgtgttaaagtttgaaaaccattggtctagacttaattggtcagagaatagttgaagtaaggtttgagaagggaagttatgagaacaagaaggcaggggccttactgcagagaccttgattgagtactagggtgtgagtatatggggctggggaaccgttagggtgaaggaaaggacatccttggagtttactttaggaagagtgagccaacaaactttttttgtaagatgaattaaaactaaaagatactggaggccgggcgtggtggctcacgcctataatctcagcattttgggaggcctaggtgggcggatcacttgaggtcaggagttcgtgaccagcctggccaacatgatgaaaccccgtctctactaaaaatacaaaaattaaccaggcatggtggtgtgcgcctgtaatcccagctactcaggaggctgaggcaggagaatcgcttgaacccaggaggcggaggttgcagtgagccaagattgcgccactgcactccagcctgggtgacggagcaagactctgtctcaaaaataaaaaataaatgaaaaaaataaaagataccggaagctgggagtagcagccttggaaagtgaaaggagcaacacagctgggatgagtgagccttgacagctggctggtcaagtgtcaggaaagaggccacagcctcagaagcagctatggttctgaacctgggtgttgagaggatggtggtgcctttagaagcagtgcaggcagaagacgcaaaggccacatggtgcaggaaaatgggacaagggggaagaggatgttttctacaaataattgcttcttcccctgaatgtacaagtttagtgtaagaaattcaggtacttgaggggacagtgaagaagaatgcagaatcgcctcaaatcccactttacagagattagcaaaacattattctctttaaatattttgagtatacatttgtttctttaaactcagttttgtatgcatggaattatacaattccgtaacaaattttctcagacaaattgaatttgaatacgttagtgttccacacatgaatgatcagtgtgcgtttggaaattggtggattttatatttgggaaacagaatgtttatacaagcagctaattggtaaagattgcaatttcattatccatggtcataaaaacatcctgtccacattagttgttacagaggaaatctggggcaaaacagtttaagatgcttggtgtgctgttagtctggggagaagaactgcaactaagaagaaaaaagatgaaacatttgtggcttttattagaatagcaagtttattacggtgtcttacaagaactaattaatattgggcataaaatagtctcattacataggtcaataccaagttccaaagttctcctttaaaataggcagctagctcctagtgaattttatgagccacaagcaaagatgtggaatagtttgcccatttcttagttttgtgacatgtatgacagaatataccatcttcttaagtatggtgtgtgtgttttttttgtttttgtttttgttttttttttaaagaaattatgggcagaaacctttatatttcttcctacctgatttgaatgtgagttcacattttcccatacctatgagagagcactagatattttccagttactttacttattaccaatctgataggttaaaactgatttctcatttttgttttttttttaatttaattgattactattgcgatggaacagggtttttctttttcttctttttatttaaaatagagatgaggtctcactaagttgcccaggatggtctgtaactcctgaggtcaagtgatcctcccacctcagcttcctaaagtactagaattacagatgtgagccatcatgcctggccaggaacaaacagcttttattagataattgcatttcttttgtgaaaggactgttaatatctctttgtctgttttctctttgggtgtttatattatactgatttgtaagatgctaacatattaaggatattcagcttctgtctttctcttttttttattttaccacttttttaaatcaagaggtgtagatactcattggctttttaaactatgccacagtgaagcatggcaaacacttcataaggtataggagatattcagtgaattatcacaaagccaaaccttatgtaacttgacctaggtgatgacataaacattgcaaaaccccaaaagtcagtagtgtacctaaggctgggggtgaaaggtgaggtctaccccaggttcaggcaataacaaagtgcattttctttagggaatttaaaatcagtaaaattattgactaagagttggtctgctttttgttatcatgtgttggccatttaaaaaatgtcagtgtgtgtacatgtatatataatatctgctttgtggctgaactgttaactttctttttgacaaatagaagttcttaattttaatatagtccagtttatctgtcttttcctttatggtgggtgcttgctgtatccacaaagagatattcttctatattatatttaaggagcattattgttttgacttttatatttaggtctgtaatccacctgaagttagtatttatgtatggtgtaagttggaggttaagttgaattttgttttcccttatgaatagccaaatgacagtgtcatttgaaaagatctgatttgcagtgccaactgtcttgtacagcaagcatccctgtatgatctatttctgggccttctgttcattcttttcatctgtttgtctagtgactgagctttataatatgtcctaatccagagagaaagtctttttgttgtacttcttcaaggacgtcttgtttgccttggctatttgtatttatgtatacatttttaaatcttctgccgggcatggtggcttatgcctgtaatcccagcacttttgggaggccgaggtgggcggatcacttgaggtcagaagttcgagaccagcctggccaacatggtgaaaccccgtctctactaaaaatacaaaaaaaattagctggatatggtggcgggtgcctgtaatcccagctactcgggaggctgaggcaggagaatcccttgaatccgggaaggggaggttgcagtcagccgagattgtgccactgctctccagcctgggcgatagagtgagactctgtctcaaataaataaataaataaataaaatcagcctgtaaatttcgattaaaaatttgttaggattggttgggattgttttgggtctctagatcaatttggatagaattgacatctttacagtgttaaatttcaagaacatgggatatcccttcactttattaggtccctttaatttgtaaaagtattttttgtttgtttaatagctttctacatagaagattttccactttttatttctaggaatttgataatttttgatggtttcaggaatggtattaaaaattcatttcctagctttattgctggtgtatagaaatactgttggtttttgaacattaacttttgtatccctcagctttgataagctaattttttctgctagcttacttgtagattgttttggattttctattgtgtacaatctgtggaaaatgataggttttttggtcattcctagcactcatttttgtctagatttctacctgttctcagtgaagagatttgtctgaattatatataatcattattactggaagcagaaagtcttcctaaatgaaagataaaaactacaccccattctcatttctgaattatctttgaatttaaacccaaatctcaaaggtgcctcaatcccagtgaaagctaatagtattttttgagacagtgttataaatgttcctaatggatttataagcaaatcttatgaaatctttaaaatttaattttttttgagacagcttttaatgtgtatctcaaggacttaaaatatgaaaacttatcagtagtttaaaaaattcttccaagtagtgaagtcactagtgaagccataaggtgtctctgatgtgctcatttttcttttcctttttttgagacagggtcttgctttgtcatccaggttggagtgtggttgctcattgcaacctcagccttgagctcctgggctcaagagatcctcctgcctcagcctcccgagtagctgggactacaggcacccgccaccacgcccagataattttttgtatttttttgtagagacagggtttcgccatgttgcccaggctggtcttaagctcctgggcttaagcagtcctcccaccttggcctcccaaagtgctgggattacaggtgtgagccaccatgcctggctcatttcctagtccttgttcttatgagcctcctactggaagtaccccagggagctctccgcatttgcagagggcattggcttgcttgggtaatgctctgtggtgccaatagagatgcactgcaggaagaactctggaaacttcgttgggagagaagtggcatatgagcatcattgtgagcaagtgtcaggtaatgttttccagaggaaaataccaaattgactagttgtatgccagacacatctgacagtaataacagaggcatactctgaatatgaacctgtatagcatatgtacctgacagcagtaacttacttaagcataccccgagaatgaccctgaggtctaagaacaacttgtgttcatagggtaccgaactaaggaatccagcagtgaccaaccagcagattcattcattatctataaggaacatctgagcccccaggccagtcctgtggatcctgggctttgccggaagattgaggatctttgttttgggttaaatgaaggttgccaggtggaggttggtgggggagggtgctaagtcaaaatgttatataaactgcatgcttttttacaagtgggatcagttcttctttctagcctgctgccactggactggatggccctgcatgtaagttccctcaaaaaccctacatctttttcactagctctgggtctcttctttggcttttcaaacatggtgctgtccctattgaagttaataggggttcaggacaacattagtaatttgatgagttgcagctgagggatcagagtattgtcataggttgtcctgtagcattttcatgcatgctccttgtgaacttgaggagtctgtaagctgctgtagtcaaggaggtcaacaaatgctaagcagcctcagtaaagggattgcaacttaaaacagcccaccattgcaggttcatctccatgaaggaccagcaagagacagttacaatgagcaagggctctgttgactattttgggaattaagggagtgggcaagcaaaagctgtaattgtaattagtgttgtggaaggagaattatcccccacctttttttttgtctttcactgcggtttacatgtgataggtgtttgattaatgtcagttgtatatgtgaattgttatgaagactttagaaaactttagaaactaatgttaagtgatgattgaaatgtgctcagattaaaaaaataattttagtatcttcaaccagtctagctggttaaataattttattattcctgtagattaaaaaattttaaatatcaagtttagagaaaaatcttattctaattttggagtatgattatatttcaattcagtatgtagttttccaatttgaaaaaaatagctatagctataattataatcagcaaatgaatgggatctgagactgatttaagttaaaatttgtgaccttaaaggaattgattcacagtgttctggattcttttcagaatgtgcggatactgtaagtacaatttttcttcatagtaagtgtaaattaaatataaactctatagtaaactcaagcattctataagaagccacataacgtgctatttctttcttttcccagtggtgttttagtgaatcattagttgtatgtttctttcttgagttggagctgaagaaatccttcccactggaaatatgagttctataccattttgtgggtagggatccagcggtgggcctttagtaagcgtaagcactggcttttgcatttatacttgtttttatagaataacaccatcttgtaaaatgatttgttcccagagtttttctagatacggtaattttaaacacaccttatgaatgttcttttaaaataagttataaagtgaattattttgtaaaacaagagttcttttattagcatgaatatctcctaatcttccctcacccccagtactactagctacttctagggttgggttttcagatacaatcaattttcttagtcttacgtagtgctttggagattagtgctcagatctcgtattgaagtatggttcttactcatggcagataatttctgtcttttcacttttgagttgtttttatacccttgaatatagtaggctaactatagaatacctaatgtcacaatcatgaaagaaatagttggtaatttataaaagctgtacgaaaatgtatattagacttttatggtttttaaggtcaaaaagaaactgaagactctttagaaaaggtcacaaaaaatcattgaatagggctgggcgtggtggctaacgcctataattgcagcactttgggaggctgaggcgggcagatcattggaggtcaggagttacagaccagcctggccaacatggtgaaaccccgtgtctactaaaaatacaaaaattagccaggcgtggtggcacacacctgtagtcccagctacttgccaggctgaggtaggagaattgcttgaacctgggaggcagaggttgcagtgagctgagatgctgccactgcactccagcctgggcgacagagtgagactctgtctcaaaaaaaaaaaaaaaaaaaaaaaaaaatagcggggtgcagtggctcatgcctgtaatcccagcactttgggaggccgaggcgggtggatcacctgagttcgggagttcgagaccagcctgaccaacatggagaaaccccatctctactaaaaatgcaaaattagctgggcgtggtggtgcatgcctgtaatttcagctactcgggaggctgaggcaggagaatcgcttgaacccaggaggcggaggttgcaatgagccgagatcgtgccattgcactccagcctgggcaatgagagcaaaactctgtctcaaaaaaaaaaaaaaaaaatttcattgaatcagacctaccagtgtctagttcaggatttgaatgcttagtatatattcattccttttgggggaaaagatatttctaatgactacttcatatgttttgtgtttttataattttctagttagaattcacgggcttatttcaaagaagacttctttaaaattaccaatttttagtccatttgtcttttctcttagcaaatccccaaatgacaaattgattaaaagaacacttagaataaatactgtaagttgtattatttaatatgtatttttatgtgccacatgtagagaaatgattaaagacaaaagtaatgaagcagactttttaaagaatcacttgacagaaagcagagaacatttcttacatatagaagtaaatgggctgggtgtggtggctcacgcttgtaatcccagcactttgggaggccgatgcaggcggatcacctgaggtcaggagttaaagaccagcctggccaacatggtgaaatcctgtctctactaaaatacaaaaattagctgggcatgatggtgggtgcctgtaatcccagctacttgggaggctgagacgggagaagcgcttgaacccaggagatggtggttgcagtgagctgagatcgcacagctgcactccagcctgggtggctgagtgagactccgtctcaaaaaaaaaaagaagaaaagaaaaaaaaaaaaaagaagaaaagaaaaaaaaaaaaaagaagtaaatggatgaggtgaacctcattatcttaggaacattttagcttaatagtaacaggaaaatagctttcagaatgggtttaatcagaataattaaacccattctgtcagtactgctggattacagattaattgctgaattttgagtacattactgagaatttggtcagagaaatagaaccactgtgagtattatgggtaaggaacttatatggtaatcagactgtacacaattataagaggtgctggggatgggaatatctatctgaaaaaggaaagacctgaaaaaatcactaatagatcctcctgaggtactggtacaggttgataaatgagagcttactgggaaaattttaagaagccaaatgtgtacagtcaccaaagtaggcatgcagaaaggcttttttctggagagttctgtggaaggctgtttcctccgtgtagctgctgcctctgtgggtccacagccaagcatttgttgttgggtcttgctctactgttggtcagatcagaagaagagctggacacagaggggacaagaggagagcagggacaagctggaagctgccacacacctctgcatttgtcgtcaccctgtgtgaccttcatgaagatcttgtaagaatttggccatcttgaacttggtgtactgtgcaggaaagggaattctgggaaacacagttcccggcttgatcaagttcacaagagactgatccactacattgagcttctcattttgagcatctcaagtctttttttttatgtgtggttaaaaatttttattttttatttttattttttgtgggtacatagtaggtatatatatttatggggtacatgagatcttttgatacaggtatacaatgcataataatcatatcagggtaaatggagtattcattacctcaagcatttatcctttctttgtgttacaaacaatccagttatactcttttagttatttttaattttaatttagttttattaattttttttgagacagggtcttgttctgttgcccaggcgggagtgcagtggtgcaatcacagctcactgcagccttgacttccagggctcaagccatactcccacttcagcctcctgagtggctgggactacaggcttgcattgccacacccagctaatgtttgtaatttttgtagagacgaggtctccttatgttgtccaggctggtgccttaactcctcagctcaagcaatcccctaccttggtctcccaagcaatcccctaccttagctgggattacaggtatgatccactgtgcccagcctagttattttatttttatcttattttgtttcagtttatgtattttatttattttattttttattgtttttttgaggcggagtctcactctgccacccaggctggagtgcagtggcatgacctcagctcactgcaaccagctcttcccgggttgaagcaatcctccaggctcagcctcccaagtagctgggattacaggtgggcaccaccacgccttgctaatttttgcatttttagtagagacaggagtctcaccatgttggccaggctggtctcgatctcctgacctcaagtgatccacccactttggcctccgaaagttctgggattacaggcatgaggctctgtgcctggctgctgcctagttattttaaaatgtacaataaattattgttgactatagtcaccccgttgtgctatcaattattcattctgtctaactatatttttgaacccattcagtgtctcttttggtctcatctcatcagtagatgatagcaatgttaaaatactttgagcctcaagattttcatttcctgatggtatttactgaggaatttaaaatgctgtactttggatagcttttgttcttttacttattaacaccatggcctttccctagtgtattttaccatacagtgcatctgtatcttattttctgacttttctcattgttgttaaagttttacaatcccagtaaatgaattccaggccagataatatcatttcagttttggagaggaaaacgagtacaaactttaagtagaagtaacttttacatagtctttggtggatttaggttaaaaatacccaagcatgccataagacattgtgctgtccttctgaaacgataatattccactctagcaataatgaataaaaggggatgacctttttcaggagatctaaatttgtgtacttctaggctctttgaaatacagagcatcaaaattttgttggctaggttgatatattcagccagcaaaattaagtggtttgctgttctctgattctgcgacacatcgtttgtgttctgggtctataccttctgtcttctgcagtgcaagtataacatacatgctagatagtttctgatttttttttttttaaatgtggatatctgacggagtaggggattttagggcatgataagatatagaaaatgctgaaaatagttttcatttatttccttcctgcagtccataatggggtgttcatttgcctctttcccatttaatttttcctctctagggttggagaatctcttctaattttttttttttttttttgagacaggatcttgctctgtcacccaggctggagtgcagtggcgtgatctcggctcactgcaacctctgtctcctggatgcaagccactttcctgcctcagcctcctgagtagctgggactacaggcacatgccaccacgcctggctaatttttgtatttttagtagagagaggggggtttcacaatgttggacaggctgatctcgagctcctgacttgaagtgatccatccgcctcggcctcccaaagtgctggaattacaggtgtgagccactgtgcccggccctcttctaatttcttttaagagcattcactgataataactgaagtatcctggagagttacatgaacctcttagatgtagtcatagaatatttaatatattttgttggcttctagtatctgttcacttttagaatagtacagtattttttttttccagtaggtgctcgtcacccaggtaaacactacattttccagtctccgttaaagccaggtgtggtagaggattaaatcttgtccagtaggatatgaatgaagatgttaggtacatcttgggtgttttgcctaaaaggagtggagttttggcctccctgtcctccacttttcccccttctctgtggctgagatatggggaaattggtgagagttgagttagatatctcagactgtgatatggacagtgctggaaccacttacctggacttttacatgaaagataaaaatgaacttctctctcttttttttttttttttggagactcagtcttgctccatcacccaggctagagtgcagtggcgccgatttcggctcactgcaacctatgcctcccggattcaagcaattcttgtggcattttttaaagacctgggggtggggagaggggatggtgtatgaaaagtaggccatcaggggaacttcggttcttttttttttttttgagacggagttttgctcttgtcacagctcactgcaacctctgcctcctgggttcaagtgattctcctgcctcagcctcctgagtagctgggattacaggcacgtgccaccacaccagggtaatttttgtatttttggtagagatggggtttcactgtgttggccaggctggtctctaactcctgaccacagttgatccacccgcaccatcccaaagtgctaggatgacaggcctgagccaccgtgcctggccctgggaactttggtctaatgaaataaaatttctgcaaattaaagtgttcgtttttgttaccttgatagcattagtctagactttcttcatttttacaagaccgtgaggagattattcatggtatagtatggtatcagaaaaattgtaagggtatggtatgtgttgattatttccccgaaaaccatcctattttcatctctgttgcctctacctttattaaggtacataagtccccaagttttataagtccccaagtttctacctcctcggaaccattttccctcatcctcaacaatcctttctgatatagaagtttatcacttgtggtatgactgttctccttaaaaccttcaataatttctaatgcctgaggaccaaagtaaacacagtttataacaaacaataatcaaacacaccttgtagcaatcagtataacaatgcccttttacagcagattaaattattgaagtgacttgttcaaagtagcagaggaagataaaagcataagcgtgttttgctgtacagaattgtgaaaatggaatccccgttcctagggaccttaacttttagtagtggaaaagcaacttaggcaggcaaataattcagagatttggtattgtttagtccaaagttagtgtttgaatgaatataaggtagtgaatgaaatttggagaatctgttgttcaaacttttaaaaagttaaatagtattaccttaaatataggaacacattttctcattttgtattctttgaatttttatttattttaaactttgtaattattttttgttttttggtttttttttttttgagacagaggctcactctgttgcccaggctggagtgcagtggcaatctcagctcactgcaaccgctacctcctgggttcaagcaattctctcctgcctcagcctcctgagtagctaggattacaggcacgcaccaccacacctggctaatttttgtatttttagtagagacggggtttcaccatgttggccaggctggcctcaaactcctgacctcacgtgatccgcccaccttggcctcccaaagtgctgggattataggcgtgagccaccacacctggcttaaactttgtaatttttatttcttttcttttctttttttcttctttgtttttttgagacagtgtcttgctcagttgcccaggctggagtgtagtggcacaatcacggctcactgcatccttgaccttttgggcacaagcgatcctcccacctcagcctcctgagtagctgggaccacaggcatgcccaccatgcttggctaatttttaaaaatttttctgtagactcagggtctccctgtgtggtccaggctggcctcaaactcctgggctcaagccatcctcctgcctctgcttcccaaagttctgggattacaggcatgagccactgtacctggcctgaactttgtaattttgtaagaacattttaagaaaatgctaattggaaaattatcatctctactctttttcctgtcaaatattatatacatcatttataatttattttagccttctaatacttagtattaatacagtgagaactggtggtggtacttcagtgttccaaactcagtctactgcttttcttggaaaagatgatgaaaataactactttaatgtttgtggttattgctcttttctagtatctgaattttaaaaatacattgtatagagttatgtttactcatataacaaattttagattttgttcttacaatgtatttccaaaacaagtaacattactattcctatttcttagtaacttgtgtaactcaagatcagaaaatttatattgatcagaccttgaaatcagggttaagcattcacatttgaacaaaggataggtttcttgagtattttctctgtagttcattccttatgtatttcttactgtgctcatccaaattttctcatttctttggttcaactttcagtactttgtgagctctctcattaggtgcaatatgtttataatttttatcccttcctgttggattgactcttaatgtccttctttatctttttttaatttttgagatggggggtttcactgtgttgcccaggctggagtgcagtggtgtgatctcattgcactgcaaccttcgcctcctgggctcaggcagtcctcctgcctcagcctcccaagtagctaagatcataggcatgcaccacgatgcctggctacttttttgtatttttgatagagacaggttttcaccatgttgctcaggctggtctcgacctcctgggctcaagtgattcacctgccttggcctcccaaagtgctgggattacaggtgtcagccactatacccagcatccctctttacctttagtaattgatttttgattaccaattactgactattggttattgatagtgattattaataaagtccacattcagatttttttagttttttaccttatacttttaaaagtcttaacatctagtttgtttgattttaatatagccattccagctctcttatgcatttatatctttatcctttcaatttccacttatttatagctgaatgtaaaatacgcctcgcatagacaacatatagttgaatctttttttttttgagacggagtctcgctctgtcgccatgctggagtgcagtggtacaatctcagctcactgcaacctctgcctcccgggttcaagcgattctcctgctgccccagcctcctgagtagctgggactacaggcatgtgccaccacgcccagctaatttttgtatttttagtagagatggagtttcaccatgttggccaggatggtttcgatctcttgacctcgtgatccgtccaccctggcctcccaaagtgctgggattacaggcgtgagccactgcacctggccctgaatcttgttttttaattttaatttttattattattttttgagacggagtctcgctctgtcaccgaggctggagcacagtgttgtgagccggattcaagagattctcctgtgtcagcctcccgagtagctgagactgcaggcacgtgccaccacgcctggctaatttttgtatttttagtagagatggtgttttgccatgttggccaacctggtcttgaactcctgacttcaagtgatctgtccaccttggcctcccaaagtgctgggattacagacatgagccactgcacctggctgaatctttttaaaatccagtctgacaatctttgcattttgattggattgtttaatcctttcacatttaatatagttattgatatgtttggatttacatctattattttgctgtttgtttactgtatttttcattttgttgttttgtttttctgtttctcctttactgttttattttgtattaagggaagaatttcaagtgtaacattttaatttctttaatgatttttttttagtttttttggagttattttcttagtgttgctctaggacttaccacatacatgcttatcagaatctacttcagatgtatgctaacttaactccagtaagatatagaaaccgttccttccatgtagctctattctctcttcctttttgtgatgttattatacatgtcttatttatgttaaaacctgagatatgttgttaaaatgataactttatataatttcatattttaaagaagctgggagaataaaggagaggaagtatatatttgtagtttgttatattaactttcttatttaccatttctggtttccttaatttttgaagaaatttgagttaccatctggtatcatttccttactccagtatagctttgttcccacccacctcctttgtgctttagtggccctttaacaaaaattcgtgtggagtcatgttactgtctagtgtcacttgttttcagtatgtaaaacttcctttagtattttttgtaagttggatcttctagcaatgaattctctcaagttttcatttatctgggaatgtctttattttgccatcatttttgaaacatagttttgttggatatgaaattcttggttgacaagtttttttttttccttttctttcatcgctttgaatgtgtcatcttactgccttccagtctccatcgtttgtttcttttctttccttttttttttttttttttgagatggagtctcactcactttgtcgcccaggttggagtgcagtggtgctatgtcagctcactgcagcctctgcctcccgggttcaagtgattttcctgcctcagcctcccaagtagctgggataacaggcatgcaccaccacacctggctaatttttgtaatcttagtagagatggggtttcaccatgttggctaggctggtctcaaactcctgacctcaagtgatctgcccacctcggcctcccaaagtgttgggagtacaggtgtgagccaccgtgcctggccaatctccgttgtttctaatcagaaagtcagctattaattttattgaggattcttcttatgtgataagttgtttttctcttgttgctttctttttttttttttttcttaaatatatattttgttgttgttgttgtttttgagatggagtctggctctgttgcccaggctggagtgcagtggtgtcatcttggctcactgcaacctctccctctcgggttcaagtgattctcctgcctcagcctcccgagtagagtagctggggctacaggtgtgcaccaccatgccccgccaatttttgtatttttagtagagacggggtttcactatgttggccaggctggtcttgaactcctgacctcaagtgatctgcctgccttggcctcccaaagtgctggtattacaggcatgagccaccacacctggccttaaatgtattttttgatatagagatggggtcttgctgtgttgaccaggctggtcttgaactcctggcctgaagcaatcctcctatcttggcctcccaaagtgttaggattataggtgtaagacaccgtgcctggcctctcctgctgctttcaagactttctatgcctttcagcattttgactatgatgtttctgggtgtggatctctttgtgtttattgtatttggagtttgttgagtttcttggatatgtagttaaatgtttttcatcacatttgagaagttctcagccactatttctttttttttttttttttttttttgagatggagtctcacactctcgcccaggctggagtgcagtggcacgatctccgctcactgcaagctccgcctcccaagttcacgccattctcctgcgtcagcctccctagtagttgggactacaggcacccgccaccatgcctggctaattttttgtatttttagtagagacggggtttcactgtgttagccaggatggtctcgatctcttgaccttgtgttccgcccacctcggcctcccaaagtgctgggattacagacgtgagccaccacgcccggccagccactatttcttaagtatttttttctgttctttcttctcctctggtattcccattacatgtatgttgttgtgtattagtccaggctctccagagaaacaaccaaaaggggatgatgagatagatagatatgtttagtggtatcccatttttctctgaggttctgttcatttttcatttttttctgtgttcttcagattgcataatctctatcaatcagtcttcaagttcactgattcttctgccagctgaaatctattcatctcctctagtgagtttttaaaaataagcttcataatttagaataggttttggtttacagaaacattgcaaagatagtggagagtttccatgtaccccacatgtagttttccctattattaacatcttatattggtatgatacattcattctaattaataaaccatattgttagtgattattgattactgatattcaaagttcatactttattcaaatttcctgttttaatctaatgtctttttttttctgctctaggatctcatgtaggatatcacattacatttagttgtcatatcttcttagactcctcttggctgttacagattctcagactttctgtgtttttgatgaacagttttgagtaatactgcttaggtgttttgtggagtatccctcagttgggatttgtctgatgttttccttgtgattagactggtgttgcaggtttttgggaggaagaccacgtaagtaaagtgtcattttcatcacatcgtatcaaagggacatactatcaacatgcttatcactattgatgttaattaaccttgatcacctggctgaggcggtgtttgtcaggtttctgcattgtaaaactactctttttctccctttccataatgtcctctttggaagaaagttactatgtgcagcccacatttaaggactatggagttatgttccaccttattgaagatggggtatttacataaattatttagaattcttctgcacaggggatttgtcaactctgactctctcatttacttatttaaaaaatcattatggactcatggatttctttttaatactttggttaataatccaaatgtagtactactttattttgttgctaaaattgtccctgctttggctactgggggccccttcagttaactagtgtgatttgacatagcacacttcttcttccttcttcctttcttctttcttcttcttcctcttcctcttctttcttcctttttttttttttttttggagaggaagtctcgttctatcccctaggctggagtgcggtggcgtgatctccgctcactgcaacctccacctcctgggttcaagcgattctcctgtctcagcctcttgagtagcttggattacaggtgtgtgccaccacgcctggctaaatttttgtatttttaatagagatggggtttcaccatgttggccaggctggtctccaactcctgacctcagatgatccacccgcctcggcctcccaaagtgttgggatgacaggcgtgagccactgcgcctggccttcttttttctttctctctttctcctcctcctcctccttctctctctctctttttttttaaacctacttctttattttctggcactagaatatgctccaggctcatcttgtacatttttatgccccagtcctagtttcagccatttcaccaaagagtcctggtttctttctttctttctttctttctttctttctttctttctttctttcttttgaggcagggcgtcactctcacccaggctggagtgcagttgcatgatcgcggctcaccacagccttgacctcctaggctcaggtgatcctcccacctcagcctccagagtaactggggctacaggtgcgggccaccacacctggctaatttttgtattttttttttttttttgtagagaaggggttttaccatgttgcccaggctggtctcgaactcttgggctcaagtgatctgcccggcctgtctcccaaagtgctaggattacagacatgagccactgtgcccgactcctggtttatttttatcacagaatggtattagaaagcaggatctaggtgctaggtgggtgctaatgaatctttcattttggttatttactttcctattccagaatttccatttggttccattttcagtattctcagccttccttgcctggggtagaggtgctgccctataaatgaggctaggtggaggtagctctgcttgaccggaatagttcctgcaacatgaaacagaggctgcgaggggtggcaggggatgtgaaattctggtaacctactgctcctggggagaaactttcgtcttggctacactcactgggcatagagctgggggtgagggagagggaatgggcatgtaaggaagtgagtcctggttcaaatttttccaacttggtctttttaccaagattcagtagattttcttgactaaatattgctgcgtttgccccatgtccttagggcaatttctgcagactgtaaatagtttcttctctttccttctttttttgtatcctttgtaccagttaaggttgttttgctgaggagagggtccagggtccacatggaccacctcacactgccattctggaagtgcttttctttggtttaattttgttggaataaagtattacttatggaaacagcattaggtaaatatatttcacgtattctaaatagtaatcttcattgccccatcttgttttctatatcctttgatactaatttataacaacagttctttagaatttagacactaactcacctcttctctttgtattttatcttttgagaatgaagcttcattttatttttcatagccctggcagactacttccatttatagtcctgtaaccatcccttttgtgtgtgtattgtttctgtgatgtctttcatgaaacttcttagggctaaaggtaattgaagcacatttgcttttcctcccactcaaatgtttttatttccttcaaacaaataccttagcaattctgcatctagatgttcttcaatttgtcagttcttgtttttttttttttttcttggcacaacagaagatgttctatttcatacagttaatgaaaggtatctttacttacgtaactataaatgatcaataatgatgatagtgcaatgcaatttcagaagttgttctagatttagcatagttctaaattgttgaggccgagtagaaaaattttcagtgatattgttcaacttgataaagtaacattactttgcagataatataattgtcatcagaactggcaagactaaaattgtttgctttaaaatattttattttccttaataaaaatattgctttaaaaatgttaatgacatttcatgaatctattcttttgggcattgacataaattactggtctcatttggggaatccatttaaatgtaggctctttgagatgatataataaatccctctttctaaagttattggccttcttattacatcatctattgtgtttcattagtgttatcttttaattagtaataatctctattatgtggcttctatgcatcagaggctttatataatcttgaatcctcttcattagcctataagtaggtggtatcagttcttcttaatgaatgagaaaataggcttgaagggactacataacttgctcatggtcacataattagtgagggatgacacccagatgtgtcagtattctcaaaagactagaaagaagggtccaggtagaggaagggtttgtggcaaaagcagtgcatggactgcttgttcatcatctttttttttttgagatggagtctcgctctgttgcccaggctggagtgcagtggcacaattttggctcactgcaacctctgcctcccgggttcaagcaattctctgcctcagcctcccaagtagctgggattacaggcacccaacaccacacctggctaattttttttttgcaattttagtagagacggggtttcaccatgttggcctggctggtcttgaactcctgacctcgtgatccacccgcctcggcctctcaaagtgttgggattacaggtgtgagccacctcacctggcctcatcatcttaattggtcttggattgttgaaataagttttcatcttctaaggaggacatatcaaaatctagaaactaaaaagttaaaaaaaatttttatgttagcctaaacaattgaaaatagcagataacaaacaatatttaaatttgaaatgtctgtgggtttctatattgaatcctgtgtctatgattatataaactaggagttacttcaaggaaaatgatgacaccacattgagaagtaggctccttagtcaccaggaggctatctgattttcccacttactctattgtgaatggagaagaatcctttggtcaagccagagcatagctcctcctcagctgattaggagacctggagatgagatctgtttcctctttgctataatgaatgtgtagggtttattctctctatcagattctggattccctgaaaacaaagatggtggtttgtatttcaatgcactttacatgtcatttgcatgaaatgagaagcgcaagtaactaactagttggtattgtggaactataaaatagaatgcagtattgtttacaagttcattctctgttagatactgttataaatatgcataatcaattctttttttttgggggggggacagtctcgccctgtcgcccaggctgaagtgcagtggtggcgcgatctcggctcgctgtaacctctgcctcctgggttcaagtgattctcctgcctcagcctcctgagtagctgggattataggagtgtaccaccatgcccagcgaatttttgtatttttagtagagatggggtttcacaatattggccaggctggtctcgaattcctgacctcaagtgatccacctatcttggtctcccaaggtgctgggattacaggcatgagccaccaccactcctggctgcataatcaattcttaattatttatgaattgttagaatggtttatcccaagcccatttctttctctgtatcttttttttgtttgtttttgacacaggatctcaaaaatcatcactagatggtaaatctgtagggaattattattttgagtcaggatcttcctctgtcatcccggctagaatgcgggggtggtggggggcaggatctctcctcacagcagcctctgtctttcagactcaagcgatccttctacctcagcctcctgagtagctgggaccacagggacataccaccatgcccggctgactttgtaatttttagtagagccagggtctcgccatgttgcccataataaataacaactaagacctcatagttgtcagtcatgtaatattattttccatttgctccatctctattcccagtttcagttagtagagtcctgatatacccagtagtcaaggcagaatttttttttcttttttttttttaatataatttttgattttacaaaccctggcctacaggtcacagcagaaattttagcatcattttagacttttccatttctcattcatcaactatttttaaattgtcgctgtgtcttttgattacatctcttaaatatctcaactttatctgcctttctttgttcccactgttgctgctttagtttaaatttcatcattttgtgcctggcctctataaatcagtagctttctgactagtgtctgccctaactctcttcctgcctccatggtgatttttctgaagtataacactggtaaaatgctcaacttaaaccttctcttgatttcttgttgtctatggcagtagccttcaaacttcttgtaaggcagttagaccccttcttcaaatatagggtgtcaacaaaatttcaacaaattgagtctcagagatctgattgggttttattaacgattcatggaccaggtagcatccagtctacgaaacagaaagagctctaatgacctagacttagtgggtacattttgtatgcacaaaaaagtggaggaaagcaggaccaaggatcaaatagtgggttggtcatttcaaggttactttccttatagggaatcttggcttaagggaatttagctatcatctttctcctgatttcttaggtggtcagattttacaagtaaataagttaggttttggtttggtaacttggaaccttagcctgagtgactccatttgggcctgctgttctttctttaactaaggcaaatacaatgtttaaaatagattttttttaaaaagagagagcgcaacactattgtctgattgaagcaggacaggaatgtaggaactctgcttttgcttctacctttctcaaaaagccccttgagccatatagggcaaagtttgaaaaccaccatcctgaagcagaacctagacttcttagcatggtatagaagccttttatgattttgtccatgccttttttcgtgttattcctggacttttgccctggatttcagatatgctgcattacttgcattcaccgaacactcattttttttgcctatatttttgcacaaacttttcatagaatgcctttacccattttgtctatcagctaaacttctgttcttgtctcaagtattaattcagatatcacctcttcaatgaagctttctctgattttccaagtcaaagttaatcttttttttctgcttttctagtatctcttcacattggaaagcaggaagactttgttatatgtgattcagcactagtagcttgaacttacaacctgttatatgacttacaatatttgcatttaaaatgcctgaaccaaacttttgccaacatttaattgtctattttttgctttctcatgaaagaaaatgtcagatgttttgcttaaaaagcggtcaagcacaatggcatatagccttaacttggttatgaaattgggcaattaaatcttttcattttaggtaaagtcctttatattctgtggtattgtagatggcattattaaagtactgaagtttccttttgttatctattttaaaggattgaatatgtactatgattatcatgtattgtgactcgcataaagagtagcaaatttatgacatgattggttcccttcaatcaaggcaccttgttgaaactcttttgaggaaatttttcattcagatttatctttaatgcagcttccaaataagtgcttgatgaatattttatttaatgagtaaattgtgaattaccttgtggtcgaagatattgtctccttattcactactttattctctcctccttctccatattccacttagctacatctttctcctcattcctaaaaaaaaaaaaatctctaaatatcttggtgcataagaaaagaagaaagaccagtgaattttcttgtttcttgcctgctttaagaggtggaattgactgtagataagaattgtggttaggctaaatattgcatatatgaacagcaagcatgccataatagatgcttaataaatgtttgttgaatttgagtagggtagatcttaggctctcagtgctttaaatgattactgagatttgaggatttcttcactttgccattgaataaacttaaggcttagagaggtagaagtggctttgcagatttctggtgaataggaatttttcaataattagaacgatctgaaattggagtgagctgttttgttttgtttagacaggatcttcctctgtcaccggagtgcactagtgatcatagcttactgcaggcttgaactcctaagctcaagctatccttctgtgtcaacctcccaagtagctgggactacaggcatggaccagcacacacggctaatttttgaaattttttgtagagacaaagcctcgctgtgttgcccaggcttgtcttgaactccaggccttaaacagccctcctgccatggcctcccaaagtgctgggtttagaggcatgagccgctgtgcctggctgtgagctgtttttgtaggcactaagtttcatatcacacctggcacggtggctcattcctgtaatcccagcactttgggaggctgaggcgggaggatcacttgaggtcaggagttcaagaccagcctggccaacatggtgaaacactgtctgtagtaaaaatacaaaaattagctgggcgtgatggcgtgtgcctgtaatcccagctacttgggaggctgaggcaggagaatctcttgaacccgggaggcggaggttgcaatgagcctagatccccctactgcactccagcctgggcgacagagtgagactccgtctcgggggaagaaaaaaaatcacttcctagctagaccaatgtgaaaaaattatttgtttgagctcttgttttgatattaacatgatgtagctaagtggtatttttctgctaattgaccttttgaaattcaaatactacttaattctattatggaacagtagaggaaatggggattctggccagagaaaacaaggaaaaagtacctcttgaaggtacttgacagtgaaatgatgaaacctaaaatgttgagatgaattgcaacaaaactttgatatttaataatgcatttgaagggaggccctgttctgttgatgaggcagaccatcaagagcagtgtagacgttgccaactcataatggcaagctaagagttcaggattttcaactgaatttattaaatctggatattcaaaatttttgtcattttgccatatattgggggtgtcttaattaaagggattttatgtagttcaaaataaatgttacaattgttgtattatactagtactatgaagatgactatgataagagtgtcttttgtatgctaattgggtgactcctggcagaacctcctagatagcttctgatgggggctggtcaaccagaaagaagaaggcactattagagatttaggactttcatcttcaccccagactttctgggaggggaaaagggaaggagaatgagctcaatcaccaatggctagtgctttaatcagtcatgcctacataatgaaaccttcctaaatgatggtgccctggagccttgtgggttggtgaacacactgtaaagcaaaacaaaattctaagccgcccagccaactgaatgaaaccctcctctcagccaagggcactctaacctgaatgctagttcaggccatgataggaaagacatgcctcattatacctttgtccctttggaattcaggcatggctaaccagcattaatgttaaaacagactctttgtagcagtaagataccaacatgatacataaaatgtatcacactttgtagcagtaagataccaacatgattgcaggccctgaaagaaatagaagtattttaccctgaaatatatttctctattttgaaatggccctggcaaagctgtctctcatggggaaaaaaatctacattctatagataatccccttccctttccaggtctttttcctggtccaggagagaatactgtctggcacctttttaagtctgttttttttgggaacaaagtctccgctctgtcacccaggctggaatgcagtggcatgatcttggctcactgcaacctccgcctcccaggttcaagcaattctcgtggtattttttaaagacctggggtggggacaggggattctcctgcctcagcctcccgagtagctgggattacaggcatgcgccaccacgcccggcaagtttttgtatttttagtagagacggggtttctccatgttggccacgctggtcttgtactcctgacctcaagtgatcctcccgcctcagcctcccaaagtgctgggattacaagcaggagccactgcacagactgccttcttaagtctgataagaaacatttacaatctgttccataggaagcctctgcataataagaaccttggtctccacaaccccttatcttaacccaaatcatagaagggagattctattgattccaggtctttaggtaaactcaaccaattgccaatcaggaaatctctgaatccacttatgacctggaagcacccccctccccacctttgagttattctacctttctggaccaaaccaatgtacatcttacatgtattgattgatgtcttatgtctccctgaaatgtacaaaaccaagctgtagggggccaggcgtggtggccttatacctgcaatcccagcactttgggaggctgaggcgggaggatcactggagtccaggaattggagaccagctgggcaacatggtgagacctcttctctacccccaactctccctcaaaataatagtaattaaaaccaagctgtagcctgaccaccttgggcacatatatattctcagcatctcctggggctgtatcacagttcgtggtcttcatatttcgctcagaataaatctcttaaaatattttagagtttgactctgtcaaaatcatcgaggtgctgggaggctggtgtgctctgagaaggcacggaaggcctgtgctggctccccaacccctcataccttgccctgtgcatctcttccatttggctgttcctgagttgtatcctttataagaagctggtagtaaatgtaagtaatgcatttccttgagttctgtgagtcacgctagcaaattatcaaacttgaggagagtgagttgtgggaacccccaaatttgtagccaagttggatagaagtatgaatagcctggggacctgggacttgtgacaggaatccgaagtgagggcagttttgtgagactgagtccttaaacctgtggattgaattgaaggatactcagttggtgtcagagaatcagaattggtgttggaaaagataccacgcatttgctgtctggggaaaaaaaaaaagccctcaggtaggcacatgaatcttcagcttacaaatggaaacgtaccaaagcttcaagagactgctgagctcatcattaaggtagtatgcgggaaagctataactcaaaagtgctcttaaccatatctttttaaaaaattgtatcctctttgagggaaagaatctatcttttcttttttaaattgttattatttattagtcagcttctcagatctctttggaatttaattgaatgcttttatcaattaatggtcttgatgaaattgcttgtatttttgactattatttgtatggccaaagtaattttacgtacccttctgaagttagcagcacaaacaattgaggaagtgcaaagattttcgcttgatttttcttcagtttcttctatattttaaataggacacaaatatctctgtaaataaaaataacttccaatacatttggaaaacatcccagacttcctgtccatgcctcgcaaagttgctgctgtctagtcattattactatgttttttccctttgacataagtgaccctcacaggaatagcttcatcaccagctgtttggccagtggtattccacttactttgtttttcctgtttctctgaaatatgctgaaagataatcactccgtgccttcccttgtttagaatgaatttactcaattgctctggaagcttaccttggtaaatgatttggaaccgtaatgaaaaaagagggtaggctttatatattttatattggtgccttaggaattgacatttatttattgaggatttttgtgctcattttcaatttgaaagggtcctagtgtttagaattaaattgtgggacttgaaagctaaaaaggaacttggagatcgtccaactgaggagccttattttttaaatgaggaaacaaaagttgtcaagatcaaccataaatctgatagtttggcttggtgaaagaaacctaggtttcagaaaatctctcatgtagtttgcagtttatagccacaaggaccaggagtctgaagacttgataagagggtctgtttttcaaaatattaacaaagtttagcctggaagctccctttgtgaattttccatgtcattgacagtgtttgaaatctcgtcatgtcttcaggatcaataacctctaccatgtacttttatactttttaattagcggattttcaaacttttaaaaacagtaactcctttttttcaatataatcttatattgaaccacaggatacaaaaaagatacgtgatatttaattaaaatagttttaagcacaattttaatttgttggataataaattaatgatgacatagctaaaatttatgaaatgctgattagagtactgtacatacatatttcacttctctctctagcttaaaatatttgaatgggtgtactgtaattcatttaactaggcccttgttgatgtgtatttagactgtttccattcttgtttttgcaaacaatgttgcagtgaataatgtatgtatacattatgtggtgtgtgtgtatgtgtttctggggataaattctggaaatgtaattgctgtgtcattagaatatgtttttagttttgaaggattttatcaaattggtttccaatttgatatatattcccaccagcagtgtatgagcaagcttaattctctcatgctctcatcagcatggtatgttatttttggtttttgctaatgtaaaaaattgtatctcagtgtggttttaatcttctatttgtattatatgtaaatttgagtaacttttttatgtttaagagccatttgtgtttctttttctctgaactatttgttcatatcactttgcccattttaaaaattgggtttccgcccctcttaatgagcaggagtagccttctgtgtattgagtttaactttgtgatataagttgcagattcttttcctcaggttttcatttctatttttcctgtagtttgtaccttttccatttttatggatatctaaactcaaccttaacttgacaaatggaaccttggatttctatccttcctttaacctccttctcttctagtcttcctcagtgaagaaacagcacctctcatgtgtctctactcatacatagcccaagcccaaaaccaagaagttatccttgcctcctctttccctccctccctgtctctaatccatcctcagtggtattgacttcctctccaacatgtcccaaatctattcatttctcttaatatccaccaatttagtccatcctccccttatctttcacctgggtggctgccatggcttcctagctgttctaccccaaaactgatgtctcccgttccaggtactgagccattctctactctgtagcttatgtgatcttttcaaactgcaaataatcagattgtcataccactccctgaatccacccctcctattcttgttcaaaaccctcctgtaagtccttatgtcccatggcaaagattatgcttcttgaaatagcccaacctgctgtttctccagcctcaccttgtactatgttattgacccccacccctccccacctcacctgtgggtctcttgtgtcaccctgttccctcctgacttggggctttagcataaattattttctcctggagcatcccccttcttccatgagtttatgttgaattattctacaggcctcagctcactaattgctttctctaagagagccaacaactcttcctaataggtgggaaacccctgtcataagcccttccagcaacttatatctctttcatagcactaatatttactgttttatacttactgtgtgagtctttgattaagctctatgagatagggatcttgtctgttttctttactgttatgtcccagaatctatcatagtacccggtacatggttagctctcaaaacattgaatgattgcttaactataaacccttaggtgtagagtttacagaatgtactgttttgccctttctggaaaatgggacatttgctcttggccagtctttgttctcctcttcttttccctgtgattttcccaagactactaaatttcagcaattccattttgaaagtcttaaagcatttcaaacatgaaatttatccaggtcaatggtcttgaattcatttaaagcctgtaggtgttcttcaagtcttggacttcagttccttccattcctttttcatgtgaagtttatttttcttggagttgaggacaataactcagaccacattttctgacccacatcaatccagcaaaatctaggtggtccccaacttctgtaagtttattttaaattcagttacttagaatttgcagttcagaaaatattaccccaaagaaaccgtgttaaaattgatctttatattttcatgaagatgtcttcaaaatccttttaaccaatagggtatctgaaatagtacagttttagtatgaactctgagtttctctgatcctattttattgaggcagggtcttgctcatcacccaggctagagtgcagtggcgtgatcatggctctctgcagcttcgacttcctgtgttcaaatgattctcccacctcagcctcctgagtagctgggagtagctgggactcaggcatgcaccaccacgcttggttaattttttgtagatgcagggttttgccatgttgcccaggctggtctcaaactcctggagtcaagcgattggcctgcctcagcgtcccaaagtggtgggattacaggcgtgagccagcgcccctggctctgatcccattttagctctgtttttctttttctttctttctttttttttggggacaaagtcttgctccgtcgcccaggctggagtgcaatggcaagatcttggctcactgcaacctccgcctcctgggttcaagtgattctcctgcctcagccttccaagtagctgggattacaggcatgtgccaccataccccgttaattttttgtatttcttttttttttagtagagatggggtttttgccacgttggccaggctggtctctaatgcctgacctcaggtgatccacccgccttggcctcccatagtgctgggattacaggcgttagccacccagcccagccttagctctgtttttcaatctgaatccaaagaccctcatattaggaagggctgggagtttaggaggattggcagtgctgggagaagtatcaagtagctggtagaagatacattgggttgatactggatttcctcccttgtggaaggattctgaaggtcaagggtagggaggcacataacatatttggtagtttgaaatttttatgctagtaaattgtgtataactcatgataatcaaatatctgtttgatttaataaggggggactgaattataaaggatggattgataaatcaagttactctccacttttgggagaataaagcaaaatgaagatcctattaattatgggtcagatggtcccatctagaaagaaaactaagtaggagtgcttcatctccttgcttgtattcagcatggagaagtctttacaaaagggtaattaattagggtgtttttcacaaggccgtgccttccatagaaatggttttcttctgtatgtggatcttgagttttaagatgctttccaaccatttgaactctcttattataacagaagtttagtcatgtaccaaatgtattcctatgcaattttcagtgacaaaatggttctctcatttggatgtgtaaaaacaatgccaggaacaaaaacaaaactcatgattcaactgattttgtactctctttgggaagaagaaaagacccgttgagatgaagattataatttcagtaacaaagaaaacattcaaggcccaggcagctcttaaattcaatactaataatctatgaaataaattataagcctacgtttctgtcagttctttagatacctgcttgtttgctaatacagaaacattgcttaattttacatgtattttcttagtgtgagtcaaatccaacctaaaatgcatttggttatttgtttacacagttagtgactggtaatcaaaaacgcaaacaatttttgagggagttagaatcttcactttagtaggtaccttagagggcatctagtttagtacaggattcctttctaccagggacaaactgtttacagaggccccttcctgcctcttgcgaggttcctccttgtctgttctgcttcagatatacaggccttctgtgttccttgaatttatcaaactctctaagactctttgtactgccttgaacactcttctcatagccctggtggcttggaatttttacatgggacagatttctctgaaatactgccttctcagacaaccttccccagatctcctacctaaaggacctctccccttcccaactgccataactctatcataagactctgttttatttccttataatacttgtcactgtctgaaattatcatatttattgtctatctcctttagctccatgagagcaggagcatggtccatgttgttcaccgctatatcctgaagtatctacaatagtggctgtcccattgtaggcatctgacaagtatgacaaaaatgagaatgaatgaataaccattgatgattgatcattttgttaatgttaaaaccaaactctgtaaaatattttaaagaggtttattctgagctaatgtgagtgaccatggtctggggaacagtctcaagagccctgacaaaatatgtcctaggctatcagattgcagtctgcttttatatgttttagggagagaattgtaggtaaaatcatcagtcagtacttggaggatgatgtacattggttcagccaaggtagtgggggatcataggtggattaaaggattttctgattcgcagttggttgaaagagttaagctttttctaaagacttgaagtcagtagaaagaaatggtaaagttaagataagggggttgtggaggccaaggttcttgttatgtagtaaagcctcataggtagcagctttcagggagaatagatggtaaatgtctcttttcagaccttaaaggtgtcaggctctcagttaatgtctcctaggttgggggaaaggcccagaaagggaaggcttggctgcactatggagattctgttggccccgtgacagttattttaaaatatgtcaaagaaatatattttggggtaaaatattttgattgccttcagggtctgctatttgtcatgtgatgctataacacagtcagattggaaagtaagccacattatactttatactaggttaatcatctctgatgaggctttatggtttgtagggcgtgacttaacccctgctttgcctgaccttaggtgttgtttataatttgttatcttattgccacagtgtctggtttgccagtcttaggatcgccatccaaaaagagggagtataacgaggtatgtctgacctctcttcctggctgggaattcagtttttcaggtttctctggggtgcccttggccaagaaggagtttgttcagtcagctggggggtttaggatttttttttttttctttttgagatggagtcttgctctgttttccaggctggagtgcagtggcgctatctcggcttactgtaacctctgcctcctgggttcaagcaattctcctgcctcagcctcccgagtagctgggattgcagacatacgccaccacccccggctaatttaggattttatttttggtttacatgttccaatcactactgagctgaaatttgtctcctttttgcttctactactgaacttagttctgtcccctggaataaatcactggctcgattccattttttccaaagtcttcagacatttggatgtcagtcatctctcactgaggccaaactcacctggtttccttaccagttcctcatctggcatggttttaggtgagtggtcactatccaggttatcagttgttggcaatttttggttttgttgttgtgatacccagcactaaacatagtgcattatgtggtgtcttgaacttccgagagagagaacagttaaactttcttgtttaatgtgatactgcaatgctttgtctttgataaaaattattttttaataccatataaatgacgaaggaactatttatatatgaaatcattatcagaaatattctgaggtcttaaaagcttgttttataatggaatataacaacgtagaaatacattaaacataagtatatactctaatgaacaattataagtgaatgtctatttaaccatcactcaagacatagaaatagtgccccaggaacccctcctgtgttgtgttgtgttgtgttgtcttgtctagcctttccctttccctttctctttccctttcttccttcctttctttcctttctttctctgtcaccccggcagtgcacagtgcacagtgcacaatcacggctcaccgcagctgtgatcacctaggctcaaggaatcctcccacttcagcctcccaagtagctgggactagaggtgttcgccaccaacgcccagctaattaaaaaaaaaaaaaaaaagttgttgtagagacaaggtctcattatgttgcccaggctggtctcaaactcctgggtttaagtgatccttccgcctcagccttccaaagtgccgcctcagccttccaaaatgccgggctgccatatgtcttttctcaatctcagtccctccttagaggtaattaatatcctgatttttttacaataaacacttccttgatcacttttttatacagttaccacttacatgtacatacttaatatagtttatagttcagctttgcctgtttttaaactgtatataaaagaaacaatgctgttgtatcagttttctgttgcataataacttaccacatgcttagccatgttaagacaccatatattattagctcacagttctgtaggttcccagcctgatctttttattacttgtgttttctgtttcatgaatttttgctcttactcatttctttcttcacattttcattgggctcattttgtgtttcttttgtttagcctcttgagtttgatgcttagttcatgtttccagtttttagtattttctgatatatgcatataagattctcaatttcctccttaagcattgttttctttctatagatttgtatttttgttattgttaagtgtattatgttttcttccttgattgacatatggattattttgggagtgtatttatttccaaacataagaattattttctaactacttcttttgtgattgatcaactttagttgtggaaagagaccatccttttacttcagtccttgtaatttattttatttatttatttatttttgagatggagttttgctctgttgctcaggctggagtgcagtggcgccatttggctcactgcatcctctgtgattctcgtgcctcagcctcctgagtagctgggactacaggcacgtggtcatcacacctggctaagttttgtgtttttagtagagacaggatttcaccatgttaaccaggctggtctcgaactcctggcctcaagtaatctgcctacctcagcctcccaaaatactgggattacaggcccgagccactgtgcccggcccttgtaatttattttgaattgctttatggcctagcatatgatcagtttttgtgaatgttgtatgtgtgcttggagaggagaaaaagatattttgcagttctttgctatagttgatatgttcatttggtcaaattttaaaaacatgttcaatgtcttctttatcctaatatttttctctttcatttagttctctttttttgttatgctctctatctagcattctaatttatttttatagtttgatctttcaccttttggaccttttagttctgtcacaatgttcagtctttgtttttttttttttttttgagatggagtctcgctctgtcgccgaggctagagtgcagtggctcgatctcggctcactgtaagctccgcctcccgggttcatgccattctcctgcctcagcctcccgagtagctgggactacaggcgcccaccacaatgcccggctaatttttttgtattttttcagtagagacagggtttcaccatgttaaccaggatggtctggatctcctgacctcgtgatccacccgcctcggcctcggcctcctaaagtgctgggattacaggcgtgagccactgcacccggccagtctggtttttattgcatcaaccctaccgttgttttgtaggctattgctgatcatttataggctatccctgacccaaagtcttttgggatcattttctttttcagttgtttctattggttcttgttcgtggtatcttaccttgcgtgtttggccatctttgattatgtactgcacattgtaaatgagaaactatctgtagcagtattgtgaggcctggttgatgccatcttccctcagagcgttgctttttttctttgtttcacccagacaactggtggctttaacaatctgaatgtggaaccaccttaatccaaagtacatttaaagattttatctagatcgcccagatgacataaacctacagttcaagtttgtccaagggctgatttatttctgttttttcttatcctgggagtatattctggggttttggcttcaagtgagtggtgatttatcaaactttctccttatttataaaaattttatttttaatgattatagctacttaatagttgtatatatttatgggatacatgttatattttgatacaagcatacaatatgtaatgatcagggtaattggggtatccatcatttcaagcatttatcatttctttgtgttaggaacctcccaattccactcttttagttattttgaaatatacaataaattattgctaacaaactttctcattttgagacacccttgactttgaattttgtgttccttgatctctaacgatttcaagagcaaacctgtttttctctcattttctggatcttcaaataccagaaaagctaaaatagttttgggtggtttggattatctctctggattctattcttttgctttgattgctttgattttagccaggtaattcttcacaatcttgttaagtgtttggagcttttaagatgtttctgaaaagtattccctctagcatttgtatttgtctgtaaagggacatttcatccaagatatgtagtttgccatcaccagaactaaaacgttttagtttttatgccttaaaaaaaaagattaatcagttatattcatataaaattgcagctaaatccaatatggcataatttttttcttcagtatgaatactggtatttaaaagaccattcttgacatccaagataagtatccactcacatcattattattttttttatttgttttgagaccgactctccttctgttgcccaggctggagtgcagtgacgtgatcttggctcactgcaaccatcacctcccaagctcaaaaaattctcgtgccttagcctcctgtgtagctgggactacaggcacccaccatcacacccggctaattttttggtattttatctggagatggggtttcaccatgttggccaggttggtctccaactcctgaccttaagcagtctgcctgcctcagcctcccaaagtgctaggattacagacgtgagccactgtagccggccccactcacattctgattcccagtttttttgtttgtttgtttttgtttttgagacggagttttcactcttgtcatccaggcttaagtacaatggcaatatctcagctcactgcaacttctgcctcccgggttcaagtgattttcgtgtctcagtctcccgagtagctgggattacaggtgcctgccaccgcacctggctaatttttgtatttttagtagagacggggttgtaccatgttggccaggctggtctcgagctcctgacctcaggttattcaccctcctcagcctcccaaagtgctgggattacaggcatgagccatctcacctggcctaattcccagtttttattactcagttttgactgccacaaagaatagtgagaccaaatgttttttttaaaaaatttttatttttttttatttttttgagacagtctcgctctgtcgcccaggctggagtgcagtagtaagatctcggtttactgcaacctctgccttccgggttcaagcaattctcctgtctcagcctctcgagtagctggcactacaggcgcgcaccaccatacccagctaatttttgtatttttagtagagatcgggtttcatcatattggtcatgctggtctcgaactcctgacctcaggtcatctacctgccttggcctcccaaagtgctgggattacaggcgtgagccaccacgcccggccacaaatgttctttacaaatacttttatacagaactttttgggtcttcttagtgagaatgattaatttttatctcaagtttcctttgaaatgaaccataccattattggcagagagtagaatatttaaatatttcctgagtgttctttcaaaccagccgtagaaaatgaaagagtgattcgttttcagaaatgctctgagcatcttttaccaggaatgtgactgacatagatcctcatatagctggctccttgtcattgccatctcagctcaaatgttacctttttagagaagccctccctgtctatcattctttttccctctttcataacaaaatacaagataatagtctcgtattttttctccaccagcaaaatgtaaagttccatgagggtaaggaccttgcctgtcttgtttaccactatgttgtgtgtcttatcctgaaaacatgggaggcagtcagtaattatttgcttaatgaattaataaatatttcatctcaaattgtgacatctttttctctaaatatcagaataatccttaaaaaatttttgattccagtgaactaaagttttctaagctaagtatagcgaaaggaggtcagtgtagctggagtgaagctagtcaagggagagtctagtaggagatgatatcaggaggggaggtcaaggcctgtggctcatgtggattttgcttttcactcttaatgatatgggaggccattagagggttttgaatgagaagtttatgagaagtgacatggtctgagttatcttcaagagttactctgacttctttaaggtctgtaggaatctgtagggatactgaagtatggtctattctgggctctcacatctgttctattggttatttatccgtgccagaaccaccctgtcttaatttccctcactctattataatcctcaacctattcagtagggcatcctgccagatcctaccctcaaagcctagtgctcttgtaacttttcttatctttcttactcttttctttttcttattctttgctgctcatacttgtagtaggagggtgttgcttctacttggaactctgcccttccatatatattttaaaatcagcttgtcttaattctttagaaaaccttgttgggattgtgattggaattgcattgactatatagatcaatatggaaagaattgatacctttatagttttgaatcttcctagctgtaaaatttggataacttatttacgtgttttttaatgtcttgagtaaagttacatatatatttgaaaagtcgttttgaatatcttttgttaaatcttaggtgctttttaaaattattgtaaatgtggtttgtttttgtttttctttgagacaaggtctggctctattgtccaggctagagtgcaatggcacaatcttggcttactgcagcctccgcttcccgggctcaaaccatcctcccatctcagcctctggagtagctgggactacaggcatgctctgccacatgcagctaatttttatatattttgttgaggctggattttgccatgttgcccagtctggtctcgaactcgtgagctcaagcagtctgcttgcctcagcctcccaaagtgctgtgattataggcgtgagccattgtgccccgcccataaatgtgatttttaaaaattgcattttctatttcttacaaatgctctttacagatgctgctgatatttgtgtattaagcttatgttcagctaccttgccaaacactaataattccaataatttatgaattcttttgaattttctatgaggtaatatatgcaaattctgttttcgtttccctcttttcaatcatacattttattcatttattgtttcttattttactaagccagctataacccacaaggatgtttttgttttgtttttgtttttgagacagggtcttgcggtgttgcccaggctggagtgcagtggtgcgatcacggctcaccgcagcttcgccctcctgggctcaagcaatcctccctcctcaccatctgagagtagctgggactacaggcgtgcacaaccacacccggctagtttttgtagtttttctagagaaagggtttcaccacatttcctaggctggtcttgaattcctgagcatgagtgatccgtccacctcagcctcccagcagcctcccaaagtgctgggattatggacacgagccactgtgcctggctaggatgtttaatactaatgttaataagtattaatagtagaactccttgtcatgtttttgtttgtttggtggagacagggtctcacactgttgcccaggctagtgtccggtggcgcaatcacagctcactgcagctttgacctcctgggctcaagtgatcctcccgtctcagcctcccacaaccatgcccaccaggctaggttttttttgtttttgtttgttttttttgtttttgtagagactgggtctccctgtgttgctcaggctggtctctaattcctgggctcaagcgatccttctgccttggcttcctaaagtgctgggattatatgcgtgaaccatggtgcctgggcacatgttcttaagttttaaagggactatgtctactgcttcacatttaagaatgatgtttgttgtaggtttttgtcagatgcccttatcaggatatgcacattttaaaatcacctaattatgtatatattgctttttagaaaatttgcaccaatttacatttctaccatcagtgtatggaagggcactccttgacaatacttacccacatcacatggggtattcttgttaaaagtttcagattttggccgggcgcggtggctcacgcctgtaatcccagcactttgggaggccgagacgggcggatcacgaggtcaggagagcgagaccatcctggctaacacggtgaaaccccgtctctactaaaaaaaatacaaaaattagccgggcatggtggcgcgtgcctgtagtcccagctacacgggaggctgaggcaggagaatggtgtgaacccgggaggcggagcttgcagtgagtcgagatcgcgccactgcactccagcctgggcgacagagcgaaactccgtctcaaaaaaaaaaaaaaaaagaaagtttcagattttataggcagtaaggaacttcttgtttagatttgtttcttccttttaaaacaatattttgtgttgttaccactgttattcttagagatgggataagctttttgaaacaaagcttattttgaaaatatttcagatttagagaaaaactgcaaaaatagtgcaaagaatttcctacttcctatacccttgacctagattttccaagtgtgttaatattttatcatatttgctttatcattctttctgtcttttttctcttccctcatacacacatataatttttctcagtggtttaagttgtaaacatgatgcccctttaaaaactttagtgctgtttcttaaaaatgagagcattgttttatataaccgaagtactaatatgaaaattagaaaactactgacaacagtactataatctgtgaacatttgaattgtatcaattgttcttcatagcgaaaaaagaacaaaagctttttcttgtccaggatgtaatccaggatcatgcaatgtatttcattgtcatatctcttaatcttctttaatctggaatagtcgcttcttgttactcagttgtttcttgtctttcatgaccttgacattttaaaagaatatgggccaattatttagtaaaatgtccctcagcttgggcttgtctcttgcttcttgtgattagattcaggttttgcatttctggcaggaatgccacagaagtggtgatgtgatacatcctatcagggggcatataatgttggtttgtccccttattgatgacgttaacttgatcatttaattaaggtggtgtctggcaggattcttcagtgtaaaattactatttttcttcttgtaattaataggtatcttgtggatactttgagattagataatatcctgttttccatcaaattttcaaccactagttttagcatgtattgatcatacttgcttgaaataattattaccagagtgattgccaaatggcgatcttctaattttatcactacatttattatttggaattatacttcgcaaaagagctttctcttctcccccatttatttatttatgtcagtaaggacttttaaaaaaattatatgggttataatctgttactgtgcttatttactttgttgctcaaatattcccgattaggccagtgggagtcacatcagtctgactcctgtgtccttttgaggtacccctatcattctttgagcatttccttactttctggcaccacaaaaatatgccctaggctcctatggtccttctcctgccccacccttggaatcagccatttcttcaaggaaccctagttccttttatcagagcaccagctgtgttcatagctataggggtatcattgcttctaggccttctcagcagacagagctaggaaatatatgtatgtgagtgcacatttacacaaacacctttatatctgtctatactcctatatattaaaaactgagcttatattgttaactccaactccaagccttctccctttttatatttgttactcccttttatgagaataagaaaccaaggtcagtatattcacagaatatttacctatttgcccaatcttagaacacacacaaacaagtttcatgtcattgtataaaagcaggtagctaagtagaatatagtatttgtttataattctttttatttttagctttaggagagtagatagtgaaaatgctgtttttaaaagttagctgtggttaattcatttgtccttgtccccaaaagtgtggttatattattcatttcaaatacagagaggttcatttgtttgtattcattccattttgggttcttcgctcctattactgttggtttcttcttcattttaagtgtataaaacattaaaatggattgaaaaataactctacaaaaaggtaagattggttactagagtactgcaaatataaaacttacagcttttaattgtgtttgtttttttcagggagtcatttaatacttcatgattagaacaaatatgtgaaagttcccaccaaccagtgagaatttcttccttcagacggttttggatcttactgcacagctttctgagaagttcttttggtgccatgttttgtggcttgcatcaaaagaggagtttgtcttcatgaagattcctaacattggtaatgtgatgaataaatttgagatccttggggttgtaggtgaaggtaagttggaatttttgcgttccttgagttttgagcaatgaacagttagttattcctaccaccaaaaagttactaattagatcctgttaatttaacctatatcaattcacatgtgtgtctaagagtaaaatattaaaaataaaattactcttaaacaatttgggtctcactctccaataaaaaattaataactttttaaaaccctttaaagtttaataaatcaaagatttttttcccttttcttttaaaaagagccccagtgttacaacagtctttgccttcattctttttttttttttttttttagcaatcatgagttccttagtctgcattttttttcttggttccattttatttttatatcagctaggcttattttgaataacttaaatttcattcattcattcattcattcattcattcattcattcaagacagagtctcactgttacccagactggagtgcagtggcatgatctcggctcactgcagcctctgcctcctgggttcaagcgattctcctgcctcagcctcctgagattacaggcgtgagccactgtgcccagctaatttttgtattttcagtagagactgggtttcaccatgttggtgaaattttacttaatacctggtaaataaacaaataagtaaattctgtttctttgaaaatgggagactatgttttgtaaattctgaggcatacaattttatctctgaaatcagggtgtatcttataatcagtatcatgtcacagtttaattggcagcattctccctttcctaatagtacataaaataatgctcatgaccaatgatataccattgatttgatgaaatatgatgtcattttgtataaactgactcctaaaaaaaaatcatttcttctgatttttcctgcttagtgatttttgctctagacttaaagataactttggaaattttgataaatgattctgttaacagaagataagtgattataattatggtttcttagcatttatatctttaaagcatatgttacaaaaatttcatatttcagaattttcaaataaactctgaattcctaaaggactaaaaaagttcacctatgtgaacagcaaagctgttattaagttttaaagttggcaaatcctttcaaatacatagaaacaattaaaataaagagtttaatcattggatgcttgtttcaaggtctgaaattcaaaccatacaaaacaaataggtctttgttccttcactagtcaactcctcttccatttcttcatcgatgttatgtaaaaatttcattttcagtgtcttgcttaccatctgttctggaatagcctattttatttttcaaaagtattagaattagagaccaatgcaataaagctgctgactggagaaggctagcacatacggtgtaacaaggttagaatgctccagattctgggcctaagtttttctggatcataactagtttttctcattatagccataggtgatcatcttctttgggattggctcaaaattaccagactgttatatatatatatatatatcagaatatgttactttgttatcagaactaccattgctgtatgtttctttctttggaaagcacctcacatgtatttttggctaggatatacatataaagtatataacaatctgtcaccaggaacggtgactcatgcctataatcccagcactttgggaggctgaggtggtggatcacaaggtcaagagatccagaccatcttggccaacatggtgaaaccctgtctctactaaaaatacaaaaattagctgggtgtggtggcgggcgcctgtagtcccagctactcaggaggctgaggcaggagaatcgcttgaacctaggaggtggaggttgcagtgagtgagcttgtgccactgcactccagcctgatgagagagcgagactgtctcaaaacacacacacacacacacacacacacacacacacacaggttgcagtgagtgagcttgtgccactgcactccagcctgatgagagagcgagactgtctcaaaacacgcacacacacacacacacacacacacacacacacacacacacacacacacccctgtcaagcaaactctgcattcttgtagtttagacagtgtattttttaccccatagaataactggcataggcagttagaattggacaattgcctggcaattgtggagttaagttagatggttataatggctggttctatgctaactgtgataataggattcatccatctctaccaaagtgagggagacttgttcaggtcccatagactgtgttggagacacatttcccaattttgtatccgtgaagcccccttctcatagatgaatgcaggcttgccagtctgctaatgttaatgttcttgatgtttctgcaaagctcagctatcattcattacattttgattctcttaattagatttttcacattataattttaacctcagtttcctgagtactttgctgtcaactctgtcctacttctaaggaagaagtctattgcctagataataggataagtaaccccaaaggtagttacttgttgaaatacaccaaagacagtgggagtgcttgtcgcctttgtgcatgaactgagtctttatttatggcaaaaggtagcaaatcctactagctattaattggaatactgaggcctggactactttgccagtcaggagagacattcagctgggtgtggtggtgcatgcctataatcccagcactttgggaggctgaggtgggaggattgcttgaggccaggagtttgagaccagcctgggcaacatagtgagaccatgtctctacaaaaaaaacttaaaaaacaaaacaaaacagaaaaaaaaaaaaaaagaggggcatttcagtatcctagaggaagattttaatgtcttctagaacagataatgtatttggtgggctctgtgcttgagcttactactgggatgtcattagctcttaaggtttttttgtttgtttgtttgtttgttttcgagatggagtcttgctctgttgcccaggctggagtgcagtggcgcgatctggactactgcaacctctgcctcctgggttcaaacgattctcctgcctcagcctcctgagtagctgggattacaggcacctgcaactatacccaactaatttttgtatttttagtagagatgggtttttgccatgttggccaggctggtcctgaactcctgacctcaggtgatctgccagcctcggcctcccaaagtgctgggattataggcgtgagccactgtgcctggcctagctcttaagttttaagttccacagaatcttctgagttaattttcctttattctcaaagttcttgagaccaaatcttgtctccataaatgtgtaaccctacatttaaacgtatcgccagtgaaattttctttaaaaagaaacatttaaaaatacttgttggaagaaatgacttgtctatactcttgatttataataaatgtataataaagtatgttccatttgtatgtggctcattattgcattatcactatagaatcttgtcactttagtagtcattattataacactgagaagcaatgtcagtatagcagagctttgtagtttgtatgcgtgcccttgattgtttacttctttttattataggagcctatggagttgtacttaaatgcagacacaaggcaagtacattatttttaaaaagaaatatctgtatatgtttaactgttttgaaactaatgtagtggtctttgcgtgtgggcatgtacaggttgagcattccttatctgaaatgcttgagaccagaaatgttttggatttttttggattttggaatatttccatatatgtaatgagataccttggggatgggacccaaggctagacacaaaattcatttatgtttcatatatacttaatacatatagcttgaaggtaattttatgcaatattttaagtttttgcctaaaacaaagtttaaatacttatatgtggaattttccacttgtggcatcatatcagtactcaaagttttggattttggagcattttggatttttgaattagggatgctcaacctgtaattaaaactctggttatgaggatgttgtttaatgaagtggaattaatatgtgaatgctgccagaaagagactacttttagataagcttgatcatggttgggtagtccttagttcttagcaatcacgtgctatttttttttttcaactgacctatgccgtgcacctcataatgacatttagatcaacagtggacagcatgtatgatggtggtcccgtaagattatgatatggtattttttgtttagataaaaaacattttcagatacacaaatacttatcattgactatggtactcagtaaggtaacatgctatacaggtttgtagccttgaaacaataggctataccatgtagcctagatgtgtagtaggctataccatctaggtttgtgtaagtacactctatgatgtttgcacagtgataaaaatcacctaatgacatatttttcagaatgtattcttgtcattaagtgatgcatgactgtataagtgaaaagctgcctaatgggaaaagagaaaaggtggtgggacaggaataagaaggcagggcagtgacagatttaatttatgttcaagtacttatgagcaaagagtttttttaaaaattatttttcatgtagacccattaacttagattgcttgatgcatttgaatccagattttgaagggtaataaggtaggtgtttggatatgagctagaacttgggataatagtgtagattatgattactggctatagttgattacccttgaacagctgtgaaatgaaccttactagaaattattttactatggtaataatcacaaattattcagagaagttatttgaagtttccatagctgttattcagttgtaagcatgttttactgggagagtaactttcagatggcaagtgttgaaactgtaacaaacattagtttaaatatttttctattatggcatacctagtctgagtatttggcttcatttgcatataatttgttaagaccaaggttttaagttttttcgtgatgtttcagaatgatataatttatgtctgtggtgattttagcaatttaacccaaaacatttaaactcttgaatctgtcgtctattgaaaataatgtatgtgtgtgtatgtatgtaaatatgcacacacataaataaagatgatactcttatatttgctttttctttcctattgtacaaaatactacctgccttttgaatttaagccttcgtgacacttaatatatttttgtgtttagatcacagatctcttacttccatgcaatggcttttgtattcttcttgaaattgggtgattgaactattttatgttaataatagttatctgaagatctctttgccattaaattttcaaaaatggttcgaatactattggttcttgattaaggatgattaagaatttaaaataataaatataataaaaataaatttagcaccttgaacaccttgttaagaaatattactgtagtttgaaattaaacaaatgaaaagctccctaataaaatgctaaatgctatacttttaatgacttgcctttagttataagtttctgaagcttaaaaaaaattcctgggtggatattacttgggagaaataggttattagtttctaagttaaatttgactttttcccgaacataaaacctccttttatacaatggctctgtttatgcaacattgcaaatggaaacttcagttcttacttctaatcttgggttttaaaactcaaagatttatgagatatgtacatatcttacatatgtacatacacatatgcatacatgtattatacgtatacatatatctgatatatattacacatcatgtacagagtccaaatgttttctcctagtcattgtcatacttcaacctgtgaccttttcctctatactttcatgtaactttaagctctccttctgccttttatataaaaatagtttattatttaaatatgttgtttttatctttctatttactcatttgttaaaatggttgtttcatatacctggttctcaaaacacacactgttagtgccagcaggatgggcccagtgtgaaagtggatgagaatggacatctctactcttaggaaaccaactctaaatgtgaactctgatttttagttactgtgtgtagggaactttgaattacaaggataaataaaccatacttttcttgcctttatatggcttatggtctgtctgaagagatagaagaatagataacttaaaaaaaaaacaagtctgtgaggttgctgcaaatgagatacatctaaaacatttctctctttgctgtccttcactacatgaggtcacacaccagctctttaagtattgtagctttctccttgcatgtgtctaaaaagatatcactggatggaaaatttaaagcataaattagtgcctatctcagagtattataaaactcttttttagaatctgcagctgtttagtcattaggcttgttatagatagtatatccttttctcagctaaaatcagaccttcaaatctataccccattatccaaaaatagagaatttgatgcttctggcaagattgatgctttagggtcaaacaaatggattattatgaaactcatattataattaaaaatgtatgtaatcttcccgattgtacttatgtaaagtaatcaggccaatatcttttgcatacctttaaaaatttagtgaaatgtttataaaaatgtataagtcaggtctgtgtgattgtttatgcataaattgggtatctttttgaaaaggttgactgggggtgtatatataattaattcttagcatgttgtatatttgaacaagtatagaagaaagtcacttttttaatctgtgtactgttgcagtaattgagagatcatgctgataaataggtgtattttgcttttgtgcatagaatatgatgttgggctgatccagaccaaagatcatacttcctaatttactgaaattaatgctgctcaatttcaaaggaaaaatatagcttttactttttttttgacagctgaacaaaattaagctgtatatatttattgtatatataataataagttgttatatatacacattgacatgcatatgaaaactcttagcagtgactaagcttctttttaggactcattatgactactcacatttgaaagatgttctaggctgggcacagtggctcacgcctgtaatcccagcaccttaggaggccaaggtgggcagatcacctgaggtgaggagttcaagatcagcctggccaacgtggtgaaacctggtctctactaaaaatacaaaaattagccgggcgtgggggcgcatgcttttagtcccagctactcgggaggctgaggcaagagagtcacttgaacctgggaggcggaggttgcagtgaaccgatatcgcaccactgcactccagcctgggtgacaagagtgaaactccatctcaaaaaaaaaaaaaaaaagatattctggtttggacctttaccctgcagatatgcatagttaattatctttttatttgtatgtgtttgttttttttgttttttggttttttttgtgacgaagtctcactctcacccaggctggaacgcagtgatgtgatcttggctcactgcagcctccacctcatgggttcaagcgattcttgtgcctcagcctcccgagtatctgggactataggcgcgcaccaacatgcccggctaatttttgtattttcagtagagacggggcttcattacgttggccaggctggtcttggactcctgacctcaagtgatctgcctgcctcggcctcccgaagtgctgggatttacaggcgtgagccaccgcgcccagcctcgtgtgtctgttttaaagtgcctgtgaaataggcatgttttgtagcatgctcttcttagcaaaaacacgaaaaggtcatgcttacaacaaggcaaggataattgaatggggttgaaataaagacattcaattagaacttgaggaaagtgggcttgtacagcttgatagagagaggctggagggtgatgctcattgagcccaggacaggaaagtggtgattcatgtaatttgtttcctgtgactatggttgacttatgagaagtttttgtttgttttgaagcagtaggtgacatatgcttttgagatagctagttatacaaagctgtgaacatccaacattggggtacagcctataagtgttcaataaataataatcttacgttagagaactgaaaatgaaggatgcagtagagagctgttgcagagtagcagggacctggtatgtgtggagggatgaaagatgatcccagggacttgaatgtggtaaactagaaaagctttggtattatttatcaggctgggaaacttaataaaagatatatgagtttggggggagaaataatgagtttggctttaataaagaataaaaatggcagcagaacataaaacctagtattaacaaatactacctattgagcatctaccacatgctagacactctactagatgtctcaaccactacaacaagataactctattcttagcctcattttacacatgaggagactgagtcttagagggtctgtgtaatagggccaaaatcatgtggctgataaattgtggaactaggctttgatctgactccagaaatagctaacttgagcatgagataggagccttctcttctcttctcttttccttccttccttcctcccttccttcctttcttctttccttctttctctctctctctctctcactgtgttgcccaggttggagtgcagtggcacaatctctgctcactgcaacctccgcttcccgggttcaaacaattcttatacctcagccttccgagtatctgggattacaggcatgagccaccaccatgcgtggctaatttttgtatttttaatagagatggggtttcaccatgttggccatgctggtcttgaactcctgacctcaagtgatcagcctcccaaagtgctgggatgacaggcgtgagccattgcgcctggcctacgtttttttttttttttttattgctaaacaattttaagaagatacttgaggaaaaagatctgtctcctcttagagaagcactcatagagaaccattgtgtgtggtttctgctcttgtcctgggttttgttgctgatccaattaattgtagaacagtgcctggaacgctgaaatagtctcacccaaattctaattctttgtattttaatattttgtatttgagattttgctagactgttgataccggaaaaactacaaatgctgctgttgtctttttttttttctaataagataggatctcgctatgttgaccaggctggtctcgaactcctggcctcaagcaatcctcccatcttggcctcccaaagtactgggattacaggcgcctggccacttgtgttgtctttttatctattaaagaaataatgggtcatgtgtcattttccatgctgatctgactttttgtttttttgagatgaagttttgctcttgtcacccaggctggagtccaatggcgctatctcggctcactgcaacctccgcctcctgggttcaagtgatctcctgcctcagcctcccaagtagctgggattacaggcatgtgccaccacactgactaattttttgtatttttagtagagacagggtctcaccatgttggtcaggctggtcttgaacccctgacctcatgtgatccacaacgcctgggcctcccaaagtgctgcaattacaggcgtgagcacctggcctgacctaacttttttagggagctagaagagttttgggcctttgcaagcctcctgtttgcctttatcctcatcatccgaatctacatttagtttattgtttgtgagttttttagtaaacagagtaagggaatggtcatgttacaattagtattacctctttctactctgaaaacttttcctcattcctcctttttacagtgattcagttcctaaatcatcgtttccccgctcacttctagaggatgaattggctggaatgcttttccagtgtaccactttcaaatccttgggattatctttcatccctcttcagggactgagttcctgctactctgcaacagctctctactacatctttcatcttcagttctctaatttaagttaacattcttatttattgaatacttatagttaactttaaagtccttttatggtaatcataaaaatataattagttcaaagaagagaacatctcttctgtactataaggtgaataatttcattaggctctgataaatgtgcttaagtgatttatactagctccttaatgccacttttcttcaaaacttcagaaacaaaaatgagtgtgaatcatttttccccccacaggcctgcaatatataggcactgatgaacaaatacctatatagtggaaactcttgagtaatttaagcatagctctttatcagttgttgaaacttcttcaaagtagtgcatggatcccagcactttgggaggccaaggcaggcagatcacctgaggtccaagagttcaagaccagcctggccaacatggtgaaaccccatctctactaaaaatacaaaaaaatttgctgggcatggtggcggacacctgtaatcccagctactcaggaggccgaggcagaattgcttgaacccgggaggcggaggttgcagtgagcggagattgggccactgcactccagcctgcgcgacagagcaagactccgtctcagaaaacaacagagtagtacgtcgtgatctatttctacataaaaagtaatccaacactgatttactgtgtaattagaagctgtagttcatattttacaatttaaaggtgtatttcatatattaaagcattttaatttaaaaaaaatcaacttttttttttgtttttaaagttacttcctatacttaaaacactgtgttctaggcatgacatcataaagtaaaattcaaccagacatctaaggaaaatctgttgaatgcctatcaaatatcaggcacttagctaggcactgactacaaaaaaaaataagatgtaatttttacttttaaggaatttaacatggataaattaacaaatataaagtcatgttttcttttcttttcttatttttttttttttttttttttttttttttttttttgtgacagagtctcgctctgtcgccaggctggagtgcagtgggacaatctcagctcactgcaacctctgcctcccgggttcaagtgattctcctgcctcagcctcccgagtagctgggactacaggtgcccgctaccatgcctggctaattttttttatttttagtagagatggcgttttaccatgttggccaggatgatctcgatctcttgacctcatgatccaccctcggcctcccagagtgctgggattataggcgtgagccatcgccccagccctaaagtcatgttttctgttgtcaggaagtttaacatatagtttgggaggtgaatttgagataagatggtagttgacatgatagtgtgaaacctttcccttttttttttttccaataaatttctccattgaagcctgccttaggaaaaattcatgtcaataataaagcgggaggggaaaagcatttcccagaaccccacatgagaactaccataaagctgggaatagaattaaggagtaacattattagctgataatggactgaatgagaatggtatagtgagaacctctgttttacctctgtgtgtcagagggcccagaatccttggtgtagtaatgatggattgtagaaccttccccaaatggcacagttgaaacttgatccaggaagcccaagtcattgccgttaagactctaccatattaggatgggcaggagaacctctcctagctgtatagatccggagttggcaaactactgcctgtgggctctattttataaataaagttttgttggaatgcagccacagtcatttaagtattttttgtgcatgcttttgcaatacaatgacggttgagtagttgtgatagagactgacccacaaagcctgaaatatttattatctgactttgtatagaaagagtttgctgacttctgatattgagcaagccctaactaggagaatattgtgggaacagcgtagtggccttagtgaaccacagtcttaatttctatttgactctttgcccttggtgctctaagagcctgaggaataaggttaataaggtgggggacttcagtgaaaattacttttccgttgatctggacttgagtaaatcctttgaatggctgggcaggaagttttgtattggttacctctttcacgtgtcaactgtcacagcagagatgtggaatttgctgggtactgggcatacagagacgcatatagtctatttaccttctgtcacatcactggcctgcatagtaccctttccacccaaagacgaatacgaagaagaaaacagtcctcattgagattgtgaaaaaattcttcagctcaagagaaggacattctcataaatatgaagagatttatgagtgtaaaatactttggagaaaaatatgtgagattcaaaggaacgtaaataagaaattaagacgaaacagttaacttttgtttcaagtgcctcttccaggcgttgtgctagctgctttattttcgtgtctctttcaatcctcacattaaccataaaagttagaaggaattatcctcctcttatgtgggggaaactggtgctcgaataggttaatttcctgaaagccatacaagtcagtagatggttgagccgggaattagtcacattttaggctccccttctttcttaaaaaaattgaggtaaaagtcacataacatgaaattaaccattttaaagtatacaagtatgtgacattgagtacattcataatgttgtgcaaccaccacctctttgaagttccaaaacattttcatcacctcaaaagaaaaccctgtactcactatttaccccccattttcccttgcccctggcaaccaccaatctgctttctgtatttacctattttggatatttcatataaatggaatcatacaaatcatacaacatgtgaccgtttgtgtttggcttctttgacctatgttttcaaagtttatccacgttgtagcatgtaacagtacttcattccattttatgcctgcatgatactgtttcgtgttgtatgaatatacctcatcgtgtttatcttttcatcagtcatggacatttgagttgtttctaccttttgtctattgtgactattactgctatgaacattcatgtacaagtgttgtttgaatttctattttcaattctctggggtatataccccaaagtagagtggaaatgccatgtttaattttttgaaaaattgcttaaactgttttccacagcagctgccctcctttacattcccaccagcaatgtatgagagttccaatttctcaacatcctcaccaactcttgtttcctcctccttctcctcctcctcattgagacaaagtctcactctgtcgcccaggctggagtgcagtgtctccctgcaacctccgcctcccaggttcgagtgattcttgtgcctcagcctcccgagtaactgggattacagttgtgcaagccaccatgcctgactaatttttgtatttttattagagatggggttttgccatgttggccaggctggtctcaaactcctggcctccagcgatccacctaccttggcctcccaaagtgttgggactataggtgtgagccaccacgcctggccaccttattattactttttaattgttgccaccctagtggatgtagtgtggtatcttattgtggttttgatttccatttccccaatgatgagtgattttgagcatcttttcatgcgcttttggtcatttgtatatcttctttggagaaatgtctattccaatccattgagcattttaaaattgggttgtctttttggttgaattgtaagagttattcatataatctgaatatagattccttatcagatatatggcttgcaaatattttctctaattttgtaggttgccttttcactttcttaatagtgtgctagatgatgtacaaggtttttaattttgatgaagtccagtttattttttcctttattgctcatatttttaaaaccattgccgaatccaatgtcatgaagatttatggctgtcttttttttaatggtacagtagtatagttttagctcttatgttaggttgttgatccattttgaattgttgtttgtacagttaaaaattgttttaatgaaattttatttttatatatttaaggcgtacaagtacagttttgttacatgggtttatttgcgtagtggatgaagtctgaggtttttgtgtaaccatacccaaataatgtacattgtacccattaagtaatttctcataacgtttgtactgtttttgtatatgttgtgagatagaggtctaacttcattcttttgcttgtggatattcagttgtcccagcacctggatttgttgaagagatcattctttccccatttactggtgctagcacccttgttgaaaatcagttggccatagacatgtgggtttgtttgtggactctcacttttattcctctgggctatgtgcctgtctttatgtcagcacttcactggttcgattactataaatttgtggtaaatattgaaattcggaagtgtgagtcttccaactttgttattctttttcaatactattttgtctatcaagggctccttgcaattctgtatgaatttgaaattttttttttcatttctgggaaaaaaagctgttgaaattttgatagagattgcagtgactctgtagattgctttgggtagtactgtcatcctaactataaattcttccaatccatgggacctttccatatatttaagtgtttaacttcttttagcaatgttttgtagttttcagtgtgctagtcttttacctcattggttagatttattcttagatgttttattcattcggatgccttttttgtttttgaggcagagtcttgctctgttgcccaggctggagctttttttttttttttttttttttttttgagacagactttcggtgtgttgcccgggctggagtgaagtgttgtgatcttggctcactgcaacctctgcctcctgggttcaagcaattctcatgcctcagcctcctgagtagctggtattacagatgtgcaccaccacgcccagctaatttttatatttttagtagagacagggttttgccatgttggccaggctggtctcaaactcttggcctcacgtaatccacccaccttggcctcccaaagtgctaggattgcaagcgtaagccaccgcacctcgctgctattttaaatgaaatagctctgttaatttcttttttaagaaattttttaaagatttttttaagctattttaaatgaaattgctgttaatttctttttaagaaatttttttaagattgtttgttgccagtgtatagaaatattatcgatttttttttttttttttttggagacagaggctctgtcacccaggctggctgtagtgcagtagtgtgatctcggctcactgcaacctctgcctcccaggttcaagccattctcctggctcagtcccccatgcagctgggattacaggtgcatgccaccacacccagctaatttttgtatttttagtagagacagagtttcaccatgttggccaggctggttttgaactccagacctcaagtgatctgcctgccttggcctcccaaagtgctgggattacaggcgtgagccaccacacccggccccagtttatttttttttattgtggtaaaatatatgtaatataaaatttgccgttttaactatttctaaggccgcagtttgacattaattgtattcacggtgttacgtaaccatcactactatgtatttgcacatttttttcattaccccaaacaggaactctctgccaattaagcaataactctctaattcccctatccccagtagttgtaacttccaacctactttctgtctctgtgatttttgcctattctagatattttatataagtggaatattacagtatttgtccttttgtgtccgatttctttcacttagcatgatgtttttaaggttcattcatgtagagtatatcagaacttcattcctttatatgactgaacaatattggaacaacatataacaatattatatggttgaaccttgaaaacatcatgttcattgtatatgtatacaacgaacaaaatgtgttgtatacatgtaattagacatcatctattaccattgagtattcgtgctgttacctgtgggttttataaatgttctttatcaggttgaggaacttgccctctatttatagtcttctcatctgccatggatatgatatgtggggggagaatgtacaccacattttgtttatccatttgtttcttcgtggacacttgagttatttatacctttggttattatgaataatgctgctatgaacattcacatacaagtatctgagtccttgttttcaattcttttgaatatatacctaggagtagcattgttgggtcatatggtaattacatgtttaatattttggggcccactggtttttgtgttttgatcttgtattatgcaactttgctgaattcgtttattagttctaatatttttgtgtgtggattctttagaattttctctgtataaggtaccatctgtgaataggggtagttctacttatccatttacaatttggacaccttttatttcttctacttgtcaaattgctctggctagaacttccagtgctttgttgaatagaagtggtgaaagtgggcatctttgtcttgttcctgatcttgagaggaggggttttagtctattaccattgagtattcatgatgttagctatgggttttaaaaatgtcctttaacaggttgaggaagttgtcctctatttctagtcttctcatctgccatggatatgatatgtgggtaaaggtaggtgggcagtttaaaatgcacagtgttatcacaaagcagctacctctttcaccaagccttcctctggtagttgtgagtttttgaatacctgcagagttgtggaaaagttgattctgatactttttgcaagctcattagttgtttttgtggagggacagagtcctagatttcccagttctgccattttcagtgctaacactctccagatatgtgttttgcacatatttccttccagtctgtggcatgtcttttcattcttacaatggtatgtttaccagagcagaagtttttaattttaatgaaatcctacttagcaattttgtctttcatggacagtccttttggtgttacatctgaaacctcattgccaaactgaaggtcacctagattttctaggttatcttctggaagttttatacatttgcattttacgtttaggtgtatgatccattttgatttagtttttgtgagacttgtaaggtctgtgtctagatcctttcttttgcatttggacatctagcaccgtttgttgaaaagattgctttccccattggattgcctgtgctcctttgtcaaagatctgctgattgtaattgtgtcgagtctattttttgtttgtttgtttgttttagagatggggtcttgctttgtcatccaggctgcaatacagtgatgcagtcatggctcactacagcttcaaactcctgggctcaagtaatcctcccatctcagtctcctaagtggttgggactataggctcatgccaccatgccctgctaatttttaaattaactaattaattatttttgagatggagtctcgctctgtcacccaggctggagtgcagtggcgcaatcttggctcactgcaacctccacatcctgggttcaagcacgtcctagtctcagcctcctgagttgcaaggactacaggtacatgccaccacgcctggctaatttttatatttttagtagagatggggtttcagcatattgatcatgctggtcttgaattcctgaccccaggtgatctacccacttcagcctcccaaagtgctgggactacaggcgtgagccaccgcgcccagcctaatttttaaattttttatagggacagggtcttgctatgttgaccaggctggctcttgagtctgtttttgtgctttattctgttccattgatgtctgtgtctatttttcaccaataccatattgtcttgattactgtagttttgtgttatcttaaaggggagtagtagtatcagtcctttcactttgtcattcttcagtattgggttggctgttttgggcctttcaatacaccctttgactttagtttgtcaatattcacagaatagcttctggggatttggattgggattgcattgaatctgcagatcaagttgagaagaactgacatcttaacaatattgagtctttttttttttttttttttttaattggagtctcactctgttgcccaggctggagtgcaatggtgcgatctcggcccactgcaacctccgcctcctgggctcaagcgcttctcctgcctcagcctcccgagtagttgggattgcaggctcccaccaccacgcctggctaatttttgtatttttagtagagctggggtttcgccatgttggtcaggctggtctcaaactcctgacctcagatgatccacccgcctgggcctcccaaagtactgggattataggcgtgagccaccgcacccggccaacaatattgagtcttataatctgtgaacacaaaatctctctccatttatttagatcatctttgattttcaacagcaatgaataatttttcacatacagatcctgcaaatattttgttaggtttataccttagcactatttttggggtgctaatataaattgtattgtgttttcaatttcaaattctagttgttctttgctggtatacaggaaagtaattgacttctgtctgttaactttgcatcctgtgaccttgctgtaattgtttagtagttccaggtttttctttttcttttttttgtttttgtagattctttgggattttctacatagacagtcatgtcatctgtgaacaaaacagttttatttctttcttcccaatttgtatatcttttctttccttttcttatcttattgtatttcttatgacttccagtacagtgttgaatatgacttatgaggtggggcatccttctgatcttaaggggaaggcgtgcagtttcttactgttaagtaccaataatgttaggttttctgtagatgttcttcatctgaggaagttcctctctatgcctagattgctgggaggtttgttttttttcttaaatcggtgacggagattgagtttcaaaaaacgcttttctgtatccagtgataagaccatgtgatttttctacttagcatggtggtggtggtatattacatggcttgattttggaatgctgaagcagcctttctttctttttttttttttgagagggagtttcactcttgttgcccaggctggagtgcaatggtgcgatctcagctcaccgcaacctccgcctcctgggttcaggcgattctcctgcctcagcctcccgagtagctgggattacaggcacctgccaccatgcctggctaattttgtatttttagtaaagatggggtttctccaagttggtcaggctggtctcgaactcccgacctcaggtgatccgcccgcctcagcctcccaaagtgctgggattacaggcgtgagccaccgcgcctggccttgaagcagcctttcatacctggtgtatagttgttttcatatattggcggatttgattcccttaatatttgttgtggatttttgcatctgtattcatgagaggtattggtctgtagtttgccttttgaaaaatatatttagcttattttggtattaggatgatactgacctcatagaatgagttaggaagtattccctctgctcctgttgtctggaagagattgtagataattggtataatttcttaaatgtttgctagaattcaccagtgaaaccatgtgagaatggagctttcttttttggaatattaataattattgatcaattttcatatacacaggcctattcagattattattttatgtgtaaattttggtaatttgtatgtttcaaggaattggtccattttatctaagttgtcaaatttttaggcatagatttatttataataatctgttattttccttttaatgtccatgtgatttggtagtgatgactcttcattcaaatctgatgtgaataatttgtgtttttttttctcttggttaatttggctagaggtttatcagctttattgatttcagagaagcagcttttgtttttactgttgattgttttcagttcattgatttctactgtaattaaaaattttttttcttctccgtgttttaggcttaagttgcccttctttcttttctttcctaaggtaaagcgtagattattgattttacgtctgttttctaataacgcacttgatgctataaacttttctctaagtgctgctttcatagtattgcacaagttttgacttgtatttttatttagtccaaaatattttaaaatttctcttcagacttctttgactcatgtgttatttagtagtttgttgtttattctctaaacattttgagattttccagctatgtttttgttactgatttctatttttattccgttgtggtatgatagcatacttagtatgatagctacaaatttattaaggtatatgttatggcccagttgtggtctatcttggtaattgttccatgtaagcttgagaagaatgtgtattctgctgttactaaagtattatataaatgtcaagtagatccagttgcttgatggtattgttcaattcatagatacccatactcattttttttttttttttttttttgcctgctgtatctatcggttactgaaaggggctgttaaagtatccaactatagtagtggatttgtctatttctgtttgcagttatatcagtattttcctcatgtattttgatgctctctagtttggtacattcatattaaggattgttatgtcttcttggagaattttgcattttgtaatgctattctttatcccaatgattttccttgttctgaaatctgctttgtctaaaatttatataactacttcaacttcctcttgattagtgttatcgtggtataactttctccatccctttacttttatcctatcccttccctccctgcctctctctctctctctctctctttctcttgctttgctttgctttctatttatttattaattatttttagatacagtcttgctctgttgcccagcctggaatacagtggcacaatcatggttcactgcagcctccgcctcctaggctcaagtgatccttctacctcagccttctgtgtagctgggactacaggtgtgcactgccatgcctggctaactttttgtattttttgtagagacagggttttgccatgttgcccaggctggtctcaaactcctgggcctcaagtgatcctcccacctcagcctcgcaaagtgctgggattacaggcatgagccaccacacctggcccattcctttatattcatttttttaaatctactctgataatttcttttaactggtgtattgaggccattcacagttaaaatgatattaatatggttgtattaatatgaaccatgtttataactgattttctatttgttgtacttactttttttttttaatcccctctttttctgccttctggttttaactgaccgttttacaggattccattttctctcctgttttagtgtctattatacttgtttttactttttttttttttcggtcattgccctagagtttgcagtgtacatttacaacttatctaagtacactttcagataactctatactgcttcttgaggagtgtaggtaacttttactagaatttttgaactcctccctccagtcccttataacgttactattattcatattgcttatccatatgctatactcagtcaataatagttactattattattttgaacagttatcaattaagaataggaaaaatagattttatcttatttattccttctccaatgctcttttctttctgtagatcccagtttcttacctatataattttgctttctctctgaataactttttaaagcatttttaaagggcaggtctactggtgacaaattcactcagcatttatctgagaaactctccttcagttttgaaggatcatttcactgagtaactttgaggtagagttttttttttctttcaacattttataaatatttcactctactttcttacttgcatggtttctgacaggacatcagaggtaattcttatccttgttctctataggtaaggtgttttttttcctctgatttctttcacaattttctccttgtgtttagttttgtgtagtttgaatatgatgtacttaggtgtagatcttttggtatttattctgcttggtgttctctgagtttcctggatatgcagtttggcacccttaattttgaaagattctttgccattattctttcaaatatttcttctcccttgtctcacttttctcttcgtattccaattacatatgttacaccttttgtaattttcccataattcttggatgttctgttttgctttttaaaaatctttattttgccgggcacggtggctcacgcctgtaatcccagcactttgggaggctgaggcaggcggatcacaaggtcaaaagatcgagaccatcctggcgaacgtggtgaaaccccgtctctactaaaaatacaaaaaaaaaattagccgggcatggtggtgcacgcctgtaatcccagctactcaggaggctgaggcaggaagaattgcttgaacctgggaggcgacagaggttgcagtgagccaagatcacaccactgcactccagccttggcgacagagtgaggctccgtctcaaaaaaaaaaaaaaaaagaaaaaaaatttcttttttcctctttccattttagttttggaagtttctactgacatatcttacagcctagtgattttttgctcagccgtgtccagtttactgtcgagtccattaaaagcattcttcatttttgttacagtgattttgatttctagcattttcttttaattcttccttagagttatgtatgcttacattacccatctgttcttgcgtgctgtctacttttcctattagagcccttaacatattaatcacagttattttaaattccctatctgataatccccaagtctgtgccatatctgagtctggttctgatgcttactttgtctctttagactatgctttttcttgctttttggcctgccttgtaatttttttaaagctggatatgatatattaggcaataggaactgaataaataggcctttagtgtaaggttatatgttaatctgtctagaagctaggtcatgtttaatgatgtaggtatagatgccagaggcttcagtttcctctagtgtctttgttattttatttttcctagtctgttgtctgtgggttctcctaagaactcctttataaatagtgagtctgtgtcttgcaactctttcagttgtaattctctgttaatgtactggagctctgttgacatgatgggaagagtatggcgaagggaagaaagtgttctataatctcattcttctgtaagacctgagtctttggctacaaccttcagaagtgtttccagccaccccttcccctccttttcttctgttagatgaaacaagaaggctagagggactgtctttggctgatttcctttctccctggacaccaaggctctggtaaattttctcttggactgttgacctttgttatgaaaaacattctggccttatttcaaaatggttactttcttcctctccctacctaaaagaagaggagatttttattagatcttacccctgggtgtatttcaaattaattttccttgtgtcttacacaaaaggggaggagttttttcttgggtcttcatagtcagaacctggtgagatttcctggaggtaaaactgcaagaacttagagggcctcctaagatttagtccccaggagttctcattcacaagctagtctcagttagcctttgtcaaaattatcatttaagttttcttactagtgtatgattccagtgccttctgctccaggtactgctgatcttggatgtgattctttgtatttgcctgtttctctagatttcaggcgattggttcaccctctgacctcaattccgtaaatccaagaaatttgctgattttcaatttgttagggttttttctttttttcttttttcttttttttttgagatggagtctcgctctgtcgcccaggccggactgcggactgcagtggcgcaatctcggctcactgcaagctctgcttcccgggttcacgccattctcctgcctcagcctcccgagtagctgggactacaggcgcctgccaccgcgcccggctaattttttgtatttttagtagagacggggtttcaccttgttagccaggatggtctcgatctcctgacctcgtgatccacccgcctcggcctcccaaagtgctgggattacaggcgtgagccaccgcgcccggccagggttttttcttaatgtaaggacaggagtgatggtatccaagcactgtatgggttgatgctgaaactggaagtcctgtttacattttaaaattggaaatatcttgtccagtttataaataatattcagcaagaggttttttaactttcctgtgaaccattttcttagctgaaatgactcattcccagttattttcatccctttgaatttcaaatctctgtattttcatatgcttagtaagaactttttcagaacaaaatatttggaaaacttaagaactttatgtagttcttgcaaatggctactaactttaccctaaagaaactagaattattacacattttgatttccttttctcccctacagcattgttttttttttttaaccttctgtaaaccatgctcaagtagttctagggattattttcttcacttatttcaccccacttatttttgaagaagaactcagttttctaaggcactttgaaatctctagagactaagcacggcttaaatttgaaaaactaatgagaataaatgtggaactcttatgctgccaatggtttattttcaattaaccttgaagaatgtagtaattataaactacagatcgtggtgactttagcttaataggattagtttgagaatctgtgtgatagaggacaatttggctaaaatgtgttatttaagcaaccgagaaagtagtgtgtgtgtactttaaagccttataatttgattactggctacaaatttgcattttggtaggctttagttcttatccttggataacagttgtaactaacctcagtcatttgagacattataaatttcgttaaccttgcttcttttttagggttcattttaagttttatttttctcactgaacgtactgtgagaaacagccattaaaccaagaaacaaattagcagtatatttaaagatcgcttattagttagcagattaatgtgtttaataaatattttcctcttttctcatttgattaaaatgaatatttgtctttgagaattaaatatatttttaaaagaattaaaatgttaaatagaatgtaattttttttgtttttctctataaatgtaattttaatatactaaataaaatgtgttttaaaatgatttgccgtactgaaaggatttggttgaaaataattaatttttgctgtgtaataatcaattagctgtggcccattttacaataagatctatttgtgtagcatgctgtgaattagagacagaaaccttttactatgcttttgcttagagacctttattataaagaagtaagggccgtagagtggaaatggataaagactagcaggtcttcaggagtggcatgcttatgagttaagcaccatgccaggttccaccacccttagcagattagtgggtggtatcagtgttgctcctcccaaaatgtttttttaagaactcttcatgtattatgacagtaccctagaagaaacccacaagaatgaacacaatgtatagtaatatagtcttaacaaaatagcttccatgtgctaacaattcaactgaagatagatggtctatgttcagtaaatacatatttaagttgggacccctattgtcagggacttgacctccaattcccagataatgagggagcagcagctcattttttgtcctgatcttactacttcatgctatctgggctggcagatacccttggaaaatgccatttcattcactaaagcttcagtaccacagtgccaggattgattgcctgttcctctctccagagattctcaggaccagccccatcattcttgacatcccttactttttgtcaccaccaaaactcactggccatctgttagcacagaatacccatccttgtgctgctctgtaggttcctcagtctgatccagtttcctccaaccctcccactggcccctagaactcttgaataatttctcccatggcctccgtcttgccccagcatcacagtgtaatctcactttctgtccctggttctctgctgctgccaaatggatgcctgagggtagcccctgctctggcatcagtctcaggctgtgctgtttcttcctttgcctactacctggtaacctcactgcctgccttttagttccttgaatacagtgaggtcttcactcttaaaaatctttgcacaggctgcttccttcatctgcagcaattttctcagtgttttgacctggccgaccctatccagtctgatctgggtgtcttcgcgttgtcctctgctggggcctcctatttgttttcttcttggcacttaattaaatttgaagttgtatattcacttgctcactgagccttttttctggattctatgatatatatttttcctcatatttctgaaattgtgatgtatcttaaactggatttcttgattcctttctgaatggtaggtaaaataatggtttatcttacaattgtcttacatttaataaaatattgcacttttaattattgtttcccccggttgattgtgagttccacacgtataggaatttcattttactcaccaatgaaccagtgcctagcacagtacctggcacctaggaggctctaaataaatagtagttgaatgaatatcattatctatttgggagattttggccctaattttctcaagatgaattagtcagtgtgtaagtatgaattgttaattcagtttctgttgttgaatcattgttttcgagattcctttattctggaattgaaagagacctttagatttgtctattttgttcctccatctatgtaacttgccctattataggtatatgtacatccttgtttagaagtacttactcaccttgcatgaaaatgaattcacataaacttctacctggtgtgagcaattttctttcattagggagaaggagcgaggaaggtaccaaacagcagcagacttttgaacttgagacagttttggctgcttgaacttaacttttttcattttacttagtcccccaatgagtgcaatcatttggcatgcctacttcactttttttaagtgaactaacagcgaacaggcaacgttggtgactggagtgcctcaggcacctcctagagaaggttcaagcttagtccccagctggaggtaaggtgtggttctcagtccttttcatttccccaatcctgctcctgagtactgcagttgagtcagcctgggataatgagcagtttgcctttcattgaacactcaacagcctggttgtgaaaatgtctgctatgaccagtctttgccaatctcccatgtatgcttctgggttctgcagataatacttgtgtctcttcccccactcttgtacctgacacacatgttctacgtgatgtgaaaagaagagaagttgaacaggcaattgggagaactcgaagttgcccaaattgatgatgtcagtgtggagatgcacttgcagggaattgaaataaagaagttcaagtgtggccttgagaaacatggaagggtgagaatcccagggagcttgctgcgaacgtgtaccattggtgtcatcttcaggcctctgtttgaggtggccttcctgatgatcccgtggtctgtctatggattcagcctaagtgtggtttacacttgcaaacgagatctttccccacattaagtggactgcttactctctcgcccccggagaaaagcaccttcatcatcttcatgctggtggtgtccttggtgtctcttgccttgaacatcattgcgttattcagtgtctcatttaagagcatttaaggatcatgtgaaggatcaggagagtgatacacctggcctgcagagtccctccaatggctccatatcaactcttcctctctccaccatgtcccctcctggggacaagctagttcctggagaaagaaacaattcctcttgctgtaggcacaacaaggaagtgagcaaaaacccttctagttacagtgcatagcaagattgaatggagcaggcaggaagtaccccctctgactcccagtcttttgatttccctgctgataaacagagttcttaaacaaaagcaaaaacctagctactgggcactagccatggtaggccagcagccatcctgcagagccagtagtcatgccagcagcagcctgatgacctagagatcaagatgcatacttggaagcattatgattctgcttgattgtttaagagaaggaagtcgcagtagaaagcgcacctttgccccagtggaggtggtactcaaaaacctcagtcgtgagacttagcagacacaaagacattagactaccagggttcctgtacaatgagaaatgctaatttgcttaatatttgatagtaaactgctgtcatttttagctttattgcatgcaatgtagacctagttcatcatattacaagttctagagagtattatttattcaatacaggttttttttttttttttttttttttttttttttgagacggagtcccactctgttgcccaggctggagtgcagtggcgtgatttccgcttactgcaacttctgcctcccggttcaagtgattctcctgcctcagcctcctgagtggctgggattatagacgtgcgccaccacccctggctaatttttgtatttttggtagagacggggtttcaccatgctggccaggctggtctcgaacttttgacctcaggtgatctgcctgcctcagcctcccaaagtgctgggattacaggcgtgagccaccgtgcctggcctcaataaagttttaagaaagcaacctgtgtgtctccctcctgagagcttctggctgcaccgatctttcctagacttttaaactcttcattggcacatcttcatttaagcaaaataggctagaatcagaattttagaaatgaaattgcagtgactacattacagaaagttttagtattaacatttttaattatatgtagcaggatcacacatatacccattactttcaaatgtgccaaaaatgtagcttttttttttttttttaactgttgtacttttcatcagaagcttcttcccaccacagggcgctggagggaaggagaagacacagacaacttaaacattaaacctgcccatccagcatcttgctgtgacagtttaaacagtctcatttggaaaactcagtctcttggctaaatttccttctcataaacccttttatgagcatgaggaataatcacagttatttactaatgaaatgtgtgtgcctattggatactacaaaactcctgaaacttttgaatcagattggacgctgctgtcctcacttcctgtttcacattcattttcacatatatcttgctttttttcccttgaacttttaatcttgagataattatagttcacatgtaggtataagaaataatagattccttatatcctttgaccagtttttcccattagtaacatcttgcataattacagtatagtatcgtaactagaaaatggacattgatgtatttccattgaccttattcagatttcaccaattttatctgcactcctgtgtgtgtatgtttagttatgtgtaatggcatcacttgtgtagattcacatgtccaccacagtcaagctacagaacggttttatcacagggatcccttgtgctgcctttttatagccacagccacactcttgccttcccctctttctaacccctggcaaccactaatgtgtacttcatctctataattttgtcatttcaagaatgctattttagtggaatgatacaatatttaaccctttgagactggctttattcactcagcacaactcccttgagattcacccaagttttttgtgtgaaccaatagtttgctcttttttattgctcttttttagtatgctgtagtatagaggtgccagagtttgtttaccttttgaaggatctttagatcatttccagttttcatttccctgtgttaggtgctcaagagtgcagttgctgggttgtatggtatgtgaatgtaatgctttgtaagaaactggtgtatacttttccagactggctgtacaattttaccttcccatcagcaatgtgtgaggaatctagtttcttcacatgcttaccggcattttgtattatcactattattatttttatgttagccattctaatagttgtgtaggtgatcccattgtagtttaaatttgtatttctctaatggctaaaaatgttgaacaccgttcctgtgcttatttggcatctgtctattttcttcagtgaagtacccgtgccatttttccaattttgaattggattgttttattattgttgagtttaagttctttatatattctggatttaaatcttttgttctatatgtttgaaaatattttctcccagattatagcttgctttttcattctcttaacaatgtctttcatggaccaaaaattttaattttgttaaggtcatttatcaattttttttttcctatggactgtgcttttggtgtcaaatctgagaaatctgcctggccctagatcctaaagattttctcctttggttgtttctaaaagttttataagcttacattttacatttaagtccatgatctattttgtcaatttttgtacaaggtgtgagataaaggccaaagttcttttttcttctcccttatggatgtctagttgctccagcaccattcattgaaaagtctattctccctccattgagttccttttgcagtgaaaaatcagttgggcagatttgtgcatctctaattctggattctctgtccctcttctagtttctagatgagactgtataagattgctgttaattcttccttaagtgttaaaattctccagcaaacctatttgagcttgcagatttcttttattggaaacttgataattataattacatattcaatttctttaataattacatgactcttaaagttgtttatttcatcttggttaacttttggtagtttgattttcaaggaaattggtccatttcttctaagttgtcaaatgtaagagtgtaaagtttgtagtgttcctttatttatttttaatgactgcaggatctgtagagatcttccttgttttgttcctgatactgatgatttttgtcttctttctttttatctttaccagtcttgctagaagtttatcaatattaattgttctttttgtggaatcagccttttgcctcattgattttctgttttcaatttcatttatttctgcttttatcatgattatttccttcttgctttgggtttattttctttttctagtcttgagagaagaatttatcttactgatttgtaaccttctctctttttaaaaaatgtatacattgaatactataaatttccctctcaatactgcttaagctgcatcccacatattttgatacatgttgtattttcattttcatcaagttctatgaaattagaatttcctttgagactacttctttgacccatggattatttagaaatgttaggtttcatttctaactatttggagattttcctgttttctttctcttactgatatttaatcggattccattgtggtcagagaaaatactctgtatgatttcagctctttaaaatttgttaaggtttgttttgtggcccaagatgtgttctgtcttggtgaatattttatgggctcttgaaagaaacatgtattctgctgctgttgggtatagtattttatatatgacaatgagaccctgttgggtttcattttcttatttttttgtcttcaggaagttttaggattccatcttatttatacagttcattagtatatcagtttgtattgtgttcttagttactgatctaggtattaaaatatacatttgtatttaccacaatctattatcagtgttttaccactcaagtgaagtgtagaaatcttactctcctttagacccttttgccctccccacttaaaaaatatatatgtcttaagtatttcttctacgtacattgagcaccacatcagatgatgttataatttataatttttgtctcaaccatcaaatctgatttatgaaactcatgagcaaaaggatagtcttatattccccaccttttatttttgtagcctgttctaatatttttttcttaaattccaagcttctttggttatcttttactttcttggttgttgttgttgttgttgttgttgttgtttgagacagggtctcattttgtcacccaggctggagggtcacccagtggtgcaatcacagctcactgtagccttgtgacttcccgggctcaagcgattctcctacctcagcctcctgagtagctgggaccacaggtgtgcaccaccacacctgactaatttttgtgtttttggtatagatagggttttgccatgttgcccaggctggtctccaactcctgggctcaagcagtccacctgcattggcctcccaaagtgctgggattacaggagtgaaccaccacgcctggctggttatcttttacttcctatttagaaaactacctttaaccattctttaagggtaagtttgctagctacttctctttgttttccttcatctgcgattgtctttatttctctttcattcctgaatggtatttttgcttgatacaggatttctgattgacaattcttttcttttcttttttcttttcttttcttttctttccccttccccttccccttcccttctttttttttgagacagagtcttactctgcctccaggctggagtgcagtggcgtgatctcggctcactgcaacctctgcctcccaggttcaagcgattctcctgcctcagcctcccgagtagctgggactacagacacgcaccaccacgcccagctaatttttgtaatttttggtatagacggggtttcaccatgttggccaggatggtcttgatctcttgacctcgtgatccacccgcctcagccttccaaagtgctgggattacaggcgtgagctaccacgcccggccgacagttcttttatttagtgcttgaaaattgtgctgtttccttttagcctctgtggttactgatgagaatacactgtcattcaaattgtttttctcctataggtaaggtgctgtttttttgttttttagttttcaaaagtttcactatgatgtgtcttggctggaattactttgggtttatcttgtttggagtttgcttagctgcatgaatctgtaggttatgtcttttgctaaatttggaacttttccgttgtgatttctttgaatgtattttcagctctactctgtttgtcccatccttctgaacctccagtgacatgaatattaggtcttttgttatagtgccacatgtctctgagtctctgttcatttttcccccatctgtttcttttctgttgttaagattggattatttctattctgtctctaagttcacagattctttcctctgttttctccattctgttgtttagtccattcactgagttttaaatttcagttatttgctttatttttcaattcataaggtttttttgttgttgttgttcgtttttgtttttttgagacagggtgtcactctatcacccaggctggagtgcagttgcacagtcattgctcactgcagccttcacctccctaggctcaggtgatcctccacctcagcctcccaagtagttgggaccacagacgcgcccagctaatttttgtttattttgtagagacaggtttcaccatgttgcccaggctcgtctccaactcctggacttaagcagtcctcctgtcttgccttcccaaagtgctgggataacaggtgtgaaccaccatgcctggcctaaagttttttttttgtatcttctattaatttgttgagagttcctatattttcttatttggttcaagtatgcttgtaattactctaaagtatttgtatgatggcagcttggaaattttttctgtgatgattctaacatctctacagtcttcgctggcacctgttagtcttttttgcatgttgagatttccctactttttagtatgatgaataattttctactgaaacctggacattttggatgttatgtcattagaatctggatcttatttaatctcctgtttttcttggccttctttgacaccccttctggaaaggaggggaatggaagttgagttttctaattccacctccattgacacccactgagaggggctccttgctgctgctttgttgggtgggaattccagctccctaggcctttgctgaccactgtggctggagggccaggagtatcttgtgaccactccccacgttggcctccactgacaccagcctggcgggggattagacatgttctcttcgcagcatttgctggcatgggtagggccccagttttcactgttttgtggctggggtagagtagttattgtctaaggtcttttgtcctgctaggctgttcttttcctggtcctttagctggagaagagaaggcttttgttggggctctttgtctgtgcccatgggctcttctgggttctttattgaagtatttttattagggttgctttaaaatctctgtcagataattccagcacctgcttcatctcagtgttaatgtctcttaattgtcttctttcattcattcaggttgtgattttcatggttcctaatatgatgatttttttttttttttgtatcctggtcattttggatattgcaagactctggatcctatttaatgtgtgttttagcaggtagccacccagttgaggtataggataagggcaaatgtgtatattcaatttccctcttggtcccattgataccacctccgcaaaagctccacttttactcacgctgcctcattgtagatgggtgaggtggatgttcagctcctcatttggccccaccaacacctccccagtgaaatcggatctcagatttgcacctgccttattgcctctgctacatcttgcagacgctaccctggccggggagtcagaggtgctacggcctgatgggcaatgaaagattagctccttggtcagcctcactgatctcatcaggcagggaattctaacagtgccgcctgctttctcgggatgtgtatgtgtaaaagagtgttttcctacttgggcctgctgaaacctcagtggggtggtgctgcagtttttccattgctgcagtttttccattttctttttggcagtaccctccctgttgcctggaatagggagggtattgccagaaagattttcagttgttagcctacccttttcctggtcttttggctgaaagaacaggtttttcttggagctattttttttttatttgtctatcggtgccaggttgaaggcttttgaagcaccttattgggcatatatgggagacaataaggaaacccaggaacttgcctctcaagtgccgaagtccctatgcagtgtgccatcttctttccatcttggcttcctatgtacgtttttgtgtcacggtcaaggatttttagtcttaaggaagaggacctggaaggagtggggctgctccatcttgaccagaatgagaagtctgtgtgtgcatgtgtttaatatataatgaaaattctaaaatctgttaacaccgttttgtataatagtaacatattttaatatttaaagaataaacaataatttattcttcaaatatactatgtatcaggcacagtgattgacccttgggtctgcagataggactgagacataatccttactttcaaatagctgatagttttgtagagttcaaagacctgtggaatcaattttaatttgccccattatactcagatggaaaccactcacaattcttttagaaataaaaacagaatctagcttcatactacctggctggtagtattgtgggagtttcctcccctctcattggttgagataagcctcctttggtttatgaggtactaggcaaatgaggaagtggtctagtgcttagtgccttgttgttactctggttacaattaaaccctttgccaggagctgccatccagtgggtagtgcttccctggccccaactctccaggctatggtgcttagtaatcagacaggtggaatctccgcaagtaccacaactgtcagaagtcctgaacacccctctctgcctcatgcagaagctgtggtcccatgatcctcccactcctggaggaaccttaactctattggatgggaagttcagctctactgcctttgtgagtctgggctttataatcataagggctgttagttctctccatgggcaggagaaactagatctcagggatacaaccccatgatctctgagttcctttggaaatttggttttgatgatttgggaatgcccaaaagtagaacatttctgaactttctccttgatggtagtgggtgataatggtgatactgtttttttaactcatgtgtgttctaagcattttacttgtatcttctcatttaatcctaatagcaacctcaggaataagtgatattattatatctgattttctccggaggaaattgaggcacagagaagttaaggaacttccctaaggccactcaggtagtaggtggtagagccaggattcaaatgcaggcagtctagctcagagctgaagttcttcttacccttctttcagcgacgtgacaacctttgagttttactttgcttttctattatttgcttgaaattaagattgatgtatctaaaataagtgttctaggcttctaaaaagtgtcacacaattaaatgttactaaagtacgtttctaattagaaaagtttttgttttctttcttattaaaccacatagatttggcaagaagagtataaaaaataaccagtaataggttacatttacaactgtttggagtatagtcctttaataatcagatttttttgttcgtttttgtaagtaggaaacaatgattttgttagaaatctctgcttttggccaagtgcagtggctcacacctgtaatcccagcactgtgggaggccaaggcgggaggattgcttgagcctatgagttagagaccagcctggtcaacatagggagaccctgtctctacaaacagtacaaaaattagccttgtgtggtggcacacagatagtagcctgtagtcccagctactcagaggataaggtgggaggatcacctgagcctggggatgtcgaggctgcagtgagccatgatcgagccactgcactcccgcctgggtgacagagtgcaactctgtctcaaataataataataataaagaaaaataaaaggaaatctctgcttttttgtttggttgcttagggctcaataaaaaatttaaccagattatttctgattatgtatatctattatatatcacattttgttatacatttgtgatcatttctattgtttttacatgtctttgtgtttaaatacaggtagtagaataactagaaggatgtgactcacacgtcattatgtaaatattatccatgccagtacatttaaattctatagggacttaattgtaaagcagttataatatagccgtgttcctctgttgagaaaagattcatactgccctttaccttgctttttcagtgaaaatgtttaagttttttcgttcatttgaaatgtagaatcaaagtttcatttacatgcatattctatgtacttggtactataatcttagagtttgttctattctttgtaaacacagaatgtgaatataaattttctgccatgttttgttaggaataatgtatctctccattaatttgcatgttttcataccattgactcttaaatttccatgaacactagcccacaatgtgatttatctgaggcagattttttttcaaattcatattgatttatcttccatgccacttgaatacattttgttgatataataagattctttgctagttctagctcaagagaaaccacaggagtgaactttagaacttccgattagttcattaaatagacatttggtaacacacctactctagtgagtcctgttggttgtttggggtaaagggtgagaagggcatgatcagtgattacagagtgaccacactccagaaaggaaaggcttattatggtggcacagaaattggggtgtactctctgccctggaggtattcatggctgtcagagcatgaaaatgtaaaaaaacaggttatccgtttgaaaactcaggtggttggttcttttaacaagataatatttgtttttactttctgccatgtttaagttacatatcttctacttcttcttttttttttttttttttttgagacagagtttccctcttgtcgcccaagctggagtgcaatggtgcaatctctgctcactgcaatctccgcctcccaggttcaaatgattcttctgtctcagcctccctagtagctgggattacaggcgcccgccaccacacctggctaatttttgtatttttagtagagatggggtttcaccatgttggccaggctggtctcggacctcctgacctcaggtgatccacctgcctcagcctcccaaagtgctggattacaggcgtgagccattgcacccaaacaagttacatatcttctttctttgcccagcatgtcccttgtctcatttcttattggtcactgtaagtttcatcagaggtatttagaacagctgaactgcctaacccatccatcacatccttttggtgggggcctttctgctaggtctcaggggcacagagttaagtgaggtacctaccctcatggatcttaatcaccgtctggctgggaagtgaggccgcatggcaaagcatagattccagtgcagttgtggtgagtggtttgctggaggtgtgaatagggtcttgggatcacgaaaagaggagtacacaaaacaagctggggggatcctgcagtgcttcctgcaggagggttttgaaggagtaaaaggagtgaactagaagtagaagggctggcttcttgtcatttcagtaaagctaaaacatcacctccttaggtactgcaccagtactctattgaattgtctgttttgttaccataatcttgttctgttatttgtttccttgttatatgtctcttccctccagaatgtaacttctttgtattcccagtgcctgttacatagtaggggcttgaaaaatgtttattggttgaataaatgaatgaatgaatgaagaatgaatgcttgaggcagagtgtgagcagataaaagcaagtgtatgtgaaggcttagttgagaaactaactgcaaatgattaggtgtgacatgagcaagggagcttttccttacaaattaggaggtaaagcatggaattagaatgttatcctgaaagcctccaggctgcatgatatgtaatgcagcattcttttcctgaattcctctgattaacagctgtgaatattttaaattttcattatgtgcaaaactgatgatcttactgaggccttttagagaatattatttaaagaggattttaactagagtgcttcagtgatgttcttgacatcaagtaaccagacacaaacattttattcaggtttacagtgttctttggctaattctcttgaaacattgaattgcttgagacttacgtgccactcttgtttcaagacaacagacaaaacttttggtagttttgtctcttcctccttttgctttagtgctcaaggtgtggtgtacattggtcatcaggccaatatgatggtgataaacagttcctcttccaggcctgtgtgataatacagtttaattgagcagacttttagttacatacgtaagataaaatgctagatacttggatgtaagacaaactagacacatgttaggaataacacttaatatcttaaggaaattgaacacttgaacaaaaggatttttagcaaagcaattttgtttttgcgcagaggggtgcctcttcggccagttgtcatgagaatatacttgaacaaagggcacgagagtttttatttttgacgcgagttttgtttttgtatttttttattggccggggttgggttgtataatttaaattaaatttggttggctaaacatttgattttttgttttttagatagggtgggcacttaaaagaaagtagaggaaagggaaggggtgtttgtaatgagctagaaagttttttttttttttaaataagggaaggaatgtgagctggtattgataacgcttggtattgaggcgtgcctgggcatttaacaaaggcaaaaaggaaaaaggagaaaaaagggagggatactatgaattaaagaataaaagattgaccagattatctgaagagaaaccttattatattttacacatagctctttgaaaaataccatgggctgctgatatatatctaatagccttctctttctctgctaagagaaagtaaatctggcattttctagttttctccacaatgtataataagatatgaggagttattacaagcttaactagatgctttgaaaatcagattttaggaaaagaaaataaaaattgttactacctatgttgaatgtatttttcacttttctctgtagatatggttatggcaaaacgctgtgacttggaacctttttcagatttcagttgtcctattctgcttccttgcctgctttgtgagcacatctatcagaaagtgtggtcacaggatttctagagataacccagcgcagtgcttgaatagggagtttctgtgtttctgttctatacgtcacagtctttcacatcttagcagtgttgtagccattgcgcacctgagcaccttgtgcctaggtagcccgaagatgttatacagaaacaaattgctgtttgctttctttgaacttcagtgttttgttaagctcgtgcctgttctaaagcagccatatctctcatgaattggaaaaaattaaaccttggtgcattggctttatttgcgattttagtattctcattttcttattttataagaaaatgtaaaattaggatattgtatttgccagaattcaagacttatagattttatatacatgcatgcacaattcatcagtgtgttgatgaataaaaacaaaacagaatcaagcatttttttattgagcactaatttattaccatttttgctctactgtctctaacgtcagcagaaggtatgagtatatacgcatgggtctggcttttgttcaggctctgagtaagcagtgagcaacttgctctgtagtagctatgctattgttaactacctgtacattgtttatacatgaataattgcaaaaattaagtatactgacttcgatggtctctacataacttactgaaacaattggtcataagaaaggcacagtcagtccctcccttgataaaggaatctctagcaagctctgtcactcattcaacagagcaatagatttttctcttcatttggaccatgcatttttatgctgatcatcagtccataattttaaactttgttttttattctgtcaatattcttgaatctttatttagcagggataatacttttggaatacctgatgatgtatctttggtcaataaattggtttttgtcttctgatcttttcttttatcatgtccccaggaaagagagcaggatgaatgccactttgtagggtaaattccttgagtattaaaggagaaatgaaggacagcccattcaagtgtcaaaggaatgtgggaagaacaggcagagttagagcaggcaggtggtcaggtatatatttcttgtcattccccgcccccatcaccttagggaactgaaattcaaggtttagggggtgggtaggttgaaggtaagccaaaagtgaaggaagcttatgccccatccccctcttgtaactcagggaagaaacagtctttcaaggctgctttaacacaatgtaagcagccacagcagaagaaaatgtagcatgctgtggttaggtaaagaggactgccaggcctcctttagctggtgagtggcttctgaggaatcccaaagttacttcacactccaggtagctgggttgagagccagtgaacctgtcagtgggaaagatgtgttgaggggcaagctgatacccacgctgtagctgacagccacgctgtagctgacactgattgagctaggtcttgggtgtaaatgagattaaggagtctagatgtcttcggcaccaattagagacagatcaactggggtagatccctgggctctgggccaagagagcacacctgagtctacagcctccttgagctccaacagcagcctcaggccagtgtctggggtccacgcgtataaggaaccttgtcttggagacctgagaacctctaccttactacggtgaagttctgtaaccccacccacatccatacccacagctgccatcttggtagaagcagggagaaaatggaaaaacttaacatttacctgaacaagactataaaccagaagggactgcactaccatataatgcaagttaaagtcaagtgtgggggcttgaaaagcaaggttaaaacagttacagaaaatttaaaagctacattttcttggcacgggttaaatttagtgagctataaattactgttcctgccgcagcaagatagtctttgaggatatatttcctgcatttaaatttaaattttgtattcttcattcacagtggaacatagcttttaagtccaatgattatctgaggtttagattgcctgcagttggcatgcctaatgccatcttggtctcagttacttgatcactagaagtgaaattttcattttctcgcctcagtgttataaaataaggacaaaatgaaatagtaacacaattgcacaataactgcagtatagacgtgatggttaatactaaactgaaaggctgtctgacaggcatcactgccatgtagtcttcaaaattctcattcatttgcagacaatttggtgtgaatttggtgtagacaaggtggtttgagggtatctacatataatgtttgaagatgtgggttttaaataaaaatgagatgcatctcaaattttatatgatctataagtatggagctagactgttttgaaagttcacctttctctctttccattgaaaattgttggtattttctgccagagggattaaggaaaattgttctctgaatgtctcatttttcattttgataactatattttactttttgaacattttattaattaccgaatctataatatgaacatagggtagtaaatttatattagtcctggaactatgaggtaaattatttttaagtgattcatcttgaattacccacttatatacaataagatgtacccatttttagtgtatagttctgtgtaaactagccctcttagttcattctttggcattatcagccagcgtcccttcaggctgatactataatagttacaatggagcatattacaagtacttacaaaggatttctggatatgtgggtttgtttgcatttatcaattaagtggtccaaggcttttaatatggttttgttctcacatttgcggcactcaaatatcagccatccaaggtggccccaagtctcatagccttactagataccttgacattattattattattattattattattattattattattattatttgagacagagtctcactgttgctcaggctggagcacagttgcagcgtctcggctcactgcagcctcaaccttcctggcccaaaggatcctcctacctcagcctcccaggtagctgggactataggtgtgcaccaccacacccagctaatcttttgtagtgtgtgtgtgtgcagagacagggtttcaccatgttgcccaggctagtattgaactcctgggctcaagcgatttgcctgcctcggcctccaaaagtgctgagattataggcgtgagccaccacacccttccgaaactttctaaagcatagaaaagcagatctaatatgtctcctagggaatctgtccttaaaaaaaccgaaatgtggccagcttacgactgtaatcccagcactttgggaggccgaggcgggtggatcacaaggtcaggagtttgagacaagcctggccaacatggtgaaaccccgtctctactaaaaatacaaaaattagccgggcatggtggcgtgtgcctgtaatctcagctactcaggaggctgaggcaagagaattgcttgaacctgggaggcggaggttgcagtgagccgagattgtgccattgcactccagcctgggcaacagagtgagactccgtctcaaaaaaaaaaaaaaaagaaagaaagaaagaaagaaaaaacccaaaatgtatatatttgcattctgtgttcttggctggttggtttttccttatgtaccaaggaatgtctttttcttttaaaattatgggaggaaaaagtgttaggctatggtagaattagtaactgatatccaaagagaagaatgagccaggccaacaggatatatgttttacattggcaacacaatacagtaagatgtttggactagctgttctccttttttgctgagcacattttggaccagttgcatttatttctcaactacaagcttgcagtctagtagtagagtcagaccttgatcaagtgatcatgtaaatctgtaaaggtggaactttaatgcaagttataaagaagaggcgcttgctgagagaacaccacagggccttcagatctcatcgaggagccgtgggaaggctcctctgaggaagtgaggattgattgagccaggatctgggggatgagagagggttgagtgggcaagggagggcaaagcttgcaagaacaaagggaatagaccctaaggcagtagagaacatggcaaggagagatgtgactcagcaagcaaaggagacctagggagaggaggtggaagagctacctggcctgccatgtggagcagctgcgacggagttgtcaggttagtggagttagggagaattttaaggggaatggtggagcttgaaatcagatttcctttcccaaggaagaacctggttgctgaggggatgaacatatcagaagggctgtggcagtactgaaggtgaaagtaccaaaggcttgaccaggggtaggaggagcattcaggtacaggacagtggacccatttgaaaacaatgtaggaggcaaaacccaacagcacttagtgatagactggatggatttggtggtgcagacaagggagatgtcaacagtgatcccaaatttctggctagtgtttactgagatatatgggacaggagacaggcccaggttttgtaggggaagatgcagaaatggttaggcattctgtctgaatattttacactcatacattctcattttacatctcaataaaagattcatggagggcagatccagcgcagagatggtagaagagattttatgtcttattggaaataatgagaaaacagagttgttgtgttggaaatttatcactgacttggcttgaaggcagttgtgtgtgtgtgcgtgtgtgtgtgtgtgtgtgtgtgtgtgtgtgtgtgtgttttggagacagagtctcactctgtctgcccggtggctggagtgcagtggcgtgatcttggctcactgcaacctccgcctcctggattcaagcgattctcacgtctcagcctcccgagtagctgggactacaggcgtgtgctaccacgctgggctaatttttttgtatttttagtagagatggggttttaccatgttggccaggctgttctcgaactcctaacctcaagtgatccgcctggaaggcagtcattatctgtacaaagtctctttgtgagatcccacttcccatgtcttcctttttggctacctgctgtctcatgttcttgataaagtattagtattttcataagactatcctctttttagaaacggtacatgaagtaaatacacagtttttcttgtaatgctttctaaattataagagttttcttaaagtactcttagcgtaccatttaattctaattttgagcaggttagagtttacatcaatgtttcctgtaataatagctccatcatgtcaaccttaataggcagttttgccaggtatttatatatatatatttttttttttctattatacttttaagttctagggtacatgtgcacaatgtgcaggtttgttacatatgtatacatgtgccatgttggtgtgctgtacccattaactcgtcatttacattaggtatatctcctaatgctatccctcccccttccccccatcccatgacaggccccggtgtgtgatgttcccctccctgtgtccaagtgttctcattttgccaggtattggtatagacttggtgggactccgctaaattgtttttggcctaatgaaaaccattcctgaaatttttaggaaaaaaaaaaaggatatatgttttcagtataccttttggtatatttcactgtctttttttttttttttttgtgagacagagtctcactctgtcgcccaggctggagtacagtggcgtgatctcagctcagtgcaacctccaccttgcgggttcaagtaattcttctgcctcagcctcccaagtagctgggattacaggccctcaccaccacgccaggctaatttttgtatttttagtagagatgaggttttgccatgttggccaggctggtctcgaactcctgacctcaggtgatccgtccgcttcggcctcccaaagtgctgggattacaggcatgagccactgcgcctggccatttcacggtataatattttaatggaaccgtattacaaaagttattataaaactaatcattgttttataaaaatgagtgtagacattttagtgttgtgataattttaataatttttggagaatggatcttttaatcttctttttcaattaaaattttctttcatagcatattaatcttttcagtaaagctttacctgatctcttcaacaagtgatcattctcaaatttttttttattatcatactttaagttctggggtacatgtgcataacgcgtaggtttgttacgtaggtatacacgtgccatggcattctcacatttttaagggggaatgtttgtacggaaataccacaaaatggttaaaatgaataaactcgagcagagtttcttacccttagcacttttgacatttggggctaggactgttgtagggactgtcccgtgcattgtaggatgtttagtggcactcttggtctctactcactcgatcccagtagcgcccccagcctatgtgacaaccgaaagtgtccccagatgtcttggggggagcacagtcaccccccaagggagaactattgaactagatttagtttttaatgtcagatacagattgtattttttttaagtgtttgaaaaaagatacatgcaatagcatatgctagttacatgatttttagtgcacaaaacgatacaatttatgggcagattcattcgtagtgataaaaatgtgtgggaatgatactatcaacttcaggatagaaattacctctgggtagagggaatgggaatgaatgaagttttatttttggcattttacatttcaaaaggcaggagatccacagcaaataagccaaaatattatcaactgttaaatctgaaggggatatacatttttttctgtatatttgcatgatcttttttgaactcctgtggcatatcatataacacttgttatactttttagcttttgtcatgcatttttaacttactgtcatgcgttattacataccaggttgtagacttctatgtatataagacagcttcatttactcactcatgtcaaacacaggatacaaaagaaaaccttacataaagcagaggtccaataaacatttgttagttgactgattgaaacgctctttttctttggtatagattttttgtgtgtgtgatttggtctgaagtattgaaatttagcagtaaatctaacttttagtattgacaagctatggtagttttcaaataacaaataatataagtcaagatctctaaggaatttcctggagaaatctagcttttatcactgaatatcatggatggtattttatatttctatagtacttggcaaatgcatattagctctgacctgctatagaatgtatcctgtgcttgaatttcctcccattttataattttacttataatgtaaaaataaatacttttggactaagttattttggaaggtttctacacagtaaaaaagataaagatggaagtaatgaaatacttgcctgtacttttcagtgtataaatattataacatattattagaaaactattttgaaatgttcattggtgctaacatttctcttcagtgatgtgtgtgtgtgtgtgtgtttcagaatcactttctacaacaaaatttacatacacatggcttgcaaagacagtatagcatgattatggttgagaaatggcattcagaatcagtcttcctgggtttaaaatctcagctctgctacatcttagctgtgtgatcatgggacaaattatggaacttcattaaaactcagtatcctcatctgtaaaatgagcatgagatctcctcagaatgatgatttgagaattaagtgagataatccacgggaagcacttagggtggggcttggtgcaagagtacttaaaaacaataacttaaaatgaagcttactttttctgggaccatactggtctataaagtagtagtttcccagcctggccaacatggcgaaaccctgtctctactaaaaatacagaaattagctgggcgtggtggcgtgtgcctacaatcccaactactcagaagactgaggcaggagaatcgcttgaatctgggaggcggaggttgaagtgagccgagaccacgccactgcactccagcctgggaaacagagcaagactccgtctcaaaaaaaaaaaaaaaaaaaaaaaagtatcagtttcacttgatcttagccagaaggctgagaagcgataaagtagtaatttctgtgtttgtagggttttacttatgctcagggagcagacaggatatttgcaaataaaacgtgaacagaaatatttaaaatactttagttatgaagttatattccctgctatttggatgatgaaatgaagaatttctcccaagaaagcacttcctcagagagcaattagaaaatgaattgtagactatagatggccctccgtatcagcaggttccacatcgatgaattcaaccatctgaggatcgaaaatattcagaaaagcagacaaacaaaaacaactaaaaatacaacaataaaaaatacaaataaaaataacagtattacaactatttatttgcatggcatttacattgtactaggtagtataagtaatcaaaagataatttaaagtatataggcgaatgtgcataggttatatgcaaatactgtgccattttatgtcagggatgagcatccatggattttggtatcctcggggatcctggaaccagtggccccctctatatcctcgtagatactgaggaataactgttataaccttttgaaatggcttaatccgtgaatagtagaataaaagagtattttattctgttctgtttcatgatacctgttggatattttaacttagcaaaacatttgaaaaataatgactcctgcgacttccttatacagtatatgatcagtttaaagacttcactgttccagagcataattaagttatataactgcattttaaaatgacttagtaaattgtatggctgttaataccaattagttgctttgccagaatcttaagtaaggcacaattaatactgggaataaaacaatgacccagagctttagacagtcagcaacgcaagtgagttgatgattataagtctgtctagtatgattctctagtgattgaggcttgatttttatggggtagagatcttgagaatattgaaggaactgtaggctctccagatatttgtatttgttagtactcataacatttattttttattctctttctgattttttttttccagctggggaaatttattctgggaaatgtgaaatgccttgatatagtttgtttactcatggagacagtagtacaattcaggaacctttatctaaagttacctagtctctctgtttgtgttccaaagtacataatacaattctaattttaaggtagaattaagggtgaggcatggaattatcattaataaattactgatatatttgatcacattcttagtttattgcttaagatgtcggcttttaaatacttcatattttaaataaagacactgaaacaagtaacaaactatgcctatcttgctaactacagctggtgacattctgttgcagacgttgtgggggcaatggtatgcttttatgaataaattaaattcaaaacaagtttttcagagttattttttgtatgtttttctctttgtctacacctttattatatatcgcatctcagggtggtggtagaataagtaataaagcttggcgtgttacttcctacctctccattaaatacccacgaagatgttaaatacccatgaagttctgcagattaagaaactaaacatcgaagattgctagcaaagtccagggagaattaattttattagcaggactgggttgaaaacatagtcttgaacatcatgctgttcatcctactttgtgaacccaaatcaggccagatatccaaagggagtaggaaatgccttggacccatgctcacaggaactgaaaaataagcaaccatctcactgaggttaactataatctgacactgctagagctggagttctcactcccctactagcctgcattaacatctgcatttccagatctttgcagagactaaaatgtcctaaatatagtaagggaagaagcaaagaaggattggaaaaagcatgtaccatcctaggattcggagtccccgtggcaaagtgtggtgaaggtaaagggaagggaacaggctgtgcttggaaatgtggtctccagaatgccacgaggtaaacagctaatgaatggcatgtgctcttctggcttactcagagaaccctgcccaggcagtttagtctcagaccagccaaccccaatgagaaggatgtgtgctagcaagccaggttctaaaatcaggctggggtgcatcagttcatatttgaagttcaagttgaggccaaatgccagtcctggtggatctctttccatcttagtaaggatgaggttttttgttttgttttgttttgttttttgggagatggagtctcgctctgtcatcacgctggagtgcagtggcgtggtctcggctcactgcaacctctgcctcctgggttccagcgattctcctgcctcagcctcccaagtagctgggattataggcacgcgccaccatgccgggctaatttttgtatttgtagtagagatggggtttcaccatgttggccaggctggtcttgaactcatgacctcgtgatccgcccacctcggcctctcagagtgctgggattacaggcatgagccactgcacctggccgtaaggatgagttttaaagggtggagcagagaatacactgaaaagatatgggaagagaaaacatggctgtgaagatttacaagcaacacatggttctgaaaatgaccttttctttttttttttttttctttttattattattatactttaagttttagggtacatgtgcacaatgtgcaggttagttacatatgtatacatgtgccatgctggtgtgctgcgcccattaactcgtcatttagcattaggtatatctcctaatgctatcccttccccctccccccaccccacaacagtccccagagtgtgatgttccccttcctgtgtccatgtgttctcattgttcagttcccatctatgagtgagaacatgcggtgtttggttttttgttcttgcgatagtttgctgagaatgatggtttccagcttcatccatgtccctacaaaggacatgaactcatccttttttatggctgcatagtattccatggtgtatatgtgccacattttcttaatccagtctatcattgttggacatttgggttggttccaagtctttgctattgtgaatagtgctgcaataaacatacgtgtgcatgtgtctttatagcagcatgatttatagtcctttgggtatatgcccagtaatggatggctgggtcaaatggtatttctagttctagatccctaaggaatcgccacactaacttccacaatggttgaactagtttacagtcccaccaacagtgtaaaagtgttcctatttctccacatcctctccagcacctgttgtttcctgactttttaacaattgccaaaaatgaccttttctaacaaaccaataaagttaaggcatctgcttagtctcccaaaagaaagccaggaagatatgacctctacagagagtgaataagctaaaacaaggcaaaaaatgcagaagttggctgagataaggacaagtgaaagaagcctaaaatggataaaacaaaattgtttagcactttcgaactgattaatgttcgtttactaaatgtttattgaacacctactatgtgcctgctattctaggtgctgatgatgcaattgtgaactttgcatactaagtacaaaaacttagtacaagactaagcaattatgaaagatccaacctagaagttgtaaggtttgtggtggaaaataatagaaaaataggagtaggaacaacgtttaaggttgctataagaagactttcctaatttcattgatttccaggtattattgattcaaaaaatacacacacacacacacacacacactcctctaaatatattccaaataatttaaaatttttatttcaaagaaaaggaaaagtcctaacagtatttaggcagaaaaaaagaagtgatctatattggaacaaaatccaaataggcctcatacttcttttctactacaaataccagagactgtcaggtcattgttccccatttgatgccttatgtgatagtattataatttctttatgttagaaaatggcagcccttctttttagacccttaattttcttcttcttggaaaaatatcctagtatatagattttgttacaagaagacactttattcctacctgcattaagttgctttaataagcatacagactctggtgtctgtgatgtgaatggcattttccagggctttatggtgcacttaagcttccagtgactctgaagaataaaaggttgccttcccaagaattctgtgcctatcaagttgccatgtatacgtgaagatgttcaaaaatgcaaagacttgaaaaataggacactttgtcagaaaacctttcaaagatgtgctctggctgagctaaacatgaatgcaaatcaatcactcaaatatgtataaaccatacaagaaaaggactggtggtaaacagtgaaggaaactgaatatgtaaaaaaaaaaaaaattatagctcatgtatctataattacaaattaaattcaacagtcaaaccctcctctcaaaaataaatatatttaacaaaatggtataagaagaatcagtgtcaataacctcagattaatttaaaacagtttaaggtcacaatactttaaaaactggttctgacataagaacaaatcagtagcctatactagactaggctagagtccactagaaatctctgaaagcacatctagtatctatatgtgaggatgctaagatgtaacaactaaaaatttctggtaaagggtattgggaaaattgatttagtgtttagaaattatattaaatctggattccctcaacatgtcatatattaaaataaattacaagtgaataaagatttaaggaaagaaataattaaaatatcaagatacataaatgcagatgaatattaaccatgctcaggctaagtaaggactttgagcacaaaagtaatggacataattacaaaggcctatatcagtaaacttgactatgtaataatttatattcaacaacaacaaaactctagtgatcacaacaatctggggaaaagatttgtaacagaatttgtcaacaagttctcatccatgaatcaacaagaaaatattaaccctagtggacccgatttcacttattaaaagaaagcttctctaatctcattgaatgccagagaggtttttttaaatgattttattttgctttggcagtgggtgtagagtaaatattcttatacactgctgaagggaactgtgacatgactttttttggatgtcagtttgtcattatatattgggagcctttaacattcataccctttgaaccaattatatcacttatagaatttactctgtggaaataaagatgcagatgttgaagtatgttcattaatagacttgttaaatagccatccatgaaaaatggtggttttaaaaataacagcttgaaatgttgcttacataatatcaagtgaaataaaaacaacatacaataagatgtccaatattactactaccatttgagaaaaatttactggaagaaaatataccaaaatattaacaagggttaattttgtaaatgtcttctctatatcctttttgtaccctttgtattctttttgtgttttctgtaatgagtttatattatttttataagcagtttgaatacatgtgaaatgttaaattctttccagtatcttctcttaattgcatgtgtttttcactaaacactgaattggtttaatgtagaaaacttcatctgttcgatttcattctttaagtaaatacataaaccatatcgggggaggcagagaaagtgagttttgaggagagaggattttcatggtattcttgaaaggataaataaaagaatacacattttatttgacccccattagccatctgctttatacagtaaattgtgtttatgagatgccagagaaaaataactaatgaatttattcaaggtggtataaatgtgccagttacaaatttaaatttgtagtcatatcagtggacagttttgaactgagtaagatcttttataaaatcagacaaagttttaacgcttaggatgcaatgaaagaaatgtatgtgggagtctttcagttagaatagaatataagatggaacactacctggaacaatattcatttgagatgtgcgcagtttttctctattcctggaagctacatctttgttctgtgagaaaagcaagaggaggttcctgatatggtctgtcctttcagttatgctgtaggtagattgctagctagagccatttgaaaaggagcagggtaagaacatgatatcaatgtattatgggagagtagcatacatgaaagagtcacctttgtactacgtgggataatattccagctgataatctcctgcattacttaaaattggcagttcttccttcccaataataaaatacctggaagaaggagtttctttaagtcagaagatccattaatgtacaaataagttgtaccctatacatacaagtaagttgtctctaccctacaatcctgttccttcattaaaaacaaaaacacagtacctttaagaagtatctttttcctccataatttatagcacttgcctggtattgtgtttaattttaaagtttttgttttgatgcagggacaacgttttattaaatattaaaagatttgatctgaaagtgtccccacttaaagtaaaaaagaacaggcctgagtcattcagaaggcttttatatgacatgttggctttgaagaatttgtattaattattttgccaaaagcttttttattccttttatagaccagaattgaataaaaattgtttagtttagtggtacttagttcttagcatttccatttcctttccagcccttgttttctttcctcccaaccaaaaacaacaaaaaagattttcatattttcttttaaagcagaattctgttatttcttctgttcagaagagataagggcaggacgaaggtgatgattggtatttggtgatggaatgtttatctcactttggatttgcagtggccatcaataggggcgagctggtgaaaattagatatgcttgttagcattctgctaccagcaactactgtgtattggagaggccctttcttggtcttagaaggccaattaaaatgtgtctctggacttcagagggcagtacagatgacagtctgacactcatcctggcacttttgagtatcctcaagacattgacactaatgatttatgagttacgcatattctgtcaccatatctgctctttgctccacaccctctccctttctcctttcccttccttgacaatgtttgtggggtgataagaaagagattttggaaccaagaaatgagaggtggcgggggagaggaagatgatatatttttaacactctggcttcttgctactctgtcccagaatatacccccaggcaactggaatccccagtcggaaaaacactggagaatgactttccttctgcttcttttcccttgcaggaaacacatgaaattgtggcgatcaagaaattcaaggacagtgaaggtagatatatatatatatatatatatatctgtatatatgtatttttccttctgtataaagtttttatacatagagtgtggaagaagtgggatctagctggtcagacactgtctattcctgatattttgaagtcacaatctcagaaagtgaatatagcttatttcttatgctttgctttcaaacatttagttccttttatgtgaatcttttcaaatctcatgatattagaaaattcatctttttattttaaggttgcaagcagcattggaaatcttgctccaaaggctggttagaaggcatgttgtttatgctgtttctaaatattattaaaataaaaaaactggcttcaagtaaatacttctgtgggtccacataaatagcaagtactacatgaaagatttcagtattggttacggtgatctccagctcctagtcagagttagaaatacaaggatatattgagggattgattttatatttagaataatgcattgagagaataaaagctttttaagaagaaatactatgcttaggggccttcatcacatccagaccatttcagacagagttgtaaaattaccccatgctgggcaagaaagtttaaaataatgcatttcagtagttcattagttttaaaatctagactgttggccatccaaagatagccaaatagagaaactgataacaaaaataggtatggcctttaaggtgctctagacaacatttttttcagactttttggactgagacccacagtagaaatatatttcatatcctaacccagtgtccgcacacatatgtaacactatatgtaaatgaagcaaaaatgtcacgaacttcatcttatgaatgtgaagctctctactttctgttctttcctgttcatgtaaatgcctattgtgacatcaaatggattgatttcactactagtaagtcagagcctgctatttgaaaaactatggtctaagagtaagaagtaccaacacagcatcaatcttcatatctaattagaagtgtggaaatagcagtcatagcttaccttcatcagcacacatcccctaagtgatgtaagacaccagcctctatatttatgaacagtttcatcaccctcacctcaaagacttagcaaacattaaataacaaaaagggacttgctccaggatagatgtagtagtatttgatgtaatccatctctgatgtgctagttatatgaaacacatgcatatcagctgggaactttagcagtcattgtatgggcaggcttaaagggaaggtaaaaagtggaaggtaaaaaagaactttttgcttgttctggggggacaaaaaaatcttgcttcaaatgggatatttgtggtctagcaggaagcagtagctccaggctatcccactgtgataccattggaaatgagctctttgagcagtgactttgggtcagcaggtggctgagagacaaatggtgatttcctaaaaagaatggttgcaacagtagatcaaagcacaaccttcgcatgcatgtaaaggcttctggctgtgcattcatctttcagggcatattggcaagcatcagttaccaccaaaaataataactgtcatcaaattttgtaaaaagtacaatctaggccatgtatgccacctttttttgtttatgagacagggtctcacactgtcacccaggctggagtgcagtggcgcaatcttggctcactgcaacctccactccccgggctcaagtgattctacagccacagcctcctgagtagctgggattacaggtgtgcgccaccatgcccagctaattttttgtattttatttgtagagacagggtttcgccatgttgcccaggctggtctcaaactgctgagctcaaagtgatccgcctgccttggcctcccaaagtactgggattacaggcgtgagccaccttgtccagccccattactttctttttaagtaaataccatgttctttataatctctgtcttgtgcataccaattcttagcttcaattatatatttttacctgtgttaatgatacctttagagtggaaatctagtgtatccgttgaaattcattgagcactgagtgaagtgctgtaagagttgaggtgtggatactttcaagaagcatatgacctattaggagaattaagacctgcaaataaataacaataaaacacagtagaaaacagttattgcctgaatggagacatggaacttggatcattttgaggtgagagaaactgtttctggacgtggtattgggagttcatgaatagtctagacgtggaagacatttgatctgcccttattttattgaaccaacaaaacattaatctgctctgccctcatctctgccagacccttatcactcaccatccctcagaggcatgcagccttatcacccaccccaccttgtcaatgacacctacgtaccacctacacatacttctagagggatacttccaaaacatttctgtgctagaacccaaaaacataaccaattattcataaactttttcattccagtctggcccacttacctactgtttacatttctcccagggagatactagtactctcttttttctgtctttacccttttcctctggctggagtagtgtcttgcttaatggaaaaaagggtacatgtttggtgaacaactcttttggagtgtgaagtgtatatagatagtctcattcaggtaaggatgtctattcaacccctgggtaaaccatttaattctcaatcagtttattaaattttagccaattataataaaaaacagtgtcgtgataatattgccctcattgtcatgtagctctcattaatcccctttattagttattcttgaaatattcatttgatattatggcagtgattatctagatctaatgtttaaaagtcttagtgaagataacgaaataatcctgtaaaaatattgttaactgaaataggatctgcacttggtctgagccatgttcaaggtaatccagtgcagatgctccttgacttgtgatgaggccacatcccagtaacccatcataagtggaaaaaattgttacgtacaaaatgctttggctgggtgtggtggctcacacttgtaatcccagcactttgggaagccgaggcaggaggattgcttgagccaggagtttgagaccagcctgggcaacatggcgagaccctgtttctacaaaaaatttttaaaaaaattagccaggcatggtggtgtgtgcctgtaatcctagctactcagtaggctgatgtaggaggctcgcttgagcccagaaggttgaggctgcagtgagccgtgatcatgccactgcactccagcctaggcaacagagtgagactctgtctccaaaaaaaggctttactacacccaacttaccacacatcatagctttagcctagcctcctttaaacatgctcagaacacttatgttagcctatagttgggcaaaatcatataacaaagcctattttatagtaaggtgttgaatatctcatgtaatttattgaatactgtagtgaaagtgaaaaccagaatgattttatgggtattcaaagtatggtttctcatgaacgcatatggctttcatgccattataaagtcaaaaaatcgaagtcaaaccattgtaagtcgggaccatctattctctcactgatatcacggaatattttgtgagaatatatgttaatttctggtagctttaaaagattatgctaatgtcctactttcttgttaaattcatatatattcacaaatttataaaaaatgtttgtgaaactatattttgttagactactatttagttcaagaagtctttattatcccaggatgatagatcactatttaaaatgggaatcaaaatttcatagtaaataaaagtttattttgggactttaagtggataaaatgaaactaaaattatgaaaataagtttatagttaacacaagttaggttatagtagtaactaatatgctatttcaagaaagaatgaagtgttaacctttttgggaggaggaacagtttttacagtaaaattgtaggctaggccaatgaatagcttctatagtaaagagggtcattaagaaatatacaaaaagctttgtcagttttctcttcttcttcttcttctttttttattcctgtctatgtgtcttctttttcaggctgtgtgtgtgtgacagggtcttgctttgtatcccagggtagagtacagtagcatggtcatggctcagtgcagccttgaactcctgggctcaagcagtcttcctgtctcagcctcccaaagtagctgggactacaggtgcgcaccaccactcccagctaattttttcattttttgtagaggcaaggtctcgctatgttgctcaggctggtctcaaactcctgggatcaagagatcctcctgcctcagcctcccaaaatgctgcgattacaggcatgagccaccaagccttgccttttcgaggtttttattttctagttgttagcagatacaattctatcagacaatttatcagtgtctttgcctgtgattctctctgaaagactttgacaccctgacttggggatatagactcctattaaaaaggaagaatgtttgagtaatgaaaaattttgtctgagcttacttcattagttaattttttcttgttttgatgacttctgtttgttgacccttcataaatttggagtctgtgataatgagttctttaagataaccctaaatgatggtattataagtttggctattaagttcctgcagagaaattttatctagtaaacacctgaccaaccagaagtctccattgtattcgttctgctcattgtaatagttctgctcattatttggattttctgagaagggaaaaaatgaccatagatcataaagatactagagattatttagttaaaaggtacttttcagactatgtataaattataaatttagtccagttcttctaccctttctatgactcccatcttctacagtgagatttgatgttcagatgataatgtatcactgttgttttgtcaagacaagtacaagtgtctgctgtcctcaatttattaaataacccaagagcgctgatttagattatatagctttggaccagcaagaattcaaaatattgtctgtccagcctttactttaggaaaacctattgtctagaatttatttttgacatacatttggaccttctttttgcttctttagacttttccatctttccttaaatgtaaggtgatggagtgaggggagagcctctctgcttgtcactgggcctctgtgcatggcaaggaggctgactccagggagctatacactagtctacatttaagatgaaacttaggttgtgtctctgcttttatataaaataaaattacttgcatttcgtattctgctgaatgttttctatagagaactattttcctcttggaatggacatattcttcttaattattagaaaacatttaattgatcatctgttctgtcttctaatttattttattcttctgtttacccagacactggaaagctctatactgatctctggatcaggagtactctggtctcttattttatataatggtacaaaaccagagttcgtaatctggagtccttaaattcaagagcctgatttctgtgtgaaagaggccttgaaacaaaaagtccaacccttgattaaacaaataatttgattaactgagcttgagcattctggctagtcatgattttaccacacttccttttcatgttcaacatggacctccttcagacttcagggattcttctaggatttggtgatcattttgcatcttctgtgatttaataaatttctactgtgcttttacctgttcttcatctctaaagattggagggtcctcatctttcttggtgtatgtaacagtagcactagcattcaaactccctcagccacattgtctgtctattgatgtcccttcttcaataagagcaaccagactcaaatatggtacccccgtggttttgatcaaggatgggttgatttttctttatcagtttatctgtgtaaaggtccatttggggtggggggctctttggctatacaaaaatgtcaggtttgtgatttcacaaagtaggttacagctattcctggatttcctttctaagcccacagttctttaaaaatagagttacaatagagtttctgctcatctttagatttttctcttttcatcagttatctttgaatctcctttgctcctgtgatctttcttcttaagaattgttctctttagcaaatcgctcttgatttttaggtgtgttaacttgccttactggtaagtttagaagtaggacagtttttgggttgtttttacttaacatcctttttccaccctgccattttgtcctcactcagtggggtttctatatatctgcacataactttgtcagagttgatcctgcattcagctaaaccccctcagtggtaactgatgacaagatgggtcagcatgcacataagcagttatcacatagaagtatggactcgggaagagtccttctgaataatccagtataactcagccccagtatacagatgatggacctcaggctcaaagttgcatagcgtgtatgtgaataattgcaactaaaatgctgacccaggatctttgttgagtttttcttccacccatactatgccgccttgccgttcagctaaatggtagcatagttatacctgaacctgggtactgtgactcactttccaaaactcactgtattgtatactatgccacctttgtgcctgtgttctactcagactatgaggttgaatatgaccctccattcatgcaccctgagaaagttatcctttctagacttgatttcttcatttgtaaactggagcccagccttgataaagaatcctagcctagacaaagaatccacggggattatttcaactagatggcagtgatttttgtgctcatttcagtgggctgtgctaccaccctttgaaaatgccttactgaatgctttttgtaaggcattttgtaatgccttgcaaaatgctttcctactttgtgtacctctgagaagagaagcctgtgtaattggaatgtgccttccttctcccctcatctgataatttagttgacagttttcatcataaagtgcagggcaggccaggaaccttcaaagtacttagaaaaacaaaattataggatgtacccagtaataatgaagagtgcccattttgcttgaatttagggaattaactccactttctgcctgttcccattcattgcaatcttagtgctcaagtgtttacctcaacttttaatactatgactggcataaagtagaaaagcctttatttcctaaaaacagctgctccaatgaggttgtttgggcactacattctaggtaattttgtgtgctgctttttgatgattcatttatcttctctaaccattgttaagtggagtcaatacagattcgaataatgtatgtataacaaagcagccaagttccatgaggtttaggctcataatcaatacaattttaatgaaaagaaataatagattattagacttgaaaaaggcaataggatttttgggagatggaggcatttatttgtttcttttactgatgaaaagttaagtggcttgcctaaagttgcatggtgtactgttagttgattaaaagaccgagtccagaatctaggtctccctagttagtcctggtccactgttccttctactaaaaccatcctgatgcagccattctgaagagggtttattcattagcaaagtgaaactgccacaagttggtaataaataatagtacgatgttttttcatttgcatttccagtaccaagaattcacaaagcatcatagtttatggacgctcttaatgattttatttttatttaggtatttgtgtgcatgtacttgtgtgtgttcttgaccctgagcactgtcagtgttctgtatcctccatcatttctaatcacatactgtagaagacacctagggacagaggtgaatagggagaagagaaaattcagtttatcgtactgcctgataagcggtgcttgaggaaattgacagtgctgtaagaaaactgagaggcaaagtgcctattgtttgccctcccgttgctgtggctgaagtgaggaagagttacgcatgtatgggcagagatttccttatggccacaggtgaagcattcatgtaggaagaatgtattgatcacctctccttgtgtcaggtacagtcctggtgtatattgttgaacagaagaattgagtcctgtcctccatgagctcttgatttagcagggatggctgcatagattgcataccactaagcaaacaaatatatcaagaaaaatggtaagaagttctgtgaaagaaaagtccagaactgtgataaggaataatggggatggaggcctacttgcttttgtggtctgggaaaggctctagaggagtgatatttaaactaaaacctgaaggagcaagccctgtcaagagcctatgtagtagactgagcattgtaggcagagggagcaagtctgaaggccattaaggtggaaaaatgaagtttggggctattttgggaactgaaagatggaggtgagggagagggacatgagatggggatggaaaggcaggcacagaccaggtcatgagtaatcagtagacttgtctcttgttaaattagtcccttgttagatcatttgtttcttatttgagatctgtgtgttattctgtttcttagagatagatggattttagtttgattaccccaaccttgagtaactcagaggggatattagagaagcatgttctcgatcttgcttctttaggaaactgccggtgttcctgtgcttcagcagctgcagctaccttagcattctaacagtcacagaacaccactgttctggctcacccccaacttgcagaacacctggacctttgtcccctcccaatgctctaagctactttgggatgtccccgattgcatctcagacattcccccactgccaggtgacatccactgtcatgctcttttccctgtaagtacccagttccctgttgactgccttggtgtgatccaggtaattcgctgcttatgccacagttggcctttcctactgctggttcttgtcttctcataggcagtatctctcttggtcctaatctgtgttccagtgttctccaacagctttctggctaaagtagaatacttcatttatgtaaccagttcacaagggagtgttgactccgtgttcccagtttgttatggatactcgggtgctacaaagcccttgcttttatgtcattcccttttctttaaactcagtttgagttgggggttgggaaagggggctgggatagaaaataatctgaggaaacattcctgggtctgcatttagaatcttccctctccctttggaatccattcagcctttttcctcctgcgtgccttggttagagagcctttcttctagagggcatatcaagtaggcttccgtgcccctatctccacactccattttcctccttctcacactgaaagatgtgtctaatcctgagggtcacacagctctcaagctaggattctggcccttacccaaaagcttgtggctacatgtgttttagacttcataatttttggattttagaatggacgtgtggcatgttataatgcacagcactcagtaatcaagtagtatttctatagcacaacatatgaatgttcatattagattggataaacaaagactttatgtagtctcctgtcagttcaggtgttacctctcagtgaatttgccccaaacttagaaaaagctttcagtttttagactgtgttttggattttggacttgcagatgagggattatgaacctgtatcctggtacatacatgcaaaaacatggtagttaggatttcccgggtaaatctaaaggtataataaaaactaatttaaatagaaatattattttcatcactcccctgccaattaatctattagagttaatatgacttctgtccttcctccataaccacggagattatcatgaatgaagttgatggtatggaagagggtctattggttcagcataagttctccatcccagaacagctacaccatctgggatggacagatggacatgccacagggaggacagcaggaacctacagcagctgctgttcagagagaagattagacactctcagaattccctgcaacttggctgtgacttgaattgtggatgcttggcgcatgacctctgctccctgaggtgactcatgcagcctgaggaataaaatgtttttttaggccaaagtttcaggccatccttaaaaacatcagctactacagatgccggctgcatagaggttcttctgcacactgacagttttgattccttatggcccttttaatctctttccttccttgtatagagtgttatagttcagatgacaatggaggcatatgttgtatctataagtgtgtttttatacatacacgtagtaaaagaagtataagaaaatttttatacatacacatagtaaaaggagtataagaaaatataagcaggaagtcaagtttgtgctgatcaagtaaaccctttcttcgattttcttattcttgatcctttcaacaagaaaacgtgttatttaatattccattcttgtacttcttatgcagaagtactcaaagcagaaggtgaaattgggatgttttcagtgttcttggaattctttgaatagtagcttgaaagttttcattttagtctcttcaccattgtttacattctagaaaatgaagaagtcaaagaaacgactttacgagagcttaaaatgcttcggactctcaagcaggaaaacattgtggagttgaaggaagcatttcgtcggaggggaaagttgtacttggtgtttgagtatgttgaaaaagtaagtcattaattgccaatgtgcacatttgcccgattcttttatttaaggctgtttctgacattatttaagaaagtactgttatctaatatggcttatcaatgtactcataatctgaggactttaaaaatgaaagtgttgttaataatcattagaaattctgaaatatatttaagaattttgtacaattaaactgtatagagataatcgtaagtttaaacaatatactgatttggcttctgaagtcttaaactctatgttcaacaagtaatttttagacttgacttaactaagcctaaactgagggagaaactggtaaactgacagtgatggtacaggctggaagaggctgtataagataccacactgaatcagacctaggctggggaatgagtgggcccaggaagcagcttatgtgaactgccaatgctttggctttatttgagggaaggagctgtgccaggaggcctaaggtgaggcttgaggtggtagatgagaccgtaaaagaaaagcatgcattgtttgagctgtctacacttgccttagcttgtattaaaaaatgttcaacttgttggagacaattttaataacatgacctaagggcaaatgtatgttacagtaatcaataatgtgtgcctagaaatttcttggagaggggcctggtgcagtggctcacacctgtaatcccagcactttgggaggctgaggcaggcggatcgcttgagcctcaggagtttgagaatagcctgagcaacatagtgagaccctgtctctaaagaaaaagaaaaagagaaatttcttggagagcagctgacctacagcagttgttatggtcaaaaacttaaacagataaacactttaacagtagtagaagaaactggagtggggcaaacctttaagcaagttttcttgatgagtaaataggtggctcctgccgattcctatgctgttgtccaaagaaggttgaagtgggagaagtttatgtttgctgcaggtctatacccaggtgcttgctataccataaatgacagagtatcaacattgtcataaccaaatggaaagcagtattgccagggtaactgaccagtaatgtggctttgaatgcattcagcctttacaaattgttttttgaaataaaaaaaaaaaatacatgtaataatttccttactagaaaaactggaacggtactagcaggttgtttgtaatcttaaaccactgctttatgttccttttccagaatctgttttaagtttctttttctgtgtcaacttatacattcctctaaggtaccttccacaccaaaataaaactaaaagttttttttttttttttaaagttctattaaaaaaaaaggattgctgtattaggattccaggggaaaccagatgctctttattttttaaaaactttttagagatggtgtctcactatgttgcctaggctggagtgtagtggctattcacaggtatgattatagcacactgcagcctcaaactcctgggctcaagcaaatctttcacatcagcctcctgagtcgctaggactacaggtgcgcgccaccatgcctggctgctttttattttttcattatcataaataatcatgcagtttgtagttttcactaccaaataagaaaattttgacatctcttagtttatcctttttatttttgttctattcatggtggttgttcattattaataataatttaatataacaaatggagaagtcacttctgtgtatctgtttcctcactgggagaggcaattttgtgtgtctgagatctccctgctggtaaatggctgagctgctactagaactccagtcttctgacagtcaggcctgagattcttcccccgatcctgtggttcttaggtagaatgtgactgtcacacctgccacattagtggcagtgcgtcataattgacagtgagtctcaggagagcaaggagaaagttctctaagggataagggactggtaacagagacccaggattgcagaggcttaaaatagaagtttctttcaccctcacatataaatacaaaggtagggcagtacaggactagtgtggcagctctgctccaccacagcgaggtgtgacccttgtcctcaaggtcaggatagagttccagctgtcatatcccattggccaggacatagttgcatgaccacattagctgcaaggcagaagagaactgtactcttcgttctgggcagcacttgaaaattgtgttcctgcggagtaagggaagactggatactggaggacaatatgtctgccactgaggaatttagaatagaatgtgaaacaagagatacaatttgttttctatattacaaagccttcttattccacctgtgcatttgggaccatctatgaatttgttaattgaaaaagagaattcaaatggagaatcaaaaaatgatgcatacatacttaaaatgtttattttaattggaaacataaatactgtatgtattcatttaccacgctataaaggtagggtcaaggccttttgcctatcgctcttctgaagttctgattggtcttttttacatacatcatactcgtaatgcatctttaaggtaaagcaaatgtgcaaaaacatctgcaaaggaatctcagtgcagaatccttcaattggacatgcttatccccactagcacccattccttgccagtgttttgtagttgtctcacatttgattagatggcaataagtttagtggcttttcatttattaagcctttctaaagtattcaactttgttttcttataaacaacaactctttttttaaaaaaacattatttcatttgtttatatggtatttaattatattaaaataacaagtgcatcttttataaataggcatgggagtaaatacaactgattcttgataggtatacaacttgactggtgggaacaaaactgtgaggccaaattagagcagtgattttctgactggtcttatggccccttcacactctgaaaattattgggaaccctaagaactttttatttatgtgtattttatctattagtgtttctcatattagtcatgactgagcaatataaaaatattagttcattttaaaataacaataaacgtattgcatgttaacatagataagtttgtatgtcagttattctttcaagtgaaaaatggcattccacataaaaagcagctcattcagcttgcatctcaatcctctaagtgcttttcctcaggacaaccattggacagatggtgcatgtgcagcagaagggctttatgtgcagtctgccattttatcatgcagattccaaaaaagacatgtactcaagaattgaaatttagtcaaagtaatattttgtactgcttcatcaaagatgtccttaactaaaacgtctgttttcttttttaaaggcaaggtttaattggattaaagaatccaatgccttgattcatgctgaggtgccagcagtttacccattgttgctttgtaccattagtgtaaatgccaacacagtgaaaaaggcaaacatcacagtcttattatgaatatagttttgacttcatgggccctccgcaagatctgagaccccacagatccacatgttacactttgagaactgctgtcctagatggttgcttacaaacaataagctgtgattgtaccacgggccttgtactttacagtgagaaaggagaatggttaatctggaaattcagtagagaccggctaagtggaatttctacataataaaaaattttgcatgaattttagttataatggtctctgactccaaattaaggtttttgaatattgaattgtagggggtctgtgactctttatttcaatagtattttctggcctgtttgaatttttgtactaaatgtattgatcatttttaattttggacatttttttttctactaagaatatttcgtggatcttccaggtgtattttcaaggcttgatttttatcacaagattctgttgcagagatacagcacactgtgtttaaaaaggctctttcccccctttatacattacagtgtcatatttctactttgtattgcttttctcttctaattattctaaaataatgcctgaaaacctttagggagagtgaaaagtatacagggttattatttggggtagcattagggaatagtaaaaatggaattcctcataaaagaaagccccaattttaatgctgattcagcatgagaaagttgtagatagaaagcaaaacaattaaaaaaaaaagctctgtattggatgaattattctagatgctttgtaaaattgttaatacataatttacgggcctacctaatttgggaaataatgactctatttaatttttagaatatgctcgaattgctggaagaaatgccaaatggagttccacctgagaaagtaaaaagctacatctatcagctaatcaaggctattcactggtgccataagaatgatattgtccatcgaggtgagtatgagatttttaaaatggaaaatattaaaacatcaaataaagttaagagtatttcacatgttactgtctttaagaatattttcataagcattggcattgccatttaaattaaatatattttgaaagtgcaagacatgagaaatatttgctctccatatctccttttctatcaccaaaaggatggattacaaatttatttggatattgtggtgagatctttacatttgtataactattatagatccactcccaattgtagaaatgcctagtgatataagagaactcaacaaatgtgaactttgaaacttacttggggataggagaagagcaaaatgttgatctctatagccttggtcctgcaggtagaccaggtaatgtgaaacaactctgaatcaggctttatataggtggttcctaagtcactggcccctattggcactcatgtctcattccttcttacaccaacaatctccagtatgtatcttcacctcctaattttctctaccccttagtgaaaagtgcccgttgtctgcagttgcaggcatgatcaaccttgcataaaggtcataattatactcccataaactgttttgtcctttactgccatgaagtgggtggtttatagcaatgaaagggaaattacttgctcagcatcaactttgtctcttctcctgataatctttcttgcactggagagttttacagtagtgggacacaaattgatacaacaatgaccctaaatatttatttaaaaaattgcagtatttactttttgtctttagattagcagataaaagaatgctacattttaatttacctatacacaaatgcacaaggatatcactttaaaaatattctcacttgtgagaatagtttaaaggtcatatgaagaatgccatcgtcttttattcctagaaacagtttatatttctcttgcatttgactctcatagcagttaccttatcaagattgttggtagcatgggtagatctccacgtcaactggacatccagtgtctagggtaatgattctagtaacagtctatactgtagtttggggatattaatgaggagccgagttaggtgcatttccatcatgatactgtgatttgattatgtgcatagtgaatcattggttgcaaattaatggtagaaaccatgatttgaaatctacagatttcactacctctgccctttctccatttgcatctctaccatatgatatagatcatgggtattctactctaaaaatacaattgcgagatgcctcccaaggagagaattcaactgcattttctgtgaatttctacttaactcccaccacatcttcataacatccatggaaaaaattagaaatcttaatttgactcatccagtatggcttcagcattagacattgataattgtgaaccatgcagaaaagctaaagagacgtaaatatagaaattatgtagaagaatgtaacagaaagcatgtcttgtatgtcttctccagtaaatataatgctagctacttattctcatgtatttttaaagtatcttgtgggtgtaaacattttatatttctatctccaaaaatttgtattactagtattttatgaagtaataataggtttttgaaatgtgttggcctatatttaattattcttaaaattctttcagagatccaactaatccttttaatacttaaagaggaaaaaaatatttttgaagttgtggtctgcatgtttctgagaaagaaattcattgaaacttttatgtaccagcataaaatgtgttactttatttttgctgccacagttttctattcaaattactctagatatttctaattagatgctattacagtgatctaacagtgtcaatcaggagaacatagaacatttttactaattttttttttatcttgacactccagatataaaaccagaaaatctcttaatcagccacaatgatgtcctaaaactgtgtgactttggtaagttaaaaagaaattaagtcctggtacttacagaattaatttattgtaacacataggtagcttttaaaggaatattaaaagtaattgttatgttttgacttaaattggtagaggaacattcttttgagtcacatgttgaaaaattgattgctggaggagtactgctctcttcagagtattgtctatttttaaaattttatcatggtttttgtttaatcagaactaattcaaagcaaatacacccatatgcccaatatctaatgacttcacaaaaattttttttgaatgttgatagttgttccaggtttaatcatgaacactaaaatatccctctgtaaatacacataagtattttgtatatgcaattgttatatatctataaagtcaaaagacatttttagaacattttcatttgttccctctaaatgttcaatgaatggggttagtcatgtataatattacagcttttgattgaatgtatagggaaatttttttagttgtactctctcctagtagaaaattgtctgtgtctcccatgtagataactctgtattaagctctattaaacatttaaattaaaataattcagaaaaaattttagattgtatgttagggtcatgggtcactttttaaaataatagttttgcctaacctgtatgctgaaaaatgaacacttgattttttaaatgtcttttttcatatatttaaatataatcacaaatacaatgtaaacctccacatataactaagaatccatctccttataaggaaaaattagattagattagtgcataggagatgaattacacaagcaagaaatagaggcattgtcaaaatttgcttcgtagaatgacccattttgtccagtgtagcaaatggaagcatgtgtagctcttgtcactcagtattttcaaagattttgaatattattaacctgtttgtctgagaaaaaatgttttacaggacttaattttcttcatattttatgataaggaatgatatgtaaaagagtctgtgtcctaaatttataaagaatgtacttaggaaaaaggaaatattgaatactggatctgaaagattttaattgtggcatttttagcattttgttagcattatgattttcaggaacaacatctgtttctgatttcctgtccgtgattgtgattactacccaaaacagagacttaagttactgaaaatataaagcaagttataaatataaaagaatgcccatagaatggttagtagtaggaagagtactcctggtctggcatttctcagagaaaagactgttgtaaatggtcaggaagttcctcctggcagcaccacatgcggtatcctgtgtcctgtgtatccctagcaaggacttcctaattgcttcccctcccagagtacgcactccttggtctgacttgaagaaccccattcaaaaatacaaatatttcttcaaagcgtgtcttatgaagaaacattgattatctgaagttaggggttttgttttacgctgggattgtttttattttttaccgtttcattttaagaaacagtattttccatgtctcaaaactgacgtacaccttgatttttactcttaattttaatgttctgattctctataactattcacagtgaacctatgttgtgtttggtgagttagatgggtgattaacttatcctcctgccttattttgtggctatgcagtagccctaaaaccttttcaaagggtgggggtaaaagtagtggtagagtctgtaattggtaactaagatacccctaatattctcagtcattaggagatgatagtaattttggcctgctttgtttccatcactgtttatgtaaaggctagaattgctcagcaacagtacatatgcaaatactgtgtaagtgccacatagcaaaattaatgaccgtctacaatatgctagtttgactttgattttgatttctagcttttgtggggactttatttcatttttttcctaaggtttgcatttattgggagagctgatttaaaagtatgctctgaataattataaaagcatgggatgacttcgaaaacccggttttctttagcatagtgaagagactggttttgtagtgaatacattgtatgtctttcaattgacatggaacactctactaactttttaagataacaaggatattattaataaatagcccatgcgagaacagtcattacattcttttgatgttgtttaaagtattactagcgctgaaatattttgcccacatgaattattatttctttttcaaagttacaactttggactttgctatctttcaggttttgctcgtaatctgtcagaaggcaataatgctaattacacagagtacgttgccaccagatggtatcggtccccagaactcttacttgggtgagttaccgtcccaaaatagaatgacatttccacatctgctgattctattgtcatttgctttgagttcatctatggaaaataagaacttcagttaattaaatgtgtcagttacatattgcagtataacaaactacctaaaacttaatggtatgaaacaagcacctttttgtttgctcagaattctgggtgtgggggaatcaccagtttgagttcagctggatggttcttctactggtctctcttggagtcactcacgaagttatagtcagctggtaggtcttctgggagctggttagtttaggggtctcagctggatcagaccatctctgatccctggaaacttatcctccagtaagctattccaagtttctaagtgtgatagttggagaattctgtgctattaagagggtaagccccaaagcaacagcagctttcaagcctttttttgtatggcttttgcctcgttggccaaagcatgttacatgaccaacccctgattcatggtatggagaaataaattccatctcttgatggggcaagtggcagagccatattataaaatggtatatgtatggaaatggaagaaattaattgtagccatctttgctaataaacttccacattaagaatgtgaatatccacacagtttgacattctggcttatctatttgttcatttattaattcttcaagtacttatcaagtatctcttatgtccaaccactttgccaggcacatagagtaaatattgaaccagactgagcacagtggctcacgcctgtaatcccagcactttgggaggccaaagccagcagatcgcttgagctcaggagttcaagaccagcccgggcaacatggtgaaaccccgtctctacaaaaaaatacaaaaattagccaggcatggtgatacctgcctgtagtcccatctacttgggaggctaaggcaggagagtcacttgagtccaggaggcagaggtcgcagtgggctgatatcccaccactgcactccaacctgggcgtcagagcaagactccatcacacacacacaaaaaaaccccaaaaaacaaaaaaatggaccaattgccatttttgttctgaacagtgtaaatcctgtttgatgataaatggctattcaaactagcactgcattgatgattttctcagtaacatctctacattgatctactttgtggccaccctttaactttcaatgctctttcattcatctgttaacaccagaaaaaggtcttctgataaggttcttttctttttagtacattttaactttaaagcctaagaaggagcctgtagttctcattaataattctctacctaccctagttgtaggattattttccttagattgtatttccttctttgggaccacccaaaaacagataatttatactccacaaataaaattagatatagtgataatgatgacaagtgcgcaaattgtaggtctcatttctttaatttagcatgccatacgtgtatctgggggacatgaggaatttaatttttaaaaatgttttttatataatagcaatataagtttctggattttttttctgaagagcatgatgacgacatgtttaagttactcactgagggtttattttgatattaactacttattttccagtgtctaccaaccgtctagtagtaattcttgattcattgctgacctaaagcctgtaagaatcattgacattagtttttgaaagctttactattttttttaaatcaaaagcttgctttatcctgaaaaacaaagatgcttagtcactttattatctcttccattgtgtaggcagagtttagagtttttatgctaatttttaatcttagaattaggattgattttctttgtgtttgtctatatttcttccgtgtaccttttggactcattgggatgcatagtccattttcttttgggagaattgaatttactggacactttaccaatggagaaatgagtatgaagtagatcattcttagaaccccatctgaggactcaagtgtagtagaagggcttgttataatatggtggtgtctgtaacatggccccaaaaagtttattttgaggacagccttattgtgaatcttcagagagtatctgctgcttaataatacctgtagaaaaactggagttatgtttagagatgtgtgctagctgctaaaagtatggggacaatgtaactaaattagtgctgaaatgaatattgctaattaagtgattgtcaagtactagttgaagagccatatttgtaaaaatccttttgaaatcaggtatttggttatacattaagaatttaagttttatatattctcaaggctttgtccttgacattcagaatcattccagctgcataaattattcaaatcagatgacagaagaaaaatagcttgtagtgagtatgtgaaaattttccataagtttctccatctagcactatggaacaaattttctctttctcaaacagatacgaaagaaagatcagtatcttgccctgcccaacaaacttaccaaaaagatctaaatgaagtttccttgtgtagttcttaggttgatatgggaaggaaatgagataaatgaaatattgacttattattgcaatgatttgttatcctagaaatttgttctgtataatgttaacagtcctttgatttaaaagttttgtttcactactgtatcattttagcattccaaaatttctttccatattctttttcagatattttcttttggctttcccttcttaaagcttggattatttatgttggaaatgtgtgtgagcgtgcacgcgtgtgtgtgtggtttcttaatttgctgtaaatttaacactctagatataaagctgttttgaggatacctagattttcatatacaacctccatttattaataacagcaacactcctaaagccctctggtaaactcacaccctagaagaagctataaacccctaaataaactggaaaatgttttgagggaaatagctaccataaagctctatatacataggttacatatattatattcaaataaataatatagtagatcttagcacaatcttagtcatcagaaactgtgatgctgagcgatggaaggttaaataatattcagtgttaaggaaacacataaatcagtacatagtaaattttaatagactgaactcataaaatggataagatgtatctttttgacatttagagagctaaaggataattatttgtcttagaaaatacaattatttggaagcatttcattccccaagtgaggtgttacttgccagatatgtatactgtattagggtttattaagccgttcacatttaagatacatatctatttatgtgaataaatttcaaattagtgtatactaactaaattgttattaaattgatggctttattagcataggtttattcacttgtgttctgatgatttgcttttcagccttcttttcacatggaactttttaatttcataaatatacaagtgtgctgcacataaatttgttcacaataatttggaaattatcaaaacattatattttttcagttgccaaaataatctcttcctttatttttcagcgctccctatggaaagtccgtggacatgtggtcggtgggctgtattcttggggagcttagcgatggacagcctttatttcctggagaaagtgaaattgaccaactttttactattcagaaggtgctaggaccacttccatctgagcagatgaagcttttctacagtaatcctcgcttccatgggctccgggtaagaggttttgctgaaacccaaaatggaatcaatactgcagtatttgagtcattgttcattgcacaatggaatgctaaactatcctttgaatactatttcttttcccattacagtgtttataatccctattataatattttatttccgaattttttaatagtacttgtggatttaaaaagtggttagaattcaaattctaatcttttttctaatttttaagttccagtttttcaaaatcttttttagtgtatacatttttacacactaaactttggttatcttatattgtttctttatccaaaatattaagcatcccccaaatataccaaatgtatgaatgttgaacaaacatatttgtagtgatttgaggaaagccctgaaaacttggattccccagatttgaaggttcttgttttagtagatgtttctggtccactgacggtgaaacatcaaatcttcttttcaaattagtgtattgtcttgggtccgtgcatggtggctcactcctgtaatcccagcactttaggaggccaagttgggcagaacacttaaggccaggagttcgagaccagcctggccaactttgtgaaaccccatctctacaaaaaaatacaaaaattagccaggcatggaggtgcacacctgtagtcccagctactcgggaggcagaggcaggagaattgcttgaacccaagaggcagaggttgcagtgagccgacatcatgccactgcactccagcctgggtgacagagtgagattctgtctcaaaaaaaaaaacaaaaacaaaaaaaaaacaacaactagtgtattgtcttgggcagcctttcctagacttgacaactttgtacaaaacttttctgagaatatgtgaaatagcgtcttagaaagtataaactttccccaaatgaggaggagtcaccttattagagtgcccagtgagttataggctacttcttccacctaccccaaaaacaactttttaagttttcagccagttttttttttttattatactttaagttctagggtacatgtgcacaacatgcaagtttgttacatatgtatacatgtgccatgttggtgtgctgcacccattaacttgtcatttacattaggtatatctcctaatgctattttcccccctcccccaaccccatgacaggccccagtgtgtgatgttccccatcctgtgtccaagtgttctcattgttcatttcccacctatgagtgagaacatgcagtatttggttttctgtccttgggatagtttgctgagaatgatggtttccagctttatccatgtccctacaaaggacatgaactcatccttttttatggctgcatagtattccatggtgtatatgtgccacatttttttaatccagtctatcattgatggacatttgggttgggtccaagtctttgctattgtgaatagtgccgcagtaaacatatgtgtgcatgtgtctttatagcagcatgatttataatcctttatatacctggtaatgggatggctgggtcaaatggtatttctagttctagatccttgaggaatcaccacactgacttccacaatggttgaactagtttacagtcccaccaacagtgtaaaagtgttcctatttctccacatcctctccagcacctgttgtttcctgactttttaatgatcaccattctaactggtgtgagatggtatctcattgtggttttgatttccatttctctgatggccagtgatgatgagcattttttcatgtgtctgttggctgcataaatgtcttcttttgagaagtgtctgttcatatccttcacccactttttgatggagtagtttgattttttcttgtaaatttgtttaagttctttgtagattctggatattagccctttgtcagatgggtagattgcaaaaattttctcccattctgtaggttgcctgttcactctgatggtattttcttttgctgtgcagaagctctttagtttaattagatcccatttgtcaattttggcttttgttgccattgcttttggtgttttagtcatgaagtccttgcccatgcctgtgtcctgaatggtattgcctaggttttcttctagggtttatggttttaggtctaacattaagtgtttaatccatcttcagccacttttttgggccagcatggcaattgctggtcattgtgggagctataaaataatctccccaccatttctttcctttctctgaaatgcgtagttctcaaaccatgttaccttgccatttacaaagcactttgtttttttcttttgattttctggcccccagttaatttccctttagagaccaccactgctcaaacctgagtgcccaaccgtccagatccttctaggctcagtgaatgtgggcgaaatgaatggacagaggcatgccagtatcttttttatctcctgctttttgtctgtctttcacatctgtctgagttacctcaggcaagtttgttgtttctccttttatttttgcttttgtaagccagaaatttgccagctatgaccagtaattggggtgccaacagcatatgtggttcagcaggttagctcaacatttttgaacatttgtcatactaggtgttggaaatatgacaataaataggacttgtccccagtctagaagaaagaaaaatctattatactcagaaataaagttagtcataattaatgaattgcattttcactgaaaatcaatctaaactccttgccgtagcctatgagaccttgcctgacctcatctcgtacctatctccattccccccattctccagattctcagcacacttgccttttttgttctttggcttccataaacattccagggtttttccagtttcatcaacttgggacccatggctgcttctcctggcaaggtgcttccctcgtgtggtcccttctcattctgtcaatctcaaagagtgcctctttctctggccacccaacgtaccaccctcacctccatcctagtctttctctcccacagcatcctttttctatcatagaacttaccacagtatggaattattttgtctgtttctttacttgttaattgttaactatctagtcctctcacactggaatatgtttctcaagggcagaaatcaactgttttatcacatcacagatgtgtttccagcatttaacacagtatctaccatatccagtgagtattcactacatatctgagaagtgattaaccagtctgtggcatcagcattgaaactcaactgtatttcttttctctccatctctcatgcttcttttacccttttacctttacctaacctttgaccaccacccccaaatagatcccccgatctttctcttttcactttagccttctcacatttctcaaaccacacaattctcttttttgtttagaaacctctacaaggttactgataaagtttaaactctttagggtagctttaaaaaccccttcttagttctccagcttcatttctgcctccccgctagcccagtttgtgctctttggccacattgaacctctcaccatttccttgacatattgcttttatagtctgcatttccatctctataatgctcccaacactcacctgtctttcttctcctcctccttcctcccctagactcaggccaaatgtcctccctccgtgaagaccttctagactattcgaggggaaactggtgaccctataacactctggttatacctcttttgtagcacccattgcattctcctttaagtagctgtttgcaaatatgtatcctcactggactgaggaaatgaactgttatgttcaccattatatttgcagcacacctagaatagtgcctgctaggctgaatagtgttgaatgattaaatatttgacctcaggattttaacattaactgctggaacattaagcctggtttgctggctgacttgttcttggcctggttaatggggctgtatgccggattctctgaagagagtatgaacagatctgacatgctgcttggccttaataacttacaaactagctgaagaattaagactttcatccatgaaataattagaaaacaatacaatttataagaaagcgtggtatataataaagtactgcattgtttacctcattgtacggttttctaatgtatctccatatggtttagaccatgagagtgtcaaatattctggaaagttagaaatcatcattggggattcattagagaatgctttatgaagcatttgacatttgaaatggatattgaagaacgaggagcatttggattagataggccacacaaaggattatctctttctcatttgtctgtggtcctgtttgttcatagtcttcttccctaaacaatactgtctataaaattctagacagcgtgtgataatgctgcttacaaacatccttcagggaaattgctgcctccatcacactttgacttttataaaccttaatactttacattttagtctgaaagtgtttgtggtgttttaactaaattagtttaatctctttggaggcttgacaatatcttttgagggagaaattttctttcatgatgttatttgaaaatgtctatgacagatagctaagcacatgggacatgtaaactgcatctgctgtgcaccatggactcaccagtaaccagtccagtgtgatgtgcatttgaagttagttgtgtagagacaggaaaatctacaagatgttgctatagtggtttgcattattgggataaagtaacaattgatgccccatagtatagggcctaggctctggagttagattgctgtggttcaaggcctggttccgtatttactattttgaatgatgccaggaagttatttcaccatcctgtgcctctgtttcttcttgtgtaaaatgatgataaccaaaagactgcctgattggattggtgtaaagatgaaatattatttgtaaaatgtctagaccagaacctcacgcatagtgctcagcaaagaggcattctcattggattgtattggattggccaagtgattcagaaagagacaagactgattgagatatactttaaacttctatgcatgagttttggctatttgttgaattatttcatattagaatggtaggtctcactcaaacgcatgtaaattaattctttgaagttaggagtttgcttggtcattttttattataatatttctaatacctttcgactttcagcattaattttcttatcaatgaaatttcactcctagaaaaaataagggggtatctggtagcataagatagacctcatacacaaaatattaacatgtactggtatagggtcttttatcacagcatggtaggtgtctttctatttgggctgatatttaatgctccagtaacatcgaagggagcctctgtacttcccttaggagaggcacctaggtttagaaagagtgtgggtttggatcacaagactgggtgcaaatactagttctactgctgtttaattatgtaacttgccttgaaccagttatttgaactttctgattgtcaccttcttcatctctaaaataagaataatatatccaaaatgcctcgcataacatcacttccctcagaaatcagttttaggttattgcctgtgcatctgtattgagttcatgttattccttctactcctctatctggaaggtgctgtcctacttttctctgtcttcacatttttcatatttttcaaaacccaattcagatattacctatgggttctttcttccacagccataaaccatcttggtctttcctttctctgagcttcaattagaatttatggttgcacagtttaacattgattgctttcccaaccagacagcagattcctcaagagcagggtttgggtcttacctgtattttttgtctcctgctatccagagcatggtgtggagatgatgtcataatcactccttaaatatcttgtttgaaattttactgtataattagtcctcccatttacttatttagcatgtttagggatttcggtacttagaaatgcttgtatgttggtatagaggaaataatgtatggaagcagactagccctgacatttggaagggagtacatggcattgggctctgccagtcatattacccaatactttaacatccactagatattgcagaatgtgagttggcagaggaaagaacaaaaagcacatctaaataaacttgaccccttcccctcattttatttaaaaatgcatttgttaatctaggaacctgtttgtcttcggttccaactttaaaaaaggaagaatttgaaaacaggtcattgtaagagcatattaaaagcgatgacagaatgtgtgtctgaattcactctctacttctgtgaccttttaggtactggccacttactttctctctatttttacttctatgttttcaaaagtaaatggtatgttgttgttaaaaagctataaggattctatctaatgtcttatcatatcctttctgctagaccctcaattactatcagtaattaagaatcatgtgtataagcagacaaattatgtatacactgtattaaaactgaattgtttataatcagatgatattctattttactgcataattagttcaaatttttatattttagtttgtttcacatgccttagtattgtctgcctagatttaagtatcatctttcacctgtgagttttcctattatttgacacccagtcgtagtaatccatataaaaatacatagacggccgggtgtggtggctcacgcctgtaatcccagcactttgggaggctgaggcgggcagatcacaaggtcaggagttcgatgccagcctggccaatgtagtgaaaccccagctctactaaaaatacaaaaaattagccaggcgtggtggcaggtgcctgtaatcccagctactcaggaggctgaagcaggagaatcgcatgaacccgggaggcagaggttgcagtgagcccagatcgcaccattgcattccagcctgggcaacagcatgaaactctgtctcaaaaacaaacaaaaaaaaatacatagacaacaaaagtaatatacaagtatgaatttgactgggattggcatttttgcttatctgctcccttctgcaacactcacaagcacgtgcacacacatgtccttccccaaatgttaacattccctttgtgtatgtctcacagtttccagctgttaaccatcctcagtccttggaaagaagataccttggaattttgaatagtgttctacttgacctaatgaaggtaaggccaattgatattatctctataaaatgtcttttggtttgtggattcttttgtgtctacatgtgaccatagcctgcttttatgaatgaaattttaggagatgtggaatggcaaataatggggaactatgtcatattaaaaggcatgtaacttatttaaaattacaatgggatctggtattgtcacagtccatctagacagaatcatgagacccctaaatgacattcttaaaatggacagaataataaaaatctgttagcatgcaagagctgttcaagcataaggttttaaaacaaatcttaaaatcaatgttgaaagaagaaattcaacaattttttctgacatggtatttgaagcctcccatcgcctacacagatttgatcagtgaatctaatttttctctttttctaacttggtctcttctctcccagactctttctggctctactttagacgtatcaggatcattgctaatgctgtggcctgagtgttcttccttatgctaccctccctgtccagaagtcttcctgctctatactctaaaagcattctcaaatttctttattcaagtttatttttttttctccagtagacagtcggctccttgagtgggaactgtttttcatatttctccagctttcactgcagccagaagtgcataagcaagtgttggttgtttgatagtagaccttcaaagaacacttattaatggatcaattttattttatgcccagtcagtcaactgtcaaaatcagtagaggttacactgtgcatagagcctttaaaaggcatacttagcacagtcggaaatttctgagtggcattctcagaactttgccgtgctttaaactatgttaatctgtgttccagggaacatagtgtacataggtgtgggggtggaggtgggggaggagggtgtgacgtttcggaaaggccacataccatacaaccttttgtagagatgcacaatattcattaatccataaaggctttcagaaatatcacaataaagaggcatttctgtcttacccaatattttccaaatttaattaaatactgaatactgttttttataaaactctaaagctctagtgttcttctgaatacagattgagaaatgctactggcaaaaaagaacccttaaagccttttgtttaattagtcataaattatcacttaaatcaggtaggttttgtcaatacactttttcacacagtcagtcctcatggattgggacctcaataatttggtaacttctaaaatgtgaatagaataaagtaggaacatggaattaaatacaatttcatgttttctgcctttcatctttctttagttaaaaataattgaatgtttttgttaaatcattaccaaatataattgccaagcatcagtgtggtaccagattaaaagctagcacaaataaaagtagaaagattacccgaatcatcctgtgcttctgccagtttagaagttaaacattcaaattcctatttatttaatatctttaccatcagatttctttaagtaaatatttttattgacatgtcctttcagaaggtgcgcaaattgtatctatatgtcagttactttttataatgtaaacatattagtgtaactctacccagatgtagatagagaaaattactaacaccctggaagccttcttatgcccccttccaggctttatgccaccccacccccctcagaaaccagttccgacttctgtcaccaaagattagtattgccttattatcaaatgttatataaatagaatcattccttttgttttttagctttttttgaaaatgaatttgaaaaatgaaaaataccaattatcccttctttgaatatttcaaagagaaatattctctttgccattctctaaagctgccgtgttaattttgtccacatctaagtacctaaaatggccatctcatcctgtcagccaatttagtgggggtacaggtcaccaaaattaattcaagcccctaataaccttaagactagctgtagtaattatattggctctattttagtcttaaaaaacgttttccctccaagtactgaacttaaaagtttatgaaacttttaaaaaaatgtaaaagaagaaactttaaaaccaaaaaattagagttgaggctctttgctgctacagaatgatttttttttttttttttttttttttgagacagagtttcactcttgtgcagactggagtgcaatggtgtgatctcagctcactgcaacctccacctcccaggttcaggcaattctcctacctcagcctcctgagtagctgggattacgggcatgagccaccacgcccagctaattttgtatttttagtagagacgggttttcaccgtgctggtcaggctggtctcgaactcctgacgtcagatgatcctcctgcctcggcctcccaaagtgctgggattacaggcgtgagccaccacacctggccccgaattatttcttaggatcttatgtcaagtgggaagaaagctaaattcaggcaattatgtgtatactactatgtgggtaaaataaaaggaacaggtagagatatgtatagggaatatctatggaaggatgcctaagaaactggtaacctaggctgcctccagaaaagggaactgggtatctgggggataagagaaagattaagaatgtatattctttcaagtgaatatctacttaattaaaagtgtactttaaattttttaattatattgtaaaagtgattttgattaatgataagtgcaggatacaaaactgtgtatattttgtaaaagaaaatatgtatataggatattcaaaaaagggctgggatcatatatacaaagaggaaaatgatgatgagattataggtgatttagatagtctttttttttttatttcctgaactgtgtttacttgatattctgcaatgactgtgtatttcttttataaggaaaaaaataaggtttttattagaacttaaatttgactttgtaatgttcttaacgatcctaaattttatttcctaagaatttactgaagttggacccagctgacagatacttgacagaacagtgtttgaatcaccctacatttcaaacccagagacttctggatcgttctccttcaaggtcagcaaaaagaaaaccttaccatgtggaaagcagcacattgtctaataggtaaatattcccttttaaggaaatacagatgcagtgttggtcttacaagtaggtggaggaggtggctgcttaaatgatgcaattagagaaaagaaggaaagccctctttattcaaaaatatcttccttatgcttattgcatgattcagaaccacaattaaggagttgtgtgggtcttaaagactttcttatctttaactagtatatgatggaaacctatgcattccctgggaaaggtagcattgggttagcaactaagggggtttacagcctcaagagctagaatattctgtgtgaatgaaacccatcagtgatacccggaggaagaaagctgggtgaaggcaaggggattcctggagagagaagaggatgccaaacacagatggtggatggaaatgtacctagtgtaatctttgtgactggaccaaataggtctggctctacagagaggtcttgtgtttttgttgctcttgtcttctaatcattgagttgagaaattaatttttcataagaataagaatatggaaatagtaaagtcagtgattaaaattgttgctctttaaatattatttttcagcataattttttcaaagcctgtttcctgaaaaacacacacacaggatttgggccatacaatcaggttgtctttcagacctgacattcctcaattctgttggttgcatgtccaagaggacagtgtcctagtcatggtctccctgttttccttcatctcccaagaggctgatcttgtcatctggggtcgttggattatggaagataggaaatagtttctctcatctactattacaagataaatagaaaacaatgattctttatttttattttttagtttttttagagacagggcctttgctctgtcgcctaggctggagagcagtggcatgattataactcactgcagccttgaactcccaggctcaagcctccctcccacctcatcctcctgagtagctgggactataggagcatgccatcatgcctggctaattttttaaattttctgtagagatggggtctcactgtgttgctcatgatggtctcaaactcctggcctcaaacaggcctcctgcctcagtctccccatgtgctggagttacaggcatgagccatagcatctggctgaaaacaataattcctaatatgaaggttttttaatataaattttcttcccacctgcaaccccaaattttccatccatatagaaccattgttcttttttgagacagtgtcttgctcgattgctcaggctggaatgcagtggtgcaatcatggcccactgcagcctctgccttcctggcaagcgatcctcccaccttagcctcctgagtagctgggacaacaggcatgtgccaccatggctggctaattttttatcttttgtagagaattcctgggctcaagcgattcgcctgcctcagccttcctaagtgctgggactacaggggtgagccaccacacctggccaatcagttgttcttaatagatcagatttttaaaagctcaagatctggtactatttaggtctgggagagcatccataaactgatgatgaccatttatcgtatgttttctctgcttaactgtgatagtataattgtgttttagagctgtttactcttcttgaaaatgactggtttcagtttgtttcccctcacatcttatagacctttcttagctggctttctttgtttgttgccatgaaatttttaggacactaagtcaaggaatagtagtcatcatttggttgctcctttgcatttagggggtgcaaattagtcctgtgtcttctttggggttactctcagttcaggtgcttttatctcctttttaccttaattgtctcttagctcctttagtttacaccgaaaaattatcccaatgatataaagtccagtagactgataataagtttttgatttgtgctatagtgattagtgatataacccatactgtgaaaagaggctgtgtatttgtcttctagtgactcacttgagagacagagttcttggaattaaccagtggggacctgaggctctcctcgggaacctctttagggatctgttaaggaggatgtgcttggtgatgatgttttcagcagatacagaagatatgatttgtttgggtccttgaggagtcctcccaagtccccttttgaaatagaggagaatagaaattataagtgaatttaaaatctctggaagaatcattttcaggtcttgacactgtattgaatatattaaagaaaaagtcttacatgatttttctaggaatgatcttaccacattttacatatatctgagggcttttgctccacactggtctatggtccatacttattccatggatgcttttttggttagagacattaattctagcttgaatctcaacacaaacgatggctccctaagacttctcaggaccattttagagatgctcacagcaccatatcacattggttgccacgtacaaactcccctgccttgtctctggagacacaaacatgctgttgcataccttgtcttctaaattttttctctctaggagaggcagtggactcttgtgttacttagcccctggctatctccctcaggctctcctgaggttctgcccaccatggacacggtgcaatggtgcatcagctgccccatactgccactctcctggtccttcaccagccttctccatcaaagtgtagctttgcaccttcgacatttgcttttaaaacttactttaactaaatcgttatctatccatccatccatccatccattctgcaaccatttaagaagagtttgtatgtaaaatttttttaactagttggcagtttaacacagattccttacagttgtgtgtcgaagagatctatggaattttcaaagctgttttttattgttgcactttggcagagctccgatgcaaagggagtatgatgccctttccacataggcgttatgtgcaaagctcagtggtttccaactaatcctaagacacaaacactcagaatggcagtttaggctctttgtacacttatggaaaacctaaagctttgacacgttttaccttaactggataacctctcttttcatgttagaattgtctcttacgttgctctgaatgtgttctttctaagatccacatgtacgtttctgcttaacgtcgctaacagtgtttctaagagttccaaaggctcaagcagctgcctttgctgttctctgtccctttatggtctttgtgagctgaggacgtttcccaatatctgtacatgttatctgtctacgattactatttctaggcctgaaggggaatggggatgaaatagggttctgagagtccagggagagctggacctgggtaggaagagccaccctgtagaagctgtcatctagaaggacacagccacgatctgagtcagggtgcagatgcctgcagggaaggagcagggaagacatcccccagcccctctctcctcttgtcttgtgatgccttccactgctaagcccaaccagaagctagctggctaggaagcgtgggtgacaatctgcagcattgggttcctgaggcccagggccgggctcatgggggtggaggacggattggaggttgggcaaatggagaataaccaacacacttagatctatttgtggatgagacagtctatcactatttaggtttgaaaagtcgctgagatatttcagttaccaagatataagttggcaaacaactcaatggtttaaaacctgatgcctttaggatatagggactttattgatctggggatagactctgttaatataatttaacagaaagtgaaacttagcatttttttctttgtaattcctttctaggtctgggctttgccattttagtgctcatatttaggagtccttttatttaatgctgtaattctaatgacctaactggaagagattagtgagtacattcaagagatgaggccccccacactgtcacaggcttgctcgatatcagatttttttttcttttttgacactctcaggtagctttctggcagagattactgactgaaaggtagactaggaaatgggtccttatgttatttaatggctgagcatgcaggttctcatggggaaaattggaagtcagagcttcacagactaccattctacatgaacaaaaaaaagtgacttccaattagtgtgtcatgggaacaaaactctcccaaatcaaaccatctgtagcaatagcaatatttgcagcaaaattttttgaatgcatagtaaaaccagaattgtgtaaatcattattcatttttaaacattctagtctgtcccaaactacaattagatcctttcaatagttacagtagcacaaactggccttgctatggtgtcagtttcagctttcaaatagaggacaagattttcctctggatttatattttgtattttaaaccaagtgtgaaatgaagctttaagtcctaaaggagggctcagtcggtctaggataatgaaatgttaaataaaaaagagaataattgtgtcttttggagagaaacgaactctttcagatctctgtaatccggtatagtacaggattcctgtttactgtacaaagagatatctgaagagccccaagtaattgccacttctccaagacataaacattgatcatcatgttttccaacaaacctcactggacagtttacatttctttttagagggtcattttcttttattaagtacattgctagaattctcattctttgattatgcaggcagaagagacattggtgtctgtgtatgtgctgtgagtatgtatctctgaggcaggctacaagttttacaaataaaaatgaagttcaagaaacatagtaacctttaagtctaaatgttgtcttctgacattcaagcagacaaaagagttataaagagtttatagctcagctctcttcttagcagtcattctatcacaaacactcatatgagtaccaatataatgagagtatgttttaccagattatcatttagaaactgttttgacagcaagttagctgagcatttagcagtgccagaataatttcatcaaggccagtgctttgttacagagtgagttggtctaagaaacttaattgctgttgataggttacttgttattcgaaggcacatgcttgagagaattaatgtttttagtcttccaggtgttttgagtatttgttctttctttttaacaatactttttgtgtgtcagctattgagggaaactgatatacttcttttgtttttaacatagaaaccaagccggcaaaagtactgctttgcagtctcaccacagatctaacagcaaggacatccagaacctgagtgtaggcctgccccgggctgacgaaggtctccctgccaatgaaagcttcctaaatggaaaccttgctggagctagtcttagtccactgcacaccaaaacctaccaagcaagcagccagcctgggtctaccagcaaagatctcaccaacaacaacataccacaccttcttagcccaaaagaagccaagtcaaaaacagagtttgattttaatattgacccaaagccttcagaaggcccagggacaaagtacctcaagtcaaacagcagatctcagcagaaccgccactcattcatggaaagctctcaaagcaaagctgggacactgcagcccaatgaaaagcagagtcggcatagctatattgacacaattccccagtcctctaggagtccctcctacaggaccaaggccaaaagccatggggcactgagtgactccaagtctgtgagcaacctttctgaagccagggcccaaattgcggagcccagtaccagtaggtacttcccatctagctgcttagacttgaattctcccaccagcccaacccccaccagacacagtgacacgagaactttgctcagcccttctggaagaaataaccgaaatgagggaacgctggactcacgtcgaaccacaaccagacattctaagacgatggaggaattgaagctgccggagcacatggacagtagccattcccattcactgtctgcacctcacgaatctttttcttatggactgggctacaccagccccttttcttcccagcaacgtcctcataggcattctatgtatgtgacccgtgacaaagtgagagccaagggcttggatggaagcttgagcatagggcaagggatggcagctagagccaacagcctgcaactcttgtcaccccaggtacagttgagcaccttgactgaatctggtggcccttcaggggaaggtggtacgagggatgtgatgagggtccatctactattttccctactacaggaggttgtgcttttcttgataggatgcatttagggaagcaatacttggcctaatctctgtttttttgttttttgttttttaaatctatttagatcaaccgttgagtactcaagaaaagtcaaattttgtttttagtgatctttttttttttcttaaatgttcttttctggaatattttgttgagagaatcctattttgatttattacagaattcatcagctgtatcagttaggttttagtttttcttaaaatacagtgtgaattcatgggtattttctctgatctctccaaaccacatttgcttaaatcaaaagcttttgctagtaccttactcaatattttaactgaatttaaaagttttaaatttgtccagaactacagataaatttaacttcataccaggataaatgttagttttcagtcttttggattgtttttaaatcttaaaacagcatttttagcataatgcttcctccatcttattcatcgtcaaactctagaactgacctaacctgcttaaaagaagtagcattccttcacttgaacctgggaggcagaggctgcagtgagccaagatcacaccactgcactccagcctgggcaatagaacgagactctgtctcaaaaacaaaaacagaaacaaaaacaaaaaaaacaagaagtagcattcttacagtagagcatgttttaaaaataatgttatcatgatttcatctataaagtactgtgcccagtgcctggcacaaagtaagtgtctaacaaattttagttattcttgctgcttctgtgattgtggaggctgatatttggacattgaacaccttttctatgctgggtgttcccaggcactcaaaagagtctgagagagctcttgcacttgagaaacttacctgctcttggggaagataaactgatacatgataacaatgaaataagtagccaggtgcagtggctcacgcctgtaatcccagcactttgggaggccgaggcaggcagatcacgaggtcaggagatcgagactatcctggccaacatggtgaaaccccgtctctactaaaatacaaaaattggctgggcgtggtggcgtgtgcctgtaattccagctactcaggaggccgaggcactagaatcgcttgaacccaggaggtggaggttgcagtgagccgagatcgtgccactgcacttcagcctggtgacagagcaagactgtcacacacacacacacacacacacacacacacacacaaacacacaatgaaataagtaagacctaagtcaatatggcactggctataaataggaactgagaatagagagaggtcattgtgagcagaagcagttagaaatggctttacaggcaactgaaggtctttctctgggctaggatgtatagacaagctttgaattggctgaagagtgaaggtatgttcaggtacgtcctgagctaggcaacatgaaaagctctagctagaaagatgaaaagaataggttccctgtcgtcttaagtgtgtgggctggcaggggacacttgtcaacagataagttgttccactactgtgaggttacattctggctactgtgctagaggcatgccagtgtggcaagggagcgagacagtccaagttgtgagttgtgggagctcctagaacaggtggcacctgagcagagacttccagaaaggttgggaagaaagtgacagtgacctcaggaaagagggaagaaaagagcattggaaggagaaggaaggtaacagatgttacatagcatggtatgctttgggcattgcaacttgttccactttgctggagtgaaaaatgcaaaatttggagtggcttttgcaataattcaagcacgaggtgaagagaatatgtttgggattaagtcagtgccagtgggaaacggagtggatcttctactcctcagaagtagaaacaataggatttgtgatttgaaggattgaatataggaaaaaggaagacttcatggtttcttttctaggacctcctttttggagtgaaagagagtagttttgaagtcacctaattcaaccccttcatttcacagatgagcatgtcgaagctcagagaagttgggtgagttgctccaagtttacccaaccagctcaggatggagctgggattatgaggcaagctccaggtgctgaggccagctgcttgccactggtgtcttgcggacatgttgaatttgaagtgaccttggcctctaagcagaagtgtgctctaagaggctaaaaagatggtctggcacccaggtgaaaggagaaagcaagaggtgcccatttgcagaggctggaagtggagtcagaggaatggtcagaggagccctgaggagatgctgtcgggagaaagaacctccagagcctagaaagatctggcagcttcctgcagaggagacatggaagggaaaattgggtaaaatgtgctagcattcagcatggtataaaatggagaagaaatcggaaaaacaaatagctttttaacttagaaaaagtaattgctctctgagaattccaggaaaagaatttttgtgaacatggtggtcataaacgaattataaacagttactgtgggctaagcacagatctgttacagactgtgaaggccagttcaggaggtacagtgcccagctgcaagaaagtacaagtttaaaagcacaaagataccagaaggctggaaaagtaacttaagctgtgagtgaatcctaggaatcactcccatgcaaagtatcgggccaccttgaaaagcacagagactcttactgagtttatattagatgttaataatttgttttcttaaaataatttttgtagaggcctttgtaaacagtacaggtggtaaaagtcaaatgagacattttcataaaatagaaagaaggaaggctatgttggatgaattcctgcccagaatcctcagagtacatttggagaatgagagggagaaaaataatcatattttaaatcttaaataaaatgtttttgatatgtcacataggcttaaggtaatgcccttttctgtgcataatatacagatatacgatgcagcgaactccttctaatgacttggtaattttcttccttaatctttttttctgatgatagaaaatgctgtgttttttcccctcggtgaacaccattgtggaccgagtactgttcttagcttgtgactcacttccttgagagagaaagatagtggtatgtctttggagatgagcactatcatgatttggcttcagaaaatacatgaaacataagtgctgttatcctagagaagattaagacaagaatttaagcacataaactatagtagttaagaggattttaacacaaaaaattattaaaaggacttactctattccttgatatattcaaaaatcatttattttcatctgactttgccatataagtcctgcatgaaatatacttttggaactgcacagttcattttggagaactcagacttaaaatctgctagagaaatttcagataaactaatagaattcctaatcagagggccgctcagaaccatgactgtctagatattagaatggtaattttttttgtttttaataattaattgaactattttcagactaatttgttctctgcttgccttaactttaatgagaattttactttccatctgtgtgaaatttgacttatattacattcatcagattattcacttttatgggactatttgtattttagccaactaacattttttattttagctggttatggtcctagttctaccaaataaaggccatgatgagttccatccctaggaacaggatgctcttataaatccttttaaattttacttccagcctggagaacagctccctccagagatgactgtggcaagatcttcggtcaaagagacctccagagaaggcacctcttccttccatacacgccagaagtctgaggtatgtcacaataaaatatgcctgtaaacatttgttcaacatcattactgcctagcttttaaaatgtattaatacccagtctcccacaaataagttgaagtggcttataaagtaagtagttttccttgtggcataattctgagttttctttcaaaaagatcattaagtcaattatagattgattaggtacggttctaaatttgggccaggtggctcacacatgtaatcccagcactttgggaggctgaggtgggaggattgcttgtgtccaggagttcaagaccagcctgggcaacatagcaagaccccatctctacaaaaagtttaaaaaattagctgggtgtagcagcgtgtgcctgtagtcccagctactcgggaggctgaggcaggaggattgcttgaactggggcagtcaaggctacagtaagccatgatcctactactgcactacagcctgggcaatagagtgagaccctgtctcaagaaaaaagtcataggcaatattgtcatcaatgtgtggcttaacttttataaatttctttcctgcctcagggtggagtgtatcatgacccacactctgatgatggcacagcccccaaagaaaatagacacctatacaatgatcctgtgccaaggagagttggtagcttttacagaggtaagcccacccccggcattcaacaggttcccctctcctccctctctcactttatgtgcacactgctttcaccgactcaggccagcggccttctcacctacactgtcgccttccagcggttctccctgcctctgctcctgctaagtcaggccctcctggcttatgaattggcctccttaggtagcctcttaactggtctccctatctccaaggtacccatcaatatagagactagagtgatccttctgaagctgtgttctgaccataccactcattttgttctgtcaagccataacatacttattgatgttacctgtgtgtctggcactgttctggcttagaacttgttggtgaacaagatagtcaaagatcttcaccatcacggaactcacttcctcgggaggagagatggacactaaacataataattatatagagcagtaaaagatattaagtgctacaaggggggaaaaaatagagcaaggcatcccattgcccaccccaccccaccctactcctaatcccctatcactcacctgttgagagtcttttggtggcttcccattggcatcaggacaaaatctgaattctctaggatgtcattccagacttcccatgatctggcccttgccatgctctccagccactttctcccccaccccccaggtctctctcgtacccagcctatgggactgcacaggctgtgccctcctctggcctgtaatgtactcttcctcctgctggaacagcttgtttctgtccctttctttaaggtcctcttcagtataatatcttcccacagtttgttccagatggactgaaacattttcttctccgttctgtctgtcgtaccttgcctgtaactctgatgtaacactgaccacattgcactgattctttgtctgagttctctctcacaaggttgtgagacattcagttctcttcgtgttctcttctttttattctcattgactagtacactgcctcgcacagtttcataaatatttgtcaattgaattaaagaaaaatttcaagtgtacttgcacgggctaaaatgtactttgttatttagcagacaactaaaacagatgcttttggggttgtacaaacttaggagacattgaatgacaaaggcaatcccttttagtaactatgcagtaatagattgtaaagcccttgggcattccaacaccctggtggagaaaatggacagcaagcccacagggccaagagcaaggccttgggtcaggaggcctgtaaagccttcaagagtcaccacagctttctaaagcctcctatgcccatgttgcctaacttcccactatttctgttgttttaagaggatagttggaaaggggcaggatttggggcgggggcatggagaactgcttagtcattttaattaggaaccccagctaaataaatgcacagaagtgttatttaggactaaatgtatatttaatgattaggctactctgttccttcccttccagccccacctttggaaaagcataaggtattgattgaatatgccatttttcctgataccatgattacgctttagtattttatgggactggccgggcgcagtggctcacgcctgtaatcctagcactttgggaggccaaggcaggaggatcacgaggtcaggaaatcgagaccatcctggctaacatggcaaaaccccgtctctactaaaaaaaataaaaaataaaatagccgggtgtggtggtgggtgcctgtagtcccagctacttgggaggctgaggcagaagaatggcgtgaacccgggaggcggagcttgcagtgagccaaaaccgcgccactgcaccccagcctaggcgacagagcaagactccgtctcaaaacaaaaaaaaaaaaaaaaagaattttatgggactaagcttttaattaagatttaatttaattaaaatattgtaacatacatgtgcaaaagccttttcttctatcaccaaagcattacctccaaaatgtagcataggtgtgttatttctatagatgtctggagaatatacattaatataaaatgctaatggagatttaagttagttagtctttgacctctggaaacacggttttattttgattgcaaaaaaaaataaattggttaattcagagaaatacttcatatgtctctacctcattagtagagagggtagtgagagcttggcaggtggaatgttttaattttaaaaatttcagatatagaaggaaaatatttaactagatgaaacatctgaagacatctgtcatttcaatgatactactaagtcctagaggaagatttggtggtatcattgaaataacagatgtttccagaatgcttcctgttttcattcctattggtcaagagtcaagtgaaattgtgtcatttatctttatatacagtctgtatattccttttgtggtaaaatttccagtatatttttattataaccattcttagaaattgacagaaaaagttaataactatccccccaaaagcagaaaagtatttattcacatacattatattttatctttttcttttcatttagaatttagagaaaaataatatttttgtagaaatagctaaatttctgtgtaattttgtttaaaaacgagtgatactacctcccaagtgtcaaggcttaaactgtagtttgtctgtttcagcacacatattaattacttcaaactaagaatagattttacattgttggtctatgataagaaagctttaacttcaaagaatgccaaaacggtggcagggaatggtggtaggggctacaagattcacacttgaaaataccctggccgggcgcggtggttcatgtctgtaatcccagcactttgggaggctgaagtgagcagatcacttgagctcgagagttcgagaccagcctgggcaacgtggtgaaaccttgtctctacaaaaaattagccaggtgtggtggtgtgcacctgtggtcccagctacccaggaggctaaggtgggaggatcacctgagcctgggaggtggagtttgcagtgaaccatgattgtgccactgcactccagcatgagtaacagtctcttatttaaaaaaaaaaaaaaagagagagagaaaaaaaatataatgttcttcactttatcagctggcaggtcagtttactgttttcaatacacattacttggtgttaactaacccttgcaaattagtgtcataagcagtggatggagggacaaggttccctggaatgccttcaccctcagaaaacacaaaagttatgtgaagagctgatgaggatttttatatgtttgtttgttgttttatttgtgttagagaaaatgcagtaggataacgtgaaaactgctttgaccaaaagagaacatcagccgtctgtggtggttcatgtctgtaatctcatcactttgggaggctcaggcaggaggattgcttgagcctgggaggtcaaggctgcactgagccgagatcacgccactgcactccagcctgggtgacagagcgagactctgtctaaaaaaaaaaaaaaaaaaaaagaaaagtccatcagtgacttactttttctttattcagtgccatctccacgtccagacaattctttccatgaaaataatgtgtcaactagagtttcttctctaccatcagagagcagttctggaaccaaccactcaaaaagacaaccagcattcgatccatggtgagcattttggtttgtttttactcttcctttttttaattgtagatttaagagttgaaataaattctggatgagctttttagtgtcctttctcctgctaggcctttttttctctagataaattattgaataaggaaaatgtgatttttcattattggtaacttttttccagtttggcatttagattaaatatcatgtaagggaaaaaaaatctcctggattattaaatacctgatacgctttccactgtgttgttctgatatgaatgatgacttttgcggtctccttttgttgacattgagccaggtacactttgcttagcatttgatgtgcatcgtctcagtcagttctcatagtcacactgtgcttccatgctagtggcagggacactgaagcttggaaaagtcgaggaactggcccggtgttggacagccagtaacatggagaagggagccagggttcaaacttaaatgggctccgactccagagctcatggttgttacctctgtgctacctgtctgtcattcagggtaaaaagaaataggggaacagtcctttatgctaccataaaagcataatggtaatgaaaggcacaaatgatgtggcaacttttcttattcttttatcttttttgtgtcgcatctaataaatatttagggagagaattacagttttatcaagatccattagcaaatctgtctgaggagtaaggactttaagaaaaataataatgtagacttcttctcaactaccctgaaagactgcccaggttctctaccaagagcataaaatgggacatcactgtaagacactggatttggaacaagaccagtctgtcagagagtccctctctggtgtttgttgccagaagtaacagaagggccttatgtcagtactcctgactccatgtgatgtcacaatttggaccctgttgataaagttacatcaaggtttcagtgttgttgtgccctatagtgaaaattacttaattattcttaaaacaatataaaaaatgacttcttaaaagctataaatacacttttgctgtataagcacaatttacatccattgcctatttataaaatgacagtcttaatgttcgtgactaagagtttagactctggaaataggatatcttggttgatggcaacttgtctatcaatcagaggactgtgtctatttgtctcttggtttcctcatgtgtaaaatagggctaagaatggcacctccctcatagggttcatgtgataattaaatgaggcaatgcattaaaagcacctagaataatgcctggctccgtaagcattcattaatgttagtgactgcagttactatcgttgtcatctaacttcaacatcaggtgtttcccctccattttgatgataaactttggtgttctttctccatgtgactgttttaagctccctagtatatagaaaagatctgcgaattaacgtgagaacacaagtataacttctttacttaccagtgttgaccattttctggtgtggctttgataagtcatgacaaaattgtctaaatggtgagaatacagaagtgcagaaggaattggattctcttgattattacataatgaagtggtgatgatttaaaagagtaacaattacagattaccttagtcctgtgaaaattaggtcagatcaaaattaaatccaaatttgagatagacagtgttagtaatgtattatttctgtcttttgataatcagtttaagtagaacttgttttacgcgtggatatgtacagaaacctaaaaagagttgttttaaaaagaatgagaggctcaattgggatgttgaactttagttgagtcttcatcaggtcatccttattctagtattgctgttatgagacttgagagttccagaattgccagtgatgaactggctctattcttttgtttctgttaactcttcgtgataatgctgctatgacgtatttccttccttcatcgcatctcacttagtctgtcattagttcaacttgactcatcttgattttttttcttgaacaagctctcgaattggttcatcagattcttcatatttgagagaaatgcacatttggtaacttacaaaaaacatcaaagagccttgttatggtaatatagtgaattgctattctttgttgcgaggggatggagacagggtctggctctgttgcccaggctgtaatgcagtggtgcaatcttggctaactgcaacctctgcttcctgggctcaagctatcctcctacctcagcctcctgagtagcccagactgtgggtacatgccaccatgtctggctaatttttgtatcttttgtaaacatggggtctcactatgctgctcaggctggactccagctcctgagctcaagtgactgactgcctcagcctcccaaagtcctgggattacaggcatgagccactgtgcctggccgtgaattgctattcctaaataatctcttacctaaggtcagtctgtttttccttggtagttgtacttcagatttacttcaggaagagaatatttgtacagtgtacccctttcttgcaatggaaaagtcaagctactatgttatattttaaagcaataaatagatattgcagtatgatatccagagctgttattctggccatctcagttatgtagaacccacttaagaatcaggagatagccaaaatatctcagaacaagcaaaatagagttaatatggtgggattaatcatctttactaataggataacacccctaccctcatttggagtctgttcttcatttatgctcagttctagcaggcagcactgaggttgtcagggcaagaaatagttcaaggtaatactacagtatgcagagggaaaaggatccaagcaatagctatggagagaagcaggttggaaaatcatacatatcatagatctctatggagtgtgtgtttataaaacaggcagcttcactttgctttgaaagacaaaatgtataaatatgtttagaaagactgctgtcaattgggttaaaaattgatgtttaaagagtaaaccaaattacttagaaatcccactagttggccaggcacggtggctcactcctgtaatcccagcacttagggaggccaaggcgggcagatcacctgaggttgggagttcgagaccagcttgaccaacatgggaaaaccccgtctctactaaaaatacaaaattagctgggcatggtggcgcatgctggtaatcccagctactcgggaggctgaggcaggagaatcatttgaacccaggaggtggaggttgcggtgagccgacattacgccattgcactcgagcctgggcaacaagagcgaaactccgtctaaaaaaaaaaaaaagaaagaaatcccactagttaaatgaagaattgctgtaacttgcacaattccagccttctttttctcgtaaggttatgaatatattgatatccattagtgcttgtcatcataactttcagagttactcccgtagaattattcactgactctctcttctcacacattagctaaccacgcttatcacatcgccaggggaggggcaggtggcagagaaagtgtcacagagtaatgctcctcaccacttcagctcaccttccatgctgctctcagagggattatactgaagtcccataagcctgaccatgatgctcccccgccccattccctagctgtcaaacctgtcccctacccccaacaagagtctgtgagcagcttgagtgagatcagattcgttcttttatttttctctgtttcttcaacacctaacacagggcctgacatgtataaagtacttgctgaatgttggttgagtgattcattggattttaattccttcctttctttaggtgaatctttggaattgtgtctcctcttggacccttatggaaatagctgtcatgttagataacgttagagtcccatgcctgtgtgcctgcttaccacttgtctcattgccctcctcccgtactgttttggtcccaactgctgctctggagaaggtgccaggtgactggatgaatagtccttctcaaagcttctgtctctgagattgatgtgaaccccctatttacccttcttttgtgctgctcctctttaccccactcagcacgaagctgctgtcttccaggtggaatcacaggggccagaatgcgcaaatgagggaaatgaccaaccacacccttacccatatggctcagttccagctgtcaatgtataactcattctgcattcctttatacaacacagcttttcaagtgcctttgttccagccagcctctttccatctgtctctgagtcactctgtcagccttttctcccttccctttctgtgttaattctttgggtatgtatgtttctgcatagcttctcgcttgttttgtttttcctctctgacatccttctttctgtctttggtgatgcaaacacacgcttcgctcctagttttcacccaccagttcaagggtaatttatttctttttttcatttggcctctgggatctttctctgcctggatctttgaaaatgtcccaatcattcctctatccccacctgggctgtggtttatccagtgcctcttgaaaagcccctgtagagggtctttggcccatcttccctgtgtcctggggacccaacgatgcaacatgcaaactgcaaacattgagctttccttttattaccctccccttctcactttcatcttattcaccgtttcatcctgcatagattctcctcttaccatgcaagatcctacttcctcctaggactggtgtctcaagccttcatttcctcttgtgccagcattaacattcttacagtaatgcccattcacattctgagatggcagtcatgatgaatatgtcttccttaaagatttgctggattggcagaaagcacttttaccctcaacacacctgtggtattttgtgagactttcattctgcttggtaaaaacttctacccattaatctgaatattctgttgtgcttctaggttgtgtttttgcagatagtattgtggaacgacatagctttttcataaacgtataattctttaacctctagaagttacagaacgttaaaaatagtattgccatttctactagatgctctctgaggctcctttccatccagagtcatgcttttgtgattccagaaaaccccactcttctgcagtgttccttaccaatggcaagtgactgaatgctgtgtcttggagtttagcttacgacagtctgtctttaagccccatgcaagagggtttcatctccttaattgcaaaagaacttgtcacaagaaacttttaccaaattcccagggcctaggcccagtctgtcattgggtttagaatgtttttcgcaacaatacaacactacatttaaagactcttttggctggccgcggtggctcacacctgtaattccagcactttgggaggctgaggtgggcagatcacttgaggtcaggagttcgagaccagcctgggtaacatggtaaaaccctgtctctactgaaagtaaaaaaattatccaggcctggtggtgcatgcctataatttcagctacttgggaggctgaggcaggagaatcacttgaacccggtaggtggaggttgcagtgagccaaaatcgcaccattttactccagcctgggcaacagagcaagacactgtctcaaaaataaataaataaaaataaagactcttaagttttcaacacttacccatttcatcatgtctgaagttttctggctttcaaaattataaatgtatcattctgagttcagaatacctggtggtgtcagtggtatcaagcttaatgtcagtattttcagttagaagcttttccccccgccccgtgaaagcttttttttttttttttttaaagaaacagggtcttgccgtgttgcccacactggtctaaaactcctgacctcaagcgatcctgtcccagcctcccaaagtgctaggattacaggtgtgagccactgcacctgtccctacatttttttcttaactatttttatttagttttaataaatacataaaaggtttaataagtaggatatttccagtttctggcaaatttttactttcattcaagatgtttttatagctgtattgatctttatgttcagtatcttgacaagtcgctaataataaacttgtcgagctggtttttaaaaggtaaatagaaaaatgaaggtaggtgttgaaaatgttttgctctttcccttgtagagttacagaaaagccatcctttaagctgtgtacttttcataatctcaaactctgaggtcttcaacagcatggaaatagtcttgcagcaacagttacaggtcatataatgctcaaattgctcttttgagtgagcctgtgccagaggataatcactaaccatggttgattaaatttagttcctcctgtgcttttttagaggctctttacccaagtgtttgattcttcccggctataggaacctagtgtcatgcattttcagtccttattatatttgtcacacaatggcaagaaaatgattgaaaaatcaatatgataaaaatgtcttctcatttaggaaaagtcctgaaaatattagtcattcagagcaactcaaggaaaaagagaagcaaggatttttcaggtcaatgaaaaagaaaaagaagaaatctcaaacagtaagtagatgaccagtttctatatataataacatgtttctgcattattcaatggatactttacactttgcacttggcaatcaaagttgattgttttcttattgagacttgacatttttgcactgtattatgtctctttctgaaattctttacaactatcctctcaacagagccttttctacattcaacagaatctccaggaatagaagaaatttaatttggatgacagagaacactttaagcctttctcaatatacttcttatctatgtgggcttatattaatgtaaaaactttgaagacacaggatttgtttctctctggggatttaaagatatgcataaacttaggaaatgggttttggtttacttttaaatgttgaaatttgtaaataaccatcattccttattctctcctggctggttacagaattcctacgttgccaggtgtgtttctgagttatatagtcacaaagatcgtatctgggattttagggcttgcgttagaaggaaaatatgtttgccttttgatcgcgctgtgggttggaatgcaccttatctcctgggagccctttgcctgaacaaagagctggctccatgggaccgttcacatcacttcactgaaccacccaagcaaggatcctgctggtttagtgacatgagaaccttggggaaacccggcctgtaggacagcagcaggagtagttcttcccctagatgaggctgcatcccccttttctttatgacaacttcaaggctaaacaaggtagagttagccgtttttatttatttatttattttagagacagggtctcaccctgttgcccaggctggagtgcagtggcatgatctcagctccctgcaacctctacctcctgggctcaagtgatctcccacctcagcctcccaaataactgggtgcacgccatcacacccagctaattttttgtatttcttgtagagacagggtttcaccatgttgcccaggctggtctcgaactcctgagctcaagcaatctgcccacttaggcctcccaaagtgctaggcatgagccactgtgcctggcctagttagccattttgaatggttttggttctagttttacttcatacgtaatttattcttatttatttgaagaggaaaaagacacaatcaaaatggcctgttcagatggacttcactgatttcatctataagtttagtagattagacccagtgtttctgaggccctttctattatgaaaattatagaattatgactcaatgggaagtagattaggtagatgttcatagcaatgtgtataaataacctgaagtaagcatttttatctcacagatgttctagaaatgttaacaaataccttcctagataatctttctagatcattctttcacttgcttgcttgttaaatttatgtatttccttataaaataaatatgagttcattatagaaaatttgagaaaaagaaaaagatcgttttaaatcttaataccctaccacaactagtattaggattttggtatattttcctccagctgtttagcctatgcatatgtttgtggcaagaaggtggggtttttttttgtttgtttgttttttaagttttaaattagagcaatccttttagtacgattttgtattctggcttttaacagtttatctatctatatctacatgcacagaatatgtatgttactacaaatactttattatcttcaatcctaatggctgcataatatttctgaagtagtcattaaaaaaactgcccatatttttaactgaagcttacttttaaagtgtcaaatcaaaatgccactcagtcagatactactataattgttacttaaactgggtgaacaaatagacctgatttaacataggaatacttaaaatgtttaaagtgttaataaaacttttatcattgtctgtagaacatgtttctctatcatgagcgttaaactttggctacctcctgaccactgttatttttattttgtggtttttgttctaaaccacaggtctcctggcattgtggggtgattaagtggtagaaagtaggaaagattaaggaattgaaggtgtttttgtatatagatttagattttgatgtttactgtagagcaacattaaacctaaagtccctggctcactgtggcacaagtagagtatacatgttggctgactttattattcagaatttagttaaattttagatattttagtaatatagattagagtaaaaaggaaaataaccattctctaacatcctctcgacttaaactttttattaggttttcataagtttcctttttgatattaaagtaactgtagaatatctctgcataggccataatgccttaagctttaccaacccaaaagttgtttgtatctctgcatcttttaattaaatgaaacataaaatttaagggctttgggatttccaaagagcgctcagtacagccttccaaacctcagagtcctacgcctgacattgggttaactctgcctactttgaatgagcatttaaactgttaatagtttttcactttctagaactcagcaaaaagaaactacatagaataagcttcaaaagatttaaggcattgtggcctttgcataagattccaaaagaatgaaaatctgatgcccagtgtacatagagacgcatgacatgttaaagctgaggtggatcctaaatctagttgaatttttttattcactggtataggaactgagcccaagcaagttgtgggcttgcttcaaagcccaaaaatcacataatcaactgggagaaccagaactgcgttctcctaaataccaagtccaggctcaattcataccatggacccgcctctgtggggagcctctaggagctctcctctggcctcttcagcgatgcaagttaaactcttcctcgaggttcctgtcattggaacaagaaaatttgtgggatgttttactcaaatccctttttacatatacccttaaaagattacctaaatacttgaataccttcatagacattctagttctctgacaattgagatatccaaaacagggaaaagtggtgacaaaaaaaaataattctgtattgtaaaggtgcctgcttcgactcaagcaaatctggaagctgccttgggaaatctggctttggttacatatccagagttacataagtcctcagagcatatggtgactttgccaacttggtaattgtatcctagttagttagtatctcaacttgtgatgatgcttccatttaaatattgaaatttctgtttcttctctttgaaaaccagtatctgaattgtgctagatgttttccattgggtaaatatttctagcagtacagaacaaggcctcttactcaacattagtatcccaccacagtgatcaatacctcttcctagtgatgttttcaggcttaaaagttgaccaaattcgaaagggtttccagtatgttgggattttttttctcctaataggcaaattacatggtagattttttacttgctgaagtcctctctagcaattaggagaagattgaagtttatcagtagctctttaacacagttctttataaccatatttctgatagtaagtaaaaattatttaacgttttataagcttaatgtgagtaggtgtgtctaggtctcttggcattcctactagaggtattgatcatgatctcacattatatacttagaagaagtttgtgcttgtcttgaatttgcattattgacatcttcacatccaggtgagaattggcacagaagctctagatgcacagcaccgagattctttcagtgactgttaatatttagcaatttgagggcttccaagggctagtagtttcaataagagcacttttttttttttttgcaattagtttatttgtatcttatattgcagacagattccaccaacggggagaatccaagcatcaagaaatccctctttcctctttttaattcaaagaatcatttaaagcatagttcttctttgaaaaagcttcctgtagtcactccacccatggtacccgtttttatgtatggtagccctgaaaactgctccagtaaacttgttttactgatgacaacagcatgtcttattttcatgaggtcatattctctttatgctagttaagtacgtgagccagttccataaattcactgggatataaattcattgccattcttctgaatcagttaagaaagttgaagcacaaagtctattaagcaaacaaactagtgaaaggctagtttgtcatgtctgattagccagttatgggcagataacatttataaaagcctgtattttatgtaaggaattctgttaacatttacagttaacaaatatctttgcatttgactcacagagtttgttaacacttgattggcaatttgtctttttgaagccaagttgaattgaccaaattgaatgagctaacaggctccatgaaaaaacagcttgtttccttgtctggcttgagcttttgctggtcagtttaaaaccagggcttttgcttggcatttgacattactcttctgtgttcaccaaaactggtgaatagagcaattgcattcatctggaatttgtggcacagatttccagcatttctctagtacataatgatagatccagatatatcagacagtggtttgggaatatgatccaaaccatactttctcactttgctatccttgaaagcctaccagacttctttggcactaccatatacagtgtttggatcattttcccagcaggaaaaaatttctgttttattgaactggttcacaacctaactgcaatatggaatgaggatacgacagcaattcctggtacagccctatttaactgctctctcttacagcgactaaaactaacagcatgggaatgctttaagggttgaggtttaacaaagctgcatgacatctgccaatttttcctaatgcagggaaaattattaagagggcagaagaatttaactagcatcacttgcattgtgaacattgggagagattggggttctatttttactgggttatttgagttttggtttggtttgctttttagtttggttctcctcttgggtgtggttgcatatcttaattaggcttctcagtgtgcttattgaatgcttgtccatattttgctctaggtacccaattccgacagccctgatcttctgacgttgcagaaatccattcattctgctagcactccaagcagcagaccaaaggagtggcgccccgagaagatctcagatctgcagacccaagtgagtggatcctgcaccactgctagactctccaactctccagtaactgtcctgaggagcggggagggcatgctagagaaaacttagcctctcaatgttacagtaaggctgagcacctcctcaaaatagaccctcagttatagccagatgcatctcgtgagccaggatgaatcttgcttcagtgacccatgttctactgggaaagatgcaagcttctgttagccttcacctagctggaggcaactgaagatgtagtcccagcccataaatacagcccaggaaagagctgagctgtgttaaagaaccataattcatggtaaaaaatgaggcatgccataacatttcaggcaggatgaacacagatggtgggaagattaaggtttcattaaaaataatagcatacaaattgaaagacaggtatgataagttttcttgaaagaatatttcaactcctgaaatccatactgtttttgacaggaaacaggcaaacagttgcattaggaactacatattagactgtattatatagtcacatttatcttccgtaatggaggaataagcagaaactgaatcagtaaatttttcaggtatctgaggtttatctcctttaaacaactattttggttggaaattttgtaatgtatcttttcagtatcccataatgagcattttgttttttgatattgagtattttataaatcctttattcttctgcactataatttctgacaatcctcccgagcttttgaggctataggattacttgtgtctgtgatttcttgtgtcacagatttctgtgattgggagagcggactactgtttttttttttttttttgagacagggcctcaatcccattgcccaggctagggtgcaatggcacaaactcggttcactgcatccttaacctccctgtgctcaggcaatcctcccacctcagcctcccaagtagctgtgactataggtgtgcaccaccacacctggctaatttttcgaatttttggtagagacggggttttgccatgttgcccaggctggtctcgaactcctgggctcaagcaagccacctgcctctgcctcccaaagtgctgggattacagggatgagccaccatgcccagcctctgtttactctttttaactgtaagctgttgcatagaactgctggcagaagttccccatattcccattctatttgccccagccatttatattttctgcttctaacataatataagctggggatggtggaagcatagagaaccagatatccaagtttattggatatgtatgcaaactaaagagacaagcctctgagtgagggcctgcttctctattcccaatttcaaaacaaaacaaaaagaatagagagctttagaactttctttgtgaaaccatttcttttaccaagaagccctctctctctctctctctctctctctctctctctctctctctctctctctctctctctctctcccccctctctccccccccctccccccccttctctctttctttctggcagggtcttactcaatcactcaggctggagtgcagtggcaagattatggctcactgcagccttgacctcctgggctcaagccattctcccatctcagcctccagagtaactggaactacaggcacacgccaccatacatggccagttttttaatttttttatagagacggggtctcgccttgttgcccaggctagaagctcttttcaaataactttatagctcttgctgaatgcagcttattgtaattgcttgatagttacatgtggtcaaggctataaaaatcaccaggagtctcatcgtgttataccaatttaattatttttaaaaagccacttttgagcacttagagtgtacagtgtgctctgctacttcctgtagggagcacaaagctttcttgggaagactttgaaatgatgatggagaatactttcccctgaaacaatatctacttgagtcagttctgaagccatttaccttgggtttcagtgcctagttccttcaaatcttgtaatgttccttgagttcgtcaacattttattcaaactttactgagcccttaaatgcatgtcccttataccatgacatttacagcaaaggtactctgagaattggccccagaggggtcccaaggctagggttgtagcccaagtggccaaatccagcagtcatgattggctgtgaatttccaagtgctttccatgtctcttccgagatcgaggaagaggagattgagccatctttcatcgttcaggagcatgaggctcaggaattgtccagtgagcagacggctctgaggctcctcccctctgccctgaagtcagtctccctccttgatgcagcacctggggatgtctagctgcacagtagacagacaggcagggcggaccactgtgagcccatgttaggaattgaaggcctcctgtgaattaattctttagatagttctgatggggttttgcatatttctttgtgctttgcattttcaatgcccaaatgttaccctccccctttcaaaaaaaaagcaaaaaaaaaaaaaaaaaagtgcagcaagggaacatttgaattttgcaatatcgagagagggaaattggggagataagaacgaaaagggctatacgacttgtagttgagtacattgctaactaaaacattccatattttcagcttctcttgctgctagatatggctgtgtacctaagttctagctggtaaaatataagtggaagcattttgtggagcctttgggaagtcttctcaaaacagagaaacatacaccttttgctttctccttcctgctggttgaagcatgagatcccctgattagagataggatgcaaccaggtagatgagcctgggcctttgattggctgccgtaccagctctatatgtcttatctagatttctaggcttttccattaaataataatacagtcttgtttgaaaaaacccgaagaacagatatggctggaccggctcctccttgcacatgcttgcccttcctggccacacccagtcacctcacctctaagcccccttccctccccagccttatggtcgctctaacttgaatcctgtgtgcattctcatcctttctttcagagccagccattaaaatcactgcgcaagttgttacatctctcttcggcctcaaatcacccggcttcctcagatccccgcttccagcccttaacagctcaacaaaccaaaaattccttctcagaaattcggattcaccccctgagccaggcctctggcgggagcagcaacatccggcaggaacccgcaccgaagggcaggccagccctccagctgccaggtcagatggatcctggttggcatgtgtcctctgtgaccaggagtgccacagagggcccttcctactctgaacagctgggtgccaaaagtgggccaaatgggcacccctataacagaacaaatcgctcacgaatgccaaatctgaatgatttaaaagagacagccttgtaatttgtgctggtaggggggaggggtggacagacaagccagtggggaggggtgggaaagggtgggctgggcttggggcatgggccgggccaagtggtgagccaatattttcagctttatgaaggtgtgtgcaatattgcatgtgttggggccgttgagctcctcgcggccacaaatgctagtcagggatcttagagccacaggagttccttagggatcgccactccccacaggtcttgtgtgagaatagatagagtgtgccattgaggaagaagaaattcttgccagtttctcccctttacattccagctttagtgcaatctctgttgaacttgggaatgccaggatgtgtcctggcactgcaagggataggaaagtcgtgttgaccgatgcccttactacatatttttttctgcctagagtaaatgtggggtttattgtaatccaagagtatccctttgaagggttagcagatgaactgtatgtcttaaattgttttctaaacttccatatttgataggatttgtaacatttatttataattaatattgtactgttaaaatcatatcttttatgttataatgtaaagttattttgagctgtttgaaacattgtgaagcagtgggacagctacagtagtttctataaaaactaaacagtaacatttatatattgcatcaggagtattttattctatatataatatatatatatggtaaatatctgttttataaatatattcatttaaagaaagtatcgttatgacactatctgccatatttttatacatttgtgatatgaagtgagtattatacttctactaaagggagttgaattgtggctacacgtgactgtaacagtatgaaccttgctcaactttgaggccccagcagtagcctctagacatgatccttggtagcagacgagatgcagcatctctttccaaacctgcaggggaagaaagtcagataggccagtgagaattccagcaggcctggtttccgtcctcacacacttggctcctgtttgtgtccagggacgttacttgcacacaggggagaatagattgaggcgttactcgtgggtctttgtagagagaatgtgctcttccacttagcattagtgtagagcgtagaccaaagatttgccagtgaacattccttgttgtgagatcataagaggtacctgtctgcagatcttgcaaaccatctctatgctcctgaatattgtccactgtcccggagactcttggctgatggggtgtgagatatatgtgtggcatttctatttctgaatgccttttttgctattgctctctccaataccatatttaaaaggctcctggagcaattccagatagataaaaaattactctatccatttttttcttcctggggctgtccacttatgacaagattttcatgcacacctgttacgcacacaacccccatcagaacaggacctatcttcccctcatctgatctctttcagctcccaagttactcccaagtatcatcaaaccctttggccatcaagtgttatcctcccatgcctctgggtcatccttgagggaagtcacctcagcaccatcatctatcagtagtagtagatttttggaattagtctctgagcaataatacttttaaaggtccctcccacccctcaaagagataacttctcagtatttattacttgtcctcaaattctgagtgtcagcccctgcatcaagtcagctatgatcaaaatgtgctgttactgttaaccctcccccgagattttgagaatcatagctctgatgattatgaagattataaagactaaggtcctagtttccctgaagcttaaattgtgcacatattgcatttttatataaatactataatgtgtattgattatatagataggtcattttaaggtgctttttatttaattttaatgagtgtaataggcactaaaatgaaactcgactgggtactattactgaaaaaatttgactcaaaccaatagttttgcatgctctttagttctttttctgtcttacttctttcaccagttcagtactgtttgggtagctctgaattctggcttttccaggcagctgcttgatgatacaaatgaggtggaccatcagcagttttgcctggacactaatgactctaaaagggtgtgtatttaactcttctttttcatactagatctctaccttgtattccccccttgcaaaccagaaactacactttttttctctggaaagacttctcactgtgctatgcgcttaggaactgcacggtcccgttgccatgctgtggcattcgaggctcgtcacctaggggctggtttcccatgttgtcatccttgctaacactgggatctcagatgtttgcagaacatttctattcatgacggttcttcaaagaagggctagaatatttgccttctacctagagcaaagtaaacctaattgttgaagagtcaatacgtactttttgtactttcccagatttgagccagaaaatacctacagatatctacaaatgttttcaaccagtgttttcgaggtagctctttaatcctcttctcagcttttgtctgttctgacttttcatccaataagctgtaagtgaactacaatctgcatttccagcatgcaattctcttcctgctcacggagggggatgcaaaagttttctctcacacctaatgggccctctcttagcttttaactgttgttttcccctgttgatgaaaaattactgacatcacaaagattgccatccatggtagaaaggacttgatttaaagtcagaaaaatttgccttttctttaggaaggggaattcatgacatccatgtcctattatcggccgtaacttcctaaagaagaaaaagggtgaatgaaagcttatgttacttttatgaaagtatcactgatctcctttggaaaagaaactctgcttcactgtttttctacctttatttctctgccatcctcgtttttcctctctgaagttctaaataccctttaactgaaccttgttggtcttgctctaaaatttagcctctttctagagcccaagaccaaaagggagtgcttcatgctgaggggctcaagtgagctgactctacaactgtggttctcaactaggggcagatttacccccaagggtacatttggcaatgtctggggacatttggttgtcatagctgggggggaggtgatggtatgctactggcatcaagtggttagaggccacagatgctactaaacaccctgccatgcacaggacagccccccaaacaaacagtggtccagccccaagcactactagtgctgaggttgagaaaccctgccctacaccatcccaagcccaccagtctgcagagcttggctctggccttgttctgtccaggctacagtactgcaggtgtgatttcttcaacatcacattctcttaagagtcttcaaccactatgcctgaatccttggaatcctattgttcgtttccattgtcttgggcctgctaaaaggtgcatactttggaaggagaccagagttactttataggtgttggagaacttaaattctaggttagcatccttagaaaatctttcatagagccatgaggcttatatttagaagcaagcaacagcctggcagattggcatgatttttaccaactgctcaaaggcatccgtggctttcagctgtgtctcccgaaagaaaatgtctttgttttttattcaagtcatttaatagctctttacaaatattagcatatggcagaccaattagaagcaaaaaagtccgtattggtggttgtgatgtggctgttatagaagtatttgtgctgtatgctttggttaaatctgttttaaaacatgctttaagattcaccttacgcagttgtactttaattctaagctcagagctatgctgtcagtctctagtcacgccatgtattataaagtatgttgtggttgtagagttagccagtttagcatgttcctaatctgagaattagtggactatactaggaaatgctatcccattttccctttccagcccctcttagttaagatcatagtatcctcacttcttaaactagtctttagagtaaataaggaaaaaagccatttattttcttctagccatgtattattgagaatgactcatagtacaactttttttcaaaggccagaggattactttgcaagtgtgtagaaagatctgtctatttctgttcacctgggacctggtggtgactgaactctttcagcaagggcaatggctcaatgtgattcggtgctggagctcagctgggactcagtaaatctgcacgttctctgctggtcagaacatgtttcctggagagcattgcttttctatctagaagttcgttacctcctgcatgatagtgggatattgagatgtgggttctaagatccacagactcatacttttgtgaactttggaatgtggtagggtacactgaaccaagtcagaaaatagtgaaatatttccttgcctccttcagttcatcactaagaaagtgtgtaggcagagaaaacttacttatggtttgaagaaccacaattgtttttgaaaggggacatagaaaagacagtacaaaggttgtaagtgtcctgtcgctaattcccagggccagaatctcacaagaagatcctctcaaagacttaaaagcctggcttacaaaaataaccagaaaccaaacttgtaagcagttacaatttcttccttttgcttcttgaccagctgagatacagaatatcttgaggtctggttcagctgatgaaaaattctgtctcagaaacgatgagtaagaaaccatacaagaaaaagaagtccctcatctatctgcatacacgcaatgtgggagaagtggggtggctaggaaactctgggcctgctgcccccttcgattctttttttttttctttgtgaattgaatgtacgatacaaatggtaggccttcatgtgagccagttactacatgaatcttcatttcccacagtggtttgttcattcatcagcgttaggcttggtcctggctccacctttctcctctccgggcactgaccccacctttccgtgtatttactgtaggctattaaatatgatcatgacccgccttgcattttcattcatcacctgtttatgcccaaatttaaaggaagtttgtctcattttgccagaaaaaaattgtaatagtcggcacgctggatttgtagggccagcaaaattgcggcagtgaaactagtttcacttctaaagcccttcatttcccacaaggttaagctctcgaaaccccatttgatccttggttcctatttcgatcctcctttggaatctgaaaatcggtctccatgttgtatgcagattagaagttgccttgtttgttactcttccaacacagggtatcagggagaaagaggccttatctgttcctccatcccccctgttttgacagactgctaagaattcctcaggacttcctttggttggggattttactttcccaaaagtctgatctgatttctttcaggggtagacaagcttgtcctagtgctctgcttcaggtcttatcagaagaaacccaggaatagaaaaggtagatgccttgacttttgtccctgttgtggggactaaagtgttttttgccagaattgtcaaaagctccggttcaaactctgtagagtttcatggaaaaacaaaacaaaacaaaaaagatgcttatcgtcccggagaatgtgtaagtaagttctccagcacggcttaggttttccaaaatggaaagcaaagcttgcagacaacctgttttctctagagacacacaatgattctggccctcagtctgtttccctccccttgtttactctttggtcaccgatcgagtcaggctagaggggtaatacggtgattaaaagaagtaaattctcactgtaaacttggattgattaacagaaacaattaaaccaaacaaaatcattgccccaaatttctatctccaagaattgctttgtgccattttgaattcaggtagttattctgtatatacttagctaactattcagagcttcttcaatctctagtaagcttgaaggtggtgtctgggaagacacagggcagggtgacatttagactctgttcattcttaaaaatagggataagccagaatgatgtgacatctagtatgtggtagatgaagaatcagtggaaattcttaattgcacagactttataatccattatataaagtgtaattccatactttttactgtggcaagggtgtgatgtgattgttaatctttttaatttttgaatccaaactgaatttaaagtgttgaatacttaaatcctcacaagtgaattatgaaccatttgtaaagtgtttctataactctttgtatcatgtgttggtacatcttatcaagttttttctggcatgtaattccattctaaacttatgtaaaatttctattgttgctgtaaatattacacaaatatctattccgtgataaccttcattatcagcatgaaatggttaatttttactgagcacaatgtatttttgaatggatcttcccaaatgtctttaataaaatgcagattttgcactgactgatgtgactgccaggccgtcccaatcttgagcactgtggtccttcgtgtttgaactgcgaacagctccattttagttccttcttgggaagaaagaatgcattcgaattcaaatgagggatgatgggcctttgaggttgtaatcagtttgagacagaaattaatgtaaaactaggcaaatcctgtaacttaatgatgttgatctttgttttcctatttataaagcttttttccccttacggcattttgaaaactttggtttgttttatacttgagtgttgtcacctttgcacgtcgctagacactcacgtggtagtttgaggaggatgggaagagaggccaatcttgtgctaagtgctatggagaaagcaaagatgcacagcttaataagggttttttgattctagaggagaggtgggcaagcttttcctgtaaagggccagatggtaaatattgggggctctgtggcccatcagttccctgtcaacattactcagctctgcctttgtattgcagaggctgcatggataatatgtaaatcagtaagtgtggctgtggtcccgtaaaactttacttatagaaacaggccatagtttactaacccgttttaggccctcagtttcatcatttagggtaacaccaaccgagtacatgttcaatcaggagggaaagaacttagcttttgtgataacttatagatgaaatattccccagttttctttctctttctaaacaaagggtaggagctgaaagtcagtgctctccattcttaaaagtcctctgtcaaccacctcttcactctatctccttaagtgacatggaaacttgtggcctgtgctttcaactataatcttaccaagactgaatgaaagtatttggtgcttatactttttaatgttcatagcacttactatggccaggcacaatgcccaagtgttttgctttattattattattattattattattattattattattattattattttcacaacaacccagcgaaacaggtactattattatcccctttttgtaaatgaggaaacagatttccatacttgacattaacctgcccaaggtcacccagtttggaagtggcagggccaggatttgaagccgaatatgttcattgtaaagcccatatacccttaaaagtcactgcacgtccacgtatggtaatgtggtcacaatcagtattgtttctctttagtaattcagatttattcaagtaactccaaggttcaaattttcaaaaacagtttccaacacaggttatattaaaaactttgcctgaagtttactctaggtgcagaaataaagacaacttagtcaagtgaaggaaagggtaacagacttagaaatggctatctacactgatggaataagtatactaattagagcaggtaacaagtccccacgatgtataacatattcttctctaaaagctcacaacaatttatgtgccaccttccatcccctttcccagcagatggtaattgatgcaatttgagaatagaacacttcattgaaacaagtcactggaggtcctctggggatgcagcttaaaagcccaggatcaggccaggtgtggtggctcacgcctgtaatcccagcactgtgggagactgagacgggcagatcacctgaagtcaggagttcgagaccagcctggccaatatagagaaaccccgtctgtactaaaaatacaaaaattaggtctgggcggtggctcacgcccgtaatcctagcactttgggaggccaaggtgggtggatcacgaggtcaggagttcgagaccagcctggccaacatggtgaaaccccgtctctactaaaaatacaaaaattgggtgtggtggtacatgcctgtaatcccagctgcttaggaggctgaggcaggagaatcacttgaacccaaaaggcagaggttgcagtgagccgagatcacgccactgcactccagcctggcaacagagcgagactctgtctcaaaaaaaaaaaaaaaaaaatacaaaaattagccgggaatggtggtgaatgtctataatcccagccactcgggaggctgaggcaggagaatcacttgaacccaaaaggcagaggttgcagtgagccaagatcgcaccactgcactcccacctggacgacagagcgagacgccatctcaaaaataaataaataaataaatccctaggatatagagtccgcttgcctgggtggagtcttggctccatctcctacatctcatgtgacttgaagcaaggcacttcactatgcctcagtttccttatctttaaatggaggtaatcacagtacctacctcagtgttgttgtgaagatttaatgagataataacctgcagagcacttgagagtctcaagaaatatgagctcttataacattattgctattgtaaaacattgctattacttctgtcccaatttggcagtttcaggaaattgagaaggaatgtcactgaatctttaatgccagttacacagagctcagtaggtgtccgcacagccctttagatgcacgtagcctatttgatcttcgtatcagccctgtaaggttgggcttaagaatgacccagcatggaagtactcttgggaccacaggggaagcaacagtccttgtaagctgtttgtcagtgggccttagcaaccaagccccaagtggacagaaagatggggttctgtgagcatccattccaagggtcactttaggggtgcaatcttctgggctctgagaatggattcacagcagcatctctatctggaaatacctttgctttgtccaagtaacctcctcccacacagagtacccgaatcagctcagattttttttccttaatattggcaacacttaatgctacttctttgttcgtaacatttcatttaattatttaaaaatctgcaaatgttgtgtatattttaccgcaatttttaaacaaactccagtgtagaccgtgctctagcatttctaaaaataaaagtaaatatgttaaaataaggtaagagtgagtttttcctacactatgtataatttttaattgaaagtttcccccacaaaagaaatgatacttggaagcatagtttgtgtgtttgacagcaagattctattaggcttcagatttccctcaataaaagttttagtttttatacattctgtcatgaattgaatgaagtaaataatatgctgttgtaagcaaattatctgcagataaatgtcttatgaatcgtatatcttactgtttattaaattctgaagtattgagcagtttccaatgtgaaatcccagctggcttctttgcaatgatggacaagttagttataattcatatggaaattcaaggaacccagaatagccaaaacaatcccgaagagcaaagttggaggactcacatgccccaatttcaaaacttactacaaagctacaataatgaagaaagtgaggtaatagaatttggagtccagaaataaaccctctcacatttatggtcaattgttttttgacaagggtgccaagatcattcaatgggggaaagaatagtcttttcagcaaatagtggtgggacaactggatatccacatgcaaaagaatgacgttggactcctatttcacaccatatacaaaaattaactcaaaatggaacaaagatctaactgtaagaggtagaactataaaactcatagaagaaaacataggggtaaatcttcatgaccttggatttggcagtggtttctcagatatgacaccaaaggcacaagcaaagagaaaaataaattggacttcatcaaatatttaaaattttgtgcttaagaggactctatcgagagggttaaaaagatccacagaatgggagaaaatatttgcaaatcatatccaataagggaattagaatatacaaagaattcttaaactcagtaagttgtaagccgatttaaaatgggcagaggatctgaaaaacctttatccaaagatgtacaaatggccagtaaacacatgaaaagatgctcaacatcattagtcactagggaaatgcaaatcaaaaccacagttgagatgcaacttcacacattatgggtatagtcaaagatggacagtaacaagtgttgctgaggatgtggagaaagtggaagcctcctacattgctggtggaaatgtaaaatgatgcagccacttgggataatagttcctccaaagattaaacaagagtgactgtgtgtcccagcagttttactcctaagtatatacccaagataaatgaaaacacacatccgcacaaaaacttatacacaaatgttcatagcagcattattcataatagctaaagagtggaaacccaaatatccatcaatggatgaatggataaataacaatgtgctcttgacatgatactgaacaatgatgttcagcaataaaaaggagtgacaagtgacatagtgatacacatgttataacgtggatgaactttaaaacactatgctaagtgaaagaagccagtcacgaaataccacatactatatgatttcatttatgtagaacgtccagaaggccaatctacagagacagtcgattcgtggttgcagagggcttggggtggccgatgggttggggagtgttggctgatgggtgcaggatttctctttggggtgataaactttctaaaattgatctagtgataatggttgcacaactctgaatataccaaaagtcatcaaattgtacactttaaatggatacaaattgtatgtgaacttaatctcaataaagccgtgacaaaagtttccaacatgaactcttatttggaaagcctttctccctgcctcactgtttcctcctctcctttttccctgaactgcactctctcgactcctgtgtttgatgtgccttaactcttaggatactgccattttgtctgacagtccatgtcgtgaccaaagttaattcacctttccaaataagggtctctgttcaggcatttctatccaaaatagatttgtcctgtgtcctaaggccagggataagtccccccaccccccccccccacccccaacaccctgtgtgatgtgtttatatttgagagaagattgggcggggaaaagcattttccgaagttcaagcatacagcatagggactagaaagatgctgggttggatataaaataattgagcccccaaagcatcaagaaggatgtttggggcttttagaaggctgcctgttcacagaaaaggtgaatgtgttgtccagcactgtattagcgcgagtctagtcacttgccttggcatttgaaaatgaaaagtaactcggaaatgagctgctagcaaagactaccctgtgtctggggccagaacagtctttagagcagcctcgtcctctgattccaccacctgctctccatatccctctcctgcccctcccccgtgttaacagcctctcccaggaaggggcctggaaactcaggctgcgctctaagtggccaatgaggcctcccaatctaaggcgccgcctccaggaacggaaagccaggcccattccttcccagagagcttttcaggagcaggcgcagtttgcgtattgcaaggcagagggtggagggtgagaagctttcagggaaaaagctacatggtcctttttatgatgtgagtccttcccacttcctgcgaagcatgtagccagctaatgagcctcctctgagtagccagtggtagctcctgggccagctgttctcgaactatgtttggtttgctaggaaatggtagccctaggtaaagggcaattgtactgtgttgtggtcatttggggtccctacatatactgagatgtgcagcctgtcctgtatgatcacctaaatggtgaccacagacacggggaatttgctggaatggattgcataatggagctgtgtgtattgggcgctctggtccctccccaatccctgtgttcatgagggtggaagcccagatccgccttgaaggtaagaactgtgagcagaggaaactcccctaccttgggcttttggtcatttgtcacgtatagcctctcagggcaccgggattctcacccaccgcactcatccctgccacccagtcacccttgagaccctcagctgcctccccagggctctgaagtcctctttggcgatgatttagtggaaacttaactaggaggagctgctcccttctgcattcaaagccaggctttaggaaactgtatgtttctgtcttgaatgtggtaaagcaaatgaattttcaaattatcagggctgctttgtgttcccctgagactgcacctttcacagtatcactgagacaaaaaatgagcagaaaattacccctgctacttaggcttttgtaagaaaattcgtttcggggacattttctttgttctgactttctctggccctgagtggggaataagttcatttttatttcattgaaatcagaaagctatatcttaaaaaaaaaaaaattatctacccagcactgcagttacaattgctttgcgaaatatagccctgtccatctcggtggtgtgtgagggggtcccctacggcccgctctgtgccagtcaccccctggcaggcgccgagctgaggcaggcatcaggcacacttgctgacgcactccagcagctccatccggatggcaatgcggacgtgccagcccagcgggatgaggcggatgaagcgggagatgatggggggccgcagcaggttctgaaccgtggaggtgcggtccgagttgccatagaagacctagagagatagaggaaatcctgtcaccatcacatcggggagggaaaaggaagaagggttcctttctggagctagccccaacttttaactatagaaatgattaggaagtagttaaagcagtttgcgggtgccccccaaaatctgaccttgagtgattgtcatcacacctacatgcttgggacatctggaactgcaccatccaatagggtggccactagccaatatgtctgtttacacttcaattaattaaaattagataaaaattcagttcctcagtcacatgagccacatttcaagtggccgccatattggacagtgcagatgtgaacatttccatcacagaaagttctattggagggtgctgctagaaaatgccacttgactcatcgcttttgagtttttatcctttgcattttgacattttgaaaaggcccacatcacacttacatgttccaaaggtatccaaagtagggctcaagtgaaaacccgtgcttggctcaggagttgtaagccaaaacttaaatgtgtattcctactttgatacaagtgatgagtacctttccaacttggaaaatgtttttttaaaaagacataaaaacttggccaggcgcagtggctcacgcctgtaatcccagcactttgggaggcggaggcgggcggatcgtttgaggtcaggagtttgagaccagcctggccaacacacagtgagaccccgtctctactaaaaatacaaaaaaattagccaggcgcagtggcaggtgcctgtaaatcccagctactctggaggcggaggcaggagaattacttgaacccgggaggcggaggttacagtgagctgagatcacaccgttgcactccagcctgggcaacagagtgagactccatctcaaaacaaaacaaaaagacataaaaactcgaaggaagattctggaaaggggagggtggtgccagagtaaagagaaagggggtttgcttagtgtttttaaggatgtaacataaaaacatgctgtgggtgtttgacgccatttccaaagaaatcattctttgccctcttaccaaagtcatggtgctctgcctgatgccactaggacatttcatctccttctgggattatctcctgaaaatatctggctgttgcatttggccccatccatccacaaaacgggaagggcctggtctgccatgttcttgcctttctccgcagtggcaccgccccacaccaccctctctattgcagtttgtctttgagcctattcaagtcaggagccaggtgaagagaggggagggtggaacaggctccaccagattgcacaagtgcaggggtgaagtgcctctttgcaaagaaccttcaaggccttcagaagcacagggcttgaaaaacttctcatgtcttttgaagaggccagctaataagaataaaaatgaaattaaatgtccaagtatcaagatggtttttcctcttgtgttcaaactccttggaacaacccatgaacgtcttggccgtacaaattgtcatcagagacttacaaagccttctgaatctcagctgtacatgtctacttaacctgattaaatgttgaaattagcctggggaactccttactcttaggcaaaaggatgtttaccatttccaaagagctagggagtttttaattcatttttattcatagcaaatatatatatatatatatagtcaggagtctactgcgtttagtcaatggtgaagaagacttctgtctcaatccacaaagattaataggatgtagagttgcccaaaggtttaagttcgtctgtgtttgtgctggtgaagtccttttaaccatttggctaatgggtaacttgctaggttctcaaaaggctcccctctgtcagtctcaaacaataggagaggccacatctatataaatggatgattctctacccacatcaataacatcagaccatacccgtgaagcaaagtgcattcaatgatccagtgagttgaaatagtccaaatggtcagtcttaagagttcaggcaactgcatgctgatatggaaactcagacaaattttttttttgagcttaagaatagcattcatttgcaaacaaactgtgctgggcaccaaagcaagcccaggaaagagagcacagcacattgtgggggaaagcgcagatgatccactgtgctgtggagtcggtgctctgacagagggcagtgacaggagctcggggacaggaggggaagtcccagagggtgcgagctgaagttggtttgggataagcccaacttacccggttgtttccagtctggtccttgtagtaaatccagttcaggcgctcatcggtcctgtactgcacgctgtacttggtcatccactcatcgatgtcacagcgcccctgggtgaggatccctgaaatcactttgatctccttcagatctatctgtaaccactggctactgtcctggaacttggagagccaggcacacctgccgagaacataccgagtcaccgagagactccccctgtgcatgtctgcaaaaagcccgcaggtgctggctctcgaggggatgccagcatccaaagagccccctgccaagctcgggcagtctgggctgcagtctgagccttgtctcctaggaatggccagcttccgttatacttaacttgcatctcattctccctctccctgcatctccacctcccaagaaaagatttccagattcgactaatttgtcaaagaaatgcctcagagtgtggctgaaattgcctttgggagtggttgaacatgtctgtctgcaaaacacgcaggtgcatggctgttagaccaccagcccctgccctctgcttgagactcccagggtgaacctttctgcgcatttcactctcttcacacctatttgtgtttccctcggttggtgacattcctgcctcgtgcagagcactgacccatgtggatctagaagggctttgacaagtgtcaagccagataaccgttgaagcaactaagttgtttttttagctacattcctcataaatcgtggaaacctatagtagttccccccgccacctccttttttccttttagtgtgtattttaattagctttgtaggacttaagccctgggccaccttctcttccttttccagacttattccttgggtggctcctgacttttcacttctatcccacaccttttctaaaccccaaatccagagagttcagttgccagctagaggacttctgtatgcctctcagcatctcagatgaaacacgtcccaatgtgagcccctaagtgcccccaccccaccctgctttcagaccccacgtctctgagttaaccccatccttgcatgtgtccatgccggccacctgagaaccatcctgggcccctcctctccacctccagtgcccaatctatctattggctccatctccaagtgcctcaaattcttctacttctgtcggtctccaccgccaccactctagcccgtgtccccctctttcttcccacacctcaactactctccctggattgctctggccccacaggaaccagagaacttttcttaaaacacaaatgtgcttgcgatactcttcgacttaaaatatttatccggcagagtctgctaattatcacccgatactcccttcccatcctcatttggtaatagaacccctgagtttcatctgggcaaatggccatctggctaagatggcatttcctagtctcccttgcaactagatggggccccctaaccaaactctggtcaatgggatgtgggcagaagtggccaatagaatatgtttgtgttcttaaaggcaagtcatgcgcactctgctgctcttttgtttctccccactaactagacggtggatgtgatggcagaagacagagacaccattctggaccccaagatagacgcttcatgttaaggacgacagaacaacaaggtagagtctgggccccgcatgccatcaagctgccataacgaccctagactactgaatgaaacttttttttttcctttctgagacagagtcttgctctgtcgcccaggctggtgtgcagtggcacacaatctcggctcactgcaacctccgcctcccaggttcaagtgattctcctgcctcagcctcctaagtagctgggattatagccacctgccaccatgcccggctaatttttgtatttttagtagagatgaggtttcaccatgttggctaagctggtcttgaactcctgacctcaggtaatctgccccccctcggcctcccaaagtgctaggattacaggcgtaagccactgtgcctggctgatgaatggaacttttaagtgagcaagaaacacacttctacattaagtcactgtactttggtgctctttgttacaacagcatgaacatgtatgctaactaatacgcactcagggtcctcccattatccctacagtacggaccacagtcattaacgtggcttctaaggtcctgcaccatctgacctccgcttgcctctccaccttgtctcacttgtgcttcaggcttgctgccctgcttatgttccccatccacaccctggaggtatcatcccgactcagggcttttgcacctgctgtaccccacgcctcttcccctccctcacctggccaacttcaagccacaggtcaaatatgttttccttagaaagccttccctggctgcatggatgaggtctttcttccttcatctctcccccagcactcataagtacattctgtgtcatttgtttattagagaggcctatattttttttcatttttgagacagggtctcactctgtcgcccaggctgtagtgcagtggtgtgatctcggctcactgtaacctccgcttcccaggttcaagcaattctcctgcctcagcctcctgagtagctgggattacaggcacgtgccaccacgccagttaattttttgtatttttagtagagacggggtttcactgtgttggccacgctggtagagaggcctatttttttttaaaagcacatgaaaaaaaatccccgggccctgcttacccaaagccttgactgttgagccgggccttgtttgcagtccacgaagaataccagcccacatactgctccgggttagagcaggtgatctggtccggtgtgacctcccctgactcgaaacccagaggcttgtgatatgggcattctgggaaaggaaaaagaattcacattcacacatatctcaatactcaacaagcaccaggtgactgaaataacaaaacaaacccatctgctttgcgcttcggagacggagaaggctttacctgtctctgtggttcacaatgggtacagctgtgtcttcaacggttcactactcacgcaagaaaggaatgaaggatgaagtaaaggaattgccatagagactcaacagcctttgtaaaagcagagggaagtggctctatggcaacttcacaaggggtgtgtggaattttgagaaatacttcacctcctccaccaacttagagatctaaaaaccaagaggtgcacagtgaaataccatatttaaatgccatacatctttatttcccccattaacacagatttagccatcctgcctcatgacgtcaggtctcttgttgtccttgggcagcagatcatgccaattatagggacaaaaccacagtgagacgcaagaagggcgatgacatattgagatatagagaatgacttcctacttgtaaattgcagttttctcaccagtctaatgaaaaaaaaaatgggtgaaatgtgcttgggggactgttgagtgagaaacagctaaaaggaactgctttttcccagtggtagtacccaaaggtggttcttctgtgttgattgtctcccccttcctctcgtctgtatgtcccctcacagtaaaaacggtgttgaggctgggcacggtgactcatgcctgtaatcccagctactcgggaggctgaggcaggagaatcgcttgaacccgggaggcagaggtttcagtgagccgaggtggtgcctgcagtggcaggcacagtgtcgagttacctggtcagaggctgccaattttcaacccagtattcattcattctccccttcttctccttttttttttcttttgagacagggtctcgccctgtcctaggctgcagtgcggtgctgctatgtcagcccactgcaacctctgcctcctgggctcaagcgatcctgccacctcagccttctgagtagctgggaccacaggtgcacaccaccacacccagctaatttttgtattttttgtagagacaggattttgccatgttccccaggctggtcttgaactcctgggctcaagggatccacctgcctcggcctcccaaggcactagggattacaggtgtgagccatcacacccagcctccccttctttttgactaaagagctctccttttattgggagcagcaatgtagccagctgaataaagggcctttcccagcctcctttgcagttagaagtgcccaggtgacataacttctgaccagtgagacataaagactgcctgctgggatttctggtcaggttttgcttgccccttcttttttcctgttgcctagatcacatctgatagttggtgtgacagtaaccatcttgcaccatgtgggtaaggccgagagaactgcagaggctgagtgcagtggctcatgcctgtaatcccagtgctttgggaggatcacttgagcccaggagttcaagaccagcctggggcaacatagggagaccccatctcgtggctcacgtctatagtcccagctaccggggaggctgagggaggaggattgcttgagcctaggagtctgtggctgcagtgagccatgatcacaccactgcattccagcctgggtgatagacactgtctcaaaaaaaaaaaaaaaaaagaaaactacagagaccttagccttgataaccttaagtattataactccctacccctaattttttttaccatgtgagttaaaactcctaaatcaataagccagtatttagggggtcttgtgcttataaccaaacccagttcctaactgaatttctacagaaaacaaatggcaaatatattttccttttttggttagagacctggtctcgctgtgtcgcacaggctggagtgctgtggcgcagtcatagctctctgcaactctaactcctgggctcaagtgatcctcccacctcattctcctagttttctgatgatgaatgataaactgcaattaaggcaaatcatagtattttctccagaatttttcaaaagccagtaaagttgaatgaaacatgcttgcagagacggccatgccctgtccccagaggctaaaaacaggccagcttcagacctctggccggggaggcttaacttcctttctgccccaatgcacgaaaggaataggcctgatctcactagtatctgcagctctgtgggtctgagggtgagggcacagaatttgtagtttattgagtactcaagtactcaagaatgcagtttccaggactccaccccagagcaattgcatttttaacaagccaacttttgaaagtgcaccttgaaaaccttggcctgccagggaagacattctttctgtgggctggggatcccgaggactgagtgcctgcggactcgagggctcctcccccacccgcgacacccctccagctgggaagacaagcccgagcgatcagggggaggggcacaaggccaggtggcagggatttttcatgggcaaaattctaaccttgggtgtctctgaggcccctccactttgagcatttgatgactgaacctcctttttgttttccacccccacccgccgccgccgccccgctcagggctactagctctgagagagtaggcagaggggaagggaaaaagccagtgccacctctcccagtcaccttattcttggcactttgctcttcttcatctgtttccccttcacatctcttttgccatttcttcccaaatagctcatctaacactccagagcggtctgtagccctgcaggggtacctggccagggccaatggccttgacagcctgggagggcctgtccaggcagcagagaatgtgtggctcactctgcgatctaaagacccgtgtgtccagacgtggatgctgtacttactccccagggaaggtgacgctctcactgtcaccttggcttcagctggtgtctgggagccgatgcctgcctcccgggccccaagcttcattccactgccctctgaatattttccaggagaatacttctgctgtggtgacccaaagaagcctcacactccgtgcgtcccaaaccgagcccttcatcgtccaatctccagtcctgctccctatccagtactccaggtccgaggcacttccatgtgcccgacactccaggtccgaggcactgatgctttcagctgcccaacccagcaatccggtaagcagagactctagaccggtggggctcagcctgggctgtacctcggaattgcccgaggagctgtagaaatgcagatgttcaggccacacccccagggattctgacatcattggcctgggcatggggacaaagctgcaggtgattgtaatgggcagtcaaggtcaagcaggcctgcgtccagccaatgacacctggggtaggggcccaccctctcagcgtgtgcgcaggccagttgcttaacctctctgggtctcagtctcctcatctgtgaaatgggggcatgatgtagtacctgtcttcataaaattgctgtaagattgagtgaaactatttggagattgtagagttcgtagagcacagcgtcttgccaaaaagcagcaggtgcatgacattggtggaggtgaatttgtgagactacgttgataaccttcttgaattttgcatgtttttctggcaaagactcaatagggaggaaatccattgcccctctatcctactctgttctgtccccattaccctccccgtccccccaccaccgcaccccccgccacaccctccagagaatgaggccagcttcatgtgactaatgaatggtttcggctgtccttgccccaggcaggagcaagtgtgtgtgtgtgtgtgtgtgtgtgtgtgtgtgtgtgtgtgtgtgagagagagagagagagagagagacagagagacacagagagagacagagagggatgtgagagagaaacttgtcgacagcatcccttaagcttatggacctggaagatctaggcctcaccaggaattagcgcattgcccaagagaaggaggtcacagccccagctaaagtagcagggatgtggtgagggcctgagcgcagcagagagggacctgattcccctgaggggctggactgggatgggcttgggagccctaagctctgggcacgctcagaaaacttgggaaggtccctcggactgagtatggctcagagggagaggagccacccatgagacgtctgccttccaatggggctgtggccagcctgccctcgcaagctcgtggggggttcatgtagtctaaatagggagaaaagaccttcaaaaatcctgtctgcacactcctcacaggccattacaatggggcactccggctggatttcttctaacgtggaaaaatagaaaatgtgacatttcccacactgtgtgtgtcctgaagaagagcacactccagttctcttattgtgatttttcctgacttcttcttcccctttcctcttccttctgtgggcctggttgagctcttttcaggtccacatgtggcctgcagcccttccctgaggccatcccctcccgtccacacccctccgcctggccccccatgcctcagccttcagatctctgcccgccctgagctggctgaggggccccaggtgctacctccccagcacccttcacacctgtcacgcacccctcctcctcaggcatacttcactgccatctcccctcgcctgcctccctccccattctccccctagctgagcagaatgcccacaggtgctgggcactctctaggtattgactggacagatggatggagagatgaatgaacacacaccatcgccccatcttgggtggccactggggacaagcataggaaatggcatttcgaaacaggcagcagaggcctcagggaagaagtagacactgactgcgacctctggcctaatcaaaagaaaccataaattgagtagatgctagaaggcaacataaatagtgttgtgaaagaattaaggggatccaaggctgggtgcagtggctcacgcctgtaatcccagcactttgggaggccgaggcgggaggatcacttgaggtcaggagttcgagaccagcctggccaacacggtgaaaccccatctctactaaaaatacaaaaattagccgagcgcagtggttggcacctgtaatcccagctacttgggaggctgaaacaggagaatcgcttgaacccaggaggcagagcttgcagtgagccaagatcgtgccactgcactccagcttgggcaacagagccagactacatttcaaaaaaaaaaactaaggggatccttatcagacacacacagaatatgaccttcccaagttttccacccagtgtcactttgctgttgcagctattagacctgtttctatactcatttcacccttagggaaaagcctacatcttctgtggctcaaatggctcttctgagccatgatgtgatcatgagatagataaaggcatatttgcaatatgttaccagcccaaggctgtgtatatttcatattctagcctttttactttagtggctactttctgagtttgtaggcaggcttataaagaatgcagatctaaagaaacacagaattcagggactttcttaacacaagattccagacagatgtgaatagtgttatgcatagatattagacttgaatatatgtgacaatatagtagagtacagaagaaaatatgtagaataatatttctggaagaatggatcataagctcaagcatcatatagaatagaaaatctagaatcaaaaggaaccattagcaaaccagtagatttcttatacttttgataatttccctaccctattttttgctctcagagtgccggggtaatcttggctcaacggtggaagagacagagcttttagtatttttaatagcattaaagtgaagattaggaggccagaatgcatgtggccttctgctccgtggggggcccgggcattagccagagtgcacctgctagcgctcctggcagctctgagtgaccccgctgtccttctgtgctttccagggttctctttcttcgtgagacacgttatgagggaagccctgattcacagggcccaggtaaaccaagctgcgctcctgacataccatgagaatgcggcactgacgggcaagtgacttctgcaagcctgcggctggtcccaatgccctgaatcacctctctcatggaagaaccaattaacaccaatgaatcaaccattaa

SEQ ID NO: 15 - DNA, 201928 bp, Homo sapiens
  source 1..201928: mol_type = genomic DNA
aatgggcgggcagcatccacatgacccgcgccggcgggagggcgtggggaggcaggccaggaacgcacgctgcctggccgtatcgccgcccccaccgccgccgccgccgggactagaagtgagccgcccgggtcccaaacgccagccagccagtcagtgggtcccgcagtcgcccgcaaccggggcgaatcatggcggccgccaaggtaaccgcgggcccgaggccggggggagcgcgcctgccggatcagcctgggggtgcgagaggctcgggcgctcacgtgtctgggttggtgccacaggcggagcaaaatggggtgccgggcagccgttccaccttgcggctgctggagggagggggccactcctcccgggcagcacaggcggtcggtgcagagaccgaggcccgacctcgcagcggaaactttgtgggccggacactcccacttggccggggagggaagttggtgcctgacggggctgagccagggccgacgaggaggagcgggcgcgactggggcctggtgcaccctgggccggcaagcgctgggggtcctctctaccttcccagcgcgctcctgctcctgaccccgctggttgttgactccggcttcttccaggggccagagcccgggctgaagcctgatcctattacgtttcaagggctccgccctcccgcgggtggggaagttactttgacttccgttttggaaactgcctaggagacttggtctgcgcctttgtgaataaaaagtccagggactctccccctccccgctttcccatcattcccatcttccccctccctctctccatctgacaacacttagatacccgcctcggagcatttgagaggcttctttttgggaacgatgaaacagattgtcctgggagcctgtcactcctgtgaagttgtacttgaaaggggttctgtgtaatgtgaatcattcactaacccagaggaaaggcaactccaacacttgacctttcctctttcaccatttcttgaaacctggacaccatttcagtctctttggactgcatttcaacttctctggcagaataccatatttagtcccaatcacttgaatcatttggaatttattgcttttaatttaagttcacgaaggcagccctctaatcaagcctatacaacttcttagctcattttaagtgcagtgaacttaaatatacctaacatttcaaacatttgtccttaatcaaaactctgtgataaccctcaagaggaaaacatggccaacacatcatattcctatttattcaagcaaactaatcacatttgcaatggaaattgtaagcagacaaatatatttaaatgctgttctatgacttaagtctctccaggctccccaaatccgtaggcttcttcatgttgttagtttctgtggtctaagtggcatttctcttttctgtaattactctgagtttcatccttaggaaagtactctgggtgtgtgggctcatgtatgtttgcatatgaacacacaggtgtgcgtgtgtatatctatctataacttttcagcagtttctctgagcatcactaggattcaattttggaagctgccttaaccctttcaagcccaatagcccttgaccttttttttgcattaaatttgcatgcaaccaaggtacaaggcttggtatgaactaattccctagagtaggtgggactaggtacccattctttactgttagttttatatctgcaggtaatgtaaatacttttactttattaggagataaggtaattgaggaacataaattgagacgtgtgcatagaaatggagtataagacttgagtaatattaagtaaaataagtgacctggtgctgtggctcatgcctgtaatcccagcactttgggaggctggggcgggcgggtcagttgaggccaggagttcgagaccagcctggccaacgtggcaaaaccctgtctctactaaaaatacaaaaaagttagctaggcgtgctggtgggcacctgtaatcccagctactcaggatgctgaggcagaagaatcgcttaaactcaggaggcggagattgcagtgagccgagattgtgccattgcactccagtctgggcaacagagcaagaccctgtctcaaaaacaaataacaacaacgacaaaacataaaataagtgatatggaagttagttcaactctttggttgtacttctacataatagtagaagtgtcacatatcaagggcagttgatttttagctaagtattgagtcagggaaaatgaaatgttcatttttactacttgggagcttgtgtttttgtttatgtcttcatttgcactcacctctttctgtgatatctgatggctcacatcatatatacttattttgcaatccaataagatatataaaaatcaattccaagtagatgggaaaaacaggacaaagggaaagtaagacaaagccaggactaaggttagtggaacattatgtgcttactagaggtgattgcattttctcccagccaaagcaaagaggaaatgatcagtgaggtcatttacttgggagagaagtctccttatactgctctctgagagcagttttttttttttttttttttttgagatggagtcttgctctgttgccaggctggagtgcagtggcatgatcttgcctcactgtaacctctgccttctgggttcaagtgattctcctgcctcagcctcccaagtatctgggactacaggcacgtgccaccacacccagctaatttttgtatttttagtaggccaacatcatgttggccaggctggtcttggatctcttgacctcgtgatctgcctgccttaacctcccaaaatgcagggattacaggcatgagccaccacgcccagccgagcagtttcttttatatgctgtgagtgaacggcatttgaatctaccttgtgaccacagatatatgtctgtgggttacataaggccatttcttatcatgtccttcattataactcaatggcagtgcagtaaatgtggccttaaaaggtccctcaatgaagctgctggtctaacttattccaagaatgtcccttattgaactgcctttgggcatcacctttatcggttgattctgttggcagcctgagttaaaggctgtgctccttgctttttccctggagcatagctattccatgttgccagctgaacacagagccataggggtagggttggcattccctcttaaaagttgaggagcctggataggagaggacttcacctcaatggactgttaggaaattgggctgagactctggggactcagcaactgtgagaattccaacactcactacactcactgtgacaaattgtttgaatatttaagcagatttggtattttctggatagatgtagccacaactagcaattagttttctgatctgtttctttctttggtctttatacttatttaaatacagctaattattcatgaccttcctttaaatagttttaatggggagatggagaatctagtctttggctgctttttattttgaattttgctatgaagattactagttaatggttcaagaagtgtttgttttctttcgtgaatgaacattaatctaaaactcttagtattctgagattatctcaaaaagtgtccattctcttgctgcctacgtttgtaggaataatccttgtgggttcccttgttagatctgcctgtactgtttgcgttgtttgaatatttcttttaaacatttcccaaaactgccataaaaaaacagttttaaaaggtggtaattgagaggtcacccttttcttcgtctctgcccttttcttggttaaaggagagctttcttcttcgtcattggttaaatttatgcgttacgaatgatgtaattaacctatatgaacctactaaaagttagaatatgctcccttgagttcagacctgtgagatgttctggggtaaaactgaacacagaccaatattagcctagaaccaaaagaaggaaatttgggggcacattaaagcattaataataaagacaatttggtctgtaggactagtacactttgtattgacttttcattcttggatgagttgttgctgtgatcattgattcatttatgtgtattgtgttctttccagtgttgcaaatgggacaaaattgagaatactaaaatgaattgttagctgggcatggtggcacgcatctgtggtcccggctacttgggaggctaaggcaggaggatcacttgagcccagaaggcagaggttgcagtgagctgagatagcaccactgtactccagcttgggttacagaacgagatcctgtctcaaaaaaaaataaaataaagtaaaataaaataataaaataaaataaaatagaataaaataaataaaatgaattggactccattttgatgttcaagaaaaccaaaaccattccagggggctaagttctctgatggaaatgctcccactacaaggtttgtgggagcagtaggagaagagcccatttctgaggagatgagggaagtcttctgaaaattgctagtatttcagaaggaatggatggggaagagtaaagatccaatccagtggttggaaacaaatgaagggctgggaggtgagagcacaggctacatttagttaacagcaggtaataaaaactaaaagcagctgacacttactgagcgcttactagataccaaattcagttccaaatgtgtttcattgttgattcatttaaaattcagttccaactgtgtttcgttgttgattcatttaatgcctcagccttttgagttagttactatcatcctttttttatagatgaaggctctgagataccaagaggtgatgttagtggcctaagatctgataagtatggctgggtacggtggctcacacctataatcccagcaccttgggaggccgaggcaggtgaatcacctcaggtcaggaatttgagaccagcctggccagtctggcccatctctactaaaaataggaaacaattagccgggcatagtggtgcattcttgtaatctcagctgctcgggaggctgaggtaggggaatttgcttcaacctgggaggcggaggttgcagtgagctgacgtcgtgccattgcactccagcctgggtgacagagcaagactctgtctcaaaaaaataaaataaaataaaaaagatcggataattaggaaattatcgagctggggttcaaatcctgccagtctggctccagcagctgtggcctcactctgtccaccatgtgtgcctggtagtttagtgtggtggagaataaagtatatgggagaggtgtgggagatgacttaggagaggggtaggtgtctcagtgtaaaccagacttttatttgagaactgccttacctagtgctttttgcatgccaggtacttttccaagagccttacaaatagtaactcaattaattttcttaattctaagaagtaggtgctttctgtttttgacttcaacttacaggtgagaaaactgagttaggggaggttaagtaatttctcacgcttgtgcaacaggtaagtgctacagtcttgatttgaaccttgccaatgtgtcttcagagtctctgctcttaacctctgcgctgctctcccaggtcttaccaagagttccatttgcgaaggtgtatgtgtgagagttcacatgccatcgggtatggatgtgtatatttcctgatcatcccagtccagtagttcttatcttagaacacctttgtcactctgtatatgcttcatttcagtgtttattaagtgtatttctcatctctccaaccagatcgcaaatccctgcaggacaggaattgtcatataccttttatttaattgctttattgagatataattcaagtactatacaatttacccatttaaagcatatgatttattggttttcaatatatgcacagagttgtgtaactgtcaccactgtcatatacctttaatccagtttccattaggatttggactataatatatatatatatatttgggacagggtctcactctctcacccaggtggaagtgcagtggtgtgattattgctcactctagcctagacctcgtggatacaagagatcctcccaccgcagcctcctgaatagctaggacctcaggcacacaccaccacacccagctaattaaaattttttttttttttgtagagacgggggtcttgctatgtcgcccaggctttgggctgtatatttaacctccatgtcttccacattgttcacccatcataaaaccctcttcagaggtttgtcattgaggataaaatatattgaggttattaaagatattcttcaaatggcagggttttttctcccctatgtaaaaactctactaagtatttggtgatatcataataaaacaaatcagtttttgtgctaggaatggaggaaagaaggtttgagttgtttttatgctaccatgatgatgattattaaaacaaatatctatggctccactgtttgggttttaggggttcttatcttgttggagctggatggccttggaatttatgttaacacaatgatctttactctttccttcctcagtcctgtccccttttaccaggagagtcctagaaatggagtcccagaaacatttgttattggtccaaattcccatgaatgcctttgcttttggcactgctctaggccagtgattccctacatactgaagtcttctggactggtataaaaaactgctgatgcctgggtctccctccagagatcatgattgaattggacttgggtgtggcctgagcctcaggatttttgaaagcttgacaaccactgttattttggtgcacattgcttcaagagacctgctggctccttcttggagtaagaatggaatgcagtgagattaagttaaagtccctggtgtgtcagttcaaaggaggggtatgtaggggtttctccaaatttctcttctttcttgacagctttgtcttagtcctgcctggtgtctccagggtgcttaggcatcaagtttatacagttttgtgataatcctggaatagaggttttaatcccaaacttgactgaaagctccatttgtctcctgcagagtctcagtggttttttgtgatcagagaaggtgctggaggagggaagcattacaaagagcaaacctggtctcagagccctctcctgggctaacctcatccagggccatgtggtgccagtgttccctggcttaggtcatatggcttcacagcaaatagagggttggaaaggtgtggggagagttgaaaggtgatatgtagcgtaaaaaagtcagggagcaggtcttttttggatattgagttcttttagaagattgtccgaggagctctgactcctctgtgctttggtctcttagacctttagtcccatgaccagtctctgcttttgatgaattcttagagggaaccattcctccctttgttctccactatgtgtgaggattatctattatggcattcctgctgagcgcttcctcctctctggttggcatttgctgcctcataaacacctacagatttcctcataagactctgtgggtttgccttagggtggaccttgcaacagaggaatgtgtgacgctgagacatgtgttggttctgcttggaggtaaggagggggatatgcctttgtgtagtgatacaattcctttagcaaagtatttaacagctactgagcaaactctattttcatggcctgtttaaccagacagaccctctaattgggtgaaatgaactaaattaaatgtccttctcctaaaagtcaccagtaacctcagttctaaacctgttggcttgtcctcatttctggcctcacatgaccctgtgtcctaccctttctttctcgccatctgctttcatgatgtcccctctcattattggcctctagcatctcatattacccctttattctcctttgcaggcttcttcttcttcttccttcttcttcgtccttcatcctttctcctccttccttcctccttcttcctcctccttctccttccttcttctttcttctttcgtcttctttcttcccagcaaagatatatttttattttagtgtttagcagcatgacatatgcatatagaatgatagtacactttaccctaatcttcaaaacagaatgtactagtttaccaatgaggaattttggccaaaaatgtagtgtttttcccttccctgtacaggtcaggtatatgtaggtccagcactaatgctgcaccttttgagaagcattactttagcaaaaatctagaaatctttcactttttctgaatctaacaaagggtcttactttctttttttttaaatgtacattttaaaaaataatttcaacttttattttagattccggaggtacatgtacagatttgttacctggatatattgcatgatgctgaggcttggggtacagttgaccccatcacccaggtactgagcatagtacccaataattagtttttcaacccttgttcccctccctcctccctctagtagtccccagtgtctattgttgccatctttatgtccatgagtacccattgtttagctcccacttataagtgagaacatgtgatatttggttttctgttcctgcattaattcacttaggatcatagcctccagctgcatccatgttgttgcaaaggacatgattttgttctttttatatctgcaaggtattccacggtggatatataccacattttctttatgcaattcaccattgatgggcacctaggttggtttcctgtctttgctactgtgaatagtgctgtgccttgtgggcttctcttcattctgcctggacacctggaaggttagtgtcccccaaggctgtgcctgagattgtctcctccctccagttcctgccgcactacctgcccccttaatgggtattggctccttaacactcctcagcctgggtggctgtctcaagctctagccctgcacttttagctgtttagtttgagctggaagactcaacttgtctgtctcaaagatatttcaaactctgctgacctagaactcaccagttcttataactgaatccatctttttggtcattcctgacttcatcctgcagcttcactttcctgataaagtttctagttagttcaattaagtacctgttatgggcagataggagagacaccatcagcctgaattggatgtggcaaaagaggtggatcagtgaaacccttctacggccatggagcatgtatgtcctatcttctctgttcaaattcagggcctctttattttgtagctgtaccattgctgtagctcccactgatccccttgcttttgatctcatccctacaccttcctctccattctgtccagactgccaaaggacttttctaagattggctcttgttgccatgataatagcactaccgtgttcatgggtacagtacttagcagctttaaaaagtgcattcaagggcataagtgacgacgactgtttgtcagtgcctacactgtgctgggattccaaaaacaggtaagctactagatttgttttcaagaagctcaaagtcttcagggattaatataaccagataatataaagacccaagcttcattatttgatctttataatcatctacaaggtagcagggaacgtgttgataacctcatttgtcagataaagaaacctaaggctcaaaaaggttatgcaaataataataataatattagcatatgtttatataacacttgtaaaagccggacactgttccaagcactttatatctactaatgcaatcttcataacaatcctatgacatgtaagtgctctcaccttcataatatacatcgagaaactcatttgtacagagtagttaagttctttgaggtacagagagattacataacttgcccaagatcacatggcttgtaaataggagagctatgatttcaacacaggcagcctggctccagagcccaagcacataaccagtgtgctgcattgccctctttaatttatcttgctatgcagtgtggcttctgttgcctgcagaataaaatttaaactctttagccagctaaaatctccttggtcttggctgcattttcaatacttttaatttagtactttcccagtattaccccagactcattcgattttcatattcttcacagcagtttgtgaacgggacataacaacctctgttcatatttcttgccataaagctatggcaacagggtagcaggataaaagagagcctgtttatttgtttgtttaacatagaggtcagtcagagacagaaatgtttctttttttttagcctttgtcagaaagaaatacttcttttcatttctctgtattggtgggcagatatatatatatttgtctgagttcttctcttcagttttcagaaggggttgtggttctattttcccatttcttgaagtccctgtaggaatgctaaaacccatgtcctaagattacagtttttatagttggtttgttctaatcaatattcagatatagtccacacatggctggttgatacgtcttttaaatcttgttaatctataggttttcctgccccctttttggttgtttccttgcagtttatttgatgagggaattgggtcgtctttcctgtaatttcccacaatttggactttgctgattacgtctttgtggtgttgcttggcctcagtatttcctgcaagtgacagtttaatctaaaagcttgatcaagttagagtcttttttggttttggctagaatacttcctagatggtgcttagagcttcccatcacattgctgggtacttggtactgggtactcacatgaggaagcacctaattcttggttgtttcttgtgatgttacgttttggtcagtggtttcagatgttgttatcttaagtccaccagctttttgcataatggttttaattagctaactttaaatattaacatttgcccttcctggtacattgagttaaaagtgattttcattatttaaatacacactcttgtgtgtatgtatgcatattatgtatgtatgtatgtctatatatgagtatatatcattgttataaaaaataatggcaattaaaattcaattggatattaatgggtttagagtttatgtttgggatgatgaaatgggtaatggtgatgtagaacattgtgaatgtacttaatgccactgaattgtatacttaaaaatggttacaatggtaaactttatggtatgtatattttaccacaatgaagacaaatcaattggaaagggattgtaacacatggaattaaaaaaatccaacacaacataatgagtgataattattgctccctaaaaggagccaaagtgagttggagaatagactgataaagtttctttactgaagaatgctagctaataaaggtagaagctatgctagaattagaaaaaggaaaaaaaattgactttgccacctgcaagtaataattgattcaggcatggatcatcattggatgctgaagcctttcagtaaaagactgttggaattcccattgtctgaatgcatctcctagtaaattacttgctgtttacagaggggaaaaagtacctttacaatggagaaatctgcttcaaccaagtgatcatcagcaaatgggataaactagcattatgttaccgactgatattatgcattgggaagtatacaacatgaacctaaaaatgttcttgccaaaaatatttaatctggatctaatcgtgaggaaacaatcagacaaatccagaaagtaggacatgctgcaagacctctggcttgacttcaaaaatgtcagtgttatgaatgaagaaggctggaataaaggaaactcccaaagagacctgatgaccaaatacaatgcttgagcctgggttaaaaacaaataaagaaaagaatcgaaacagctggaatatggggaccatattaaaagatattgtattagtttgctagggctgccataacaaagtactagagactggatggcttaaacagcagaaatttattttttcacagttctggaagttaaaagtctgagatggagaccccagcaagtttggtttctcctgaggccttctctccttggcttgtagatgggtgtcttcatgtggttccttctctgtctgtatcctaatttcctcttcgtataaggacaccagtcttattggattagggtccccttcatcatctcattttaacttaataaccttttcaaagaccctatcttcatatatggccagtcatcttccgaggggctgggattggaacttcaacatatgaattaggtgtgggggacacagttcagcccataacagttattgaatcatttaaaaatggcttgggtgagataatgatgtcaaggttctgaagggaagtgatctttgctgctgatttattttgtttcctcctagattttgaactcttgaggacaaggaccttctctggacacagatatgcctcagagtaactgttgcatagcattcagacactgctggttgaattgtccatttacttggcatgccaacacatggcaaagtaaagggggaaggagattttctgctgcatgtatgtggtttgttgtaaacctttttctaataatccatttgctcaatcctctccatcccccaacaaagtaatatgatgagaatttggaaatacttgaggagttgtgcatgggtaatcgccaggtgagcacatcatggagaatcagaaattcagaacagaccttggcaggggttgtgctgtcccaaggtagatgaatctctatgactacagaaaggctgcttcaaaaggaggcacctagagaaactctcccttgtgattaaaaaagcccaggtacattagagggcaaaattcccagcaggtccaaacaatgtgttccattgctgctgtttcagccctgctagtctcagtagtaccctgggtcatcagatggcttgaaggacaagagggtgatatcctgtctcttctttgactttgttgtgctcactggcaaggagtttcattcacttctgagaattcacacactcattttattgcaggctgatgttgattctgagtttgaggatgccaacatcttttcattgcctcccagctcagttccagaagtgaaagctcagtcctagattctttttttatggtggttcatgaagatttcagttaatccatttgtggtgtccaacagcaacttgagaagagcctggtcttgacctttgcccaattttctattggtttatttgccttttcacattgatttgttctaagagcgcttgtaaatgaagaacattgcccctttgtcctatctattgcaaattttgttgttgtttttcttctcagttgttgtttaactgatttatattcactttttaaattgttatgtcaaatatttatcatttttttctttatggcttctggattatatggcttctgagtttgtcatgtttgaaatcagcttccctacttaacattacataagaaaccacctgtgcgtttttctagtactttttgaaattctctctctctccttttaaagattaactctgatccagctgtagttcttttggtataagatgaaaggtagggagccagtttaatttttgttgctcaaccccaggagttcgtgacccttcactagtgccacatcatcagctagagagacctgctgctaattcagcctgaatctgctggttcagccttcagaggaaatctgattagttcagaaagccaagatcacctccccacaggggtcaggtatctgctgctgcctcaatcagctaggctgctctgaatatgaagagtaactgggaagcaaggcgctgctagattgtctcaagttgtgctgttttcattcaattgttattctctattctcttacttttagcagatgagaaaacaagaggtcatgctgctggttaacagtggagtcagattttttttttttttttttttggagatggagtttcgctcttgttgcccaggctagagtgcagtggcacgatcttggctcactgcaacctcttgaaccctggttcaagtgattctcctacctcagcctcccgaatagccgggattacaggcatgtgccaccgtgcccggctaaatttttgtatttttagtagagactgagtttctccgtggtggtcaggctggtcttgaactcctgacctcaggtgatccacccacctcagcctcccaaagtgctgggattacaggcgtgagccactgcgcccggccgcagtggagtcagatttaaatgttccattgcaaagctcatgaaataggaaacattctatgaggggaatctggttggagaatcctggaggaagaggcatttgacttagtccttgaaagaacagcatcattttttaaacttctcattatggaaatttcccaaaaagtgcaaaactggaatagtataattaaccctcatctccctatctagccagtagtaatcatcaatttatgtcctcaatattgtttcatttatgccatgccctctttcctccttccatccctacttttttttttttaattaaatttttgtttttggagacaggatgttgctctgtcacccaggctggcgtgcagtggcgcgattatggctcactgcggtctcaaccaacagtcctcccacctcagcctcctgagtagttgggactacaggcacatgccaccatgcctggctaattcatccccatatgtttttcaaagcaaactcagccatcctatctgtaaatattttatgtatctctaaacaagatttcttcaaagcacaatcacaatatcattattatactttaaaaaattataataattcttcaatatcttcaaataggtgttctgtacacattgtacacatttcccgtattgtcttaaaattttttaaatagttgttgaattgtgatgtatataaggttcatgcattacaactgatgtgtcttaattttctttatttttttttttaaattacaaagctacctttatacttttaagccccacaggaataaaaaacactgggaagggctaaccccctcaccccaggagtggcccatagggagagaggctacctgaggggaaggaagtacaaaagggacccaccgcagactcatggcaaagggaagccatcggtgctgggacctgtggtcactacaggaggaaatgcgagtgtggtgggactggctccaggcacacaagtgaagggcaagagagattggagtgaagccacaaagctacttgggttcctccttcttctcgtttgcctttttctgcttctgctgcatgatctcctgagtccctgggggtagagatgatagggcactaggaggtatcagagggcaaaaagaacaaaatgcagagggatgaagggcacaaaagagaagatggaagtggatgggactaagctcaccgtttggctgctgtactcccatcctaggagaagaagaggaagagagctgaggctcaaaaggcaatcagtctccatcctgcagttgcccaagaggtcagaagtctggccacataggcccaaggctctctaccgtttggctgctgtactcccatcgtaggagaacaagaggaagagagctgaggctcaaaaggcaagcagtctccatcctgcagttgcccaagaggtcagaagtctggccacacaggcccaaggctctctattcttacaccagtaagaaggttgggagaagggaggagaaccgggaacagcaaggagggccagaagcactgggctgtcataaccacaggtgtatctgaaatgggaagctccctgcccttgccctgaaggtcagactgggggatgctcagaaatcagactcttgtgtcctaattttcttttgatctctggattctcttgcctgctcaatactgtgctttcttttcctctgaaggacagtgtcacataatggctgaaatcatagatttgcaatcaaattagggctctgccacttgctaactgtgtgacttggggaagttactcaacctctctgtgcctcagtttcctcatctgtaaaatggacataacggtgtctactcctcagggctgttgagagtgtcagtaagctaatgtttgcaaagcattagagtcatgtcaaaagctgtgggctgtggaatagggcccaggagggctcactcaagtgagatggtgtgtcgtctttgagatgagcctccagctgtgcagagagcccctttccttttcctttttgcttccttctggttcttgacgtgcttcagttagatgaggttgatagcaggaatttggacaggtaaggcatatttaatggaagcaacttctttattgtcctttcatttttggcttcctcttcctctgtatttattaaattagcttttctctctcagaagtgtttaactttttatggcattatctgggcttcagcaacttgtgatctcctaagtagagcttttcagcactttataaatacgtcatatactttttatattcctttgttccccatcaggaacatagccccagtcttcagaatagcacaatcagtttttattcatttaaggagcagtagtaatttgacacttgctaatatgtaacaaattatattgggcgtggtaattacaattgcagctggttcctaattatactgtaaccttgatgcttacaaaaattgagactgaattcagcataaaatactggagaataatattctgcactaggcatttctgccttctactgagccatgggcatttatgaatcataatgccaaattaaaaagaatttattttaaattggttacaattacaatgttgtccagtgtctccattcttaaaggtagctttaaagtccccctttttgcttgctaaactctgggaatatccttcaggtattataattagtgtctaaataacctgagctcaggggtcatttctggctgtgtgatctactggtattcatttaagactctttagtacctcagcttctttatttgaaaagtggggatattactcactcttccccttaaagagttttaatgatacagtatataaatgaaataagataaaaagccattagcataatgcctggcatagagttaaggacccagtaaaagttagctggtcattgttatcgttataattaataataagtgatccggctccaaagactgcctctgtgaccctcaactttagcagaattagtgtattaattctcctgccactctgccttatgatagcatgtatcatcatacattttgtaccaaccacttgtcgataagtcagctttccctgcttggggcagggtttctgatttattgggtgttttctcctcggtgcctggcgctgggcctagtacactgcagctttcccataggtgattgtgttgcatggatgagcaagtagagcatcaccatctaaggagtggttgttagctggggggtggggtagtttggcccccaagaggatttcttttagcaacctctggagacagtttcttggttgttgcagcttgttggggaaggggttgctactcccatctagcaggtagaggtcagcttaataacaataatagtaaaatccagaactagtatgtttcaggctcttttggcataacagaacccagctaaaacaccaccattcattcttaactgttatactctgcctcttaatatcagaattttaatgatgatggctttctagtttatgttctacaacagagcagagtgaaatctaacatacatcacaacctactgaatccttctgataaacatctctagtgcctctgaaatgactcgctgatgtaattacccagtgggttaacatttgtggtgtctgatactttataagtcaactgttgagtgaaatgaagttttgccagctgattacatagaaatgttgtggtttgaagaatgcttaacagggcatcttgtctttgtactaatttatatttcagtaacttttcccataatgactgctcttcatttattaggtcgtagggaaactgtaggatgaaggatgagtgactcagtggtttcaataaaaaattattttcttaagtttgagatacctttttcttcttctcaagttaatggtaactgtggttttagggaattccaaactttcttttgcaattactgattgtatcagtcagggctcactcgcagagaacagaatctactctagctggtttaagcagagagagatttattacaggatattaaatggcttacacaatttgttgggaaggtaaagaaacagacttgaggttgagctctaaagaatgacgtctagagtctcaagcagagcaggccaccaagacagcagtgacctcctgtgcagtcacaatgctgcctgccaagtggagagtgtttcaggaccatgtggccactgacatgggagggcaggaggttgccacaggaaaactagacacttccagcaatggtgcgtgcttggcagaaacagcagaaggtgccccccaactcccaaacatttgccaaatctcactcaatttcatctaattgatggcacataggccgcatagcagcaagggagtctgggaattgtagtttcagccttctagtgtctttagtataggaagataaagaaggagggtgggcccctgcttctaagtggttaggttacacccaagaatacttttctttgggattcagggccatctactgcactatttcctcaggttcaaaagactatgcaggactgtttctccttctctctccgtttcctgcttgtcactgcatgcttatttacacccacccacccacacacacacccagaagcttgcttttgatgagctacctctttgagtttgtagttcttatctaaggcaaatatttactttatgatagtagaattttcagtgtaagtctgtgcttgtcttggctttcagatgtttcaggtttgggagggtgactggggaagtattgctgaggaagggctgtgctgtacagttggtgacgtagcagctgaggttgggcctcgggtcctaacgcagttgttctcagtccacccacacatggtaatttcttgagggagctctaaagatatccattctagaaattttcatttgattgacctttggtatggtttgggttttgtaaaacctaaaagcacctcaggggacttgaatatgcagcgaggactgagaacctacatcttataatccgtacattaaaattggacattatctaaagctgtggttcttaaactttaactgcatcagggtcacctggagggcttgttaaatcataggggattgctgggcctcacccagtttctgattctttgggtctgggatgggtgtgataatttgtatttttaaaagttcccaggtgatgctgatggtctccacactttgagaaccattggtctgaagagagttgcctattttcattgtaaatgtcagatttttactgacctgaaagactttattctatattcagcacttccagagaatctactttgtttcctgatctttgccagagttggggttgatctgaggagtaaggtgccctcacagagatggtggtctcacatctctacagcctcccagtgaaagaggagagctttgcttttctttgcattttatttttcaaattagcatttcttattttcgtgtaggttttcttatattcttccccaccatcctctcttagatctgacaactattttgaatacaccattctataccactgtgatttgttaaagtaatgagcctgcaactgtggcttgattcccttgtaagaaagtctgtttaaaaaatattcctacaggtaggaattttctggtgaccccctacctatggctgctctaactcatattaggagagtgaattcatttgtcctgaaagatgacttttgtattcttcttgccatgttctcccctaccccctgcctttttaaaaacaccagttcttgaaattgtgttattgtttttctttttatttctaggatgtacctacctagtatgtgttttgcaaacgctattgatgacttacacaattataaccagtgtttatcttgtcaaaaagttttacatattcagtgattctcaaattttgctcctgtggagcatagactcattgaatcgacctgaaatttccatactaaatttaaataatgatagacttttcccagtttatggaagaaactatgcatagagtttttctgttccaacattgccactttctgggccaggcatggtggctcatgcttgtaaacccagcactttgggaggccaagatggaaggatcacttgaggccaggagtttgagactagcttgagcaacatagtgagactgtctctacaaaaaaattaaaaaattagtggggcctggtgacacatgcatttagcctcagctactcaggaggctgaggtgggaggattgcttgagcccaggagtgtgaggctgcagtaagccatgatcgcaccactgcactccagcctgagtgacacaatgagacccccaactaaaaaaaaaaaaaacaaaacaccaaaaccctctctttttcccttaaatttggaatcagagtaaaatgttatcaaatttcaacaaaattctttatcttgttagcaaataatatttcatagtaatctgtaaaggacccctttcttcttagtgaattactctgtatgtttgaaaaccagttacttgatttaaaattcttgatataaaatttttgttttaatgttggaatccattcttacaaatgcaaattcagaagaagaatcataaagaaaatcaggcagttataacaatagtagctgtaaatatttgcatgctattaatatatgagaaaaaaatgtaacagtgaaagtaagccttctggaaacaatctaaagtttgatgactcttctaaaccccaagaatgaacgaagtctaataattccaggcttctaaagcccaagaatgaactaagtctaataatcccaagcttatgtgatgcaaagtatgcatgctggacagctgttctgaattgactttaaaagggtggctacatttctgtggcttcctttttccagctcatagaacttcctgggtattggttttgccaccaggtagaattcattgaaatacacctttaaaaaactggtacatctcatggtaactttgcattgtcttcaattaagttgtgtaagtgttcttcattcatagcaaatgacacttaaaacaagaagataggaatgggaggtagcagtataaatggaaattccgaacagccacacagcatttgactggtgaataatagatggaattactatagagatgaggcccaggaggctggtagtaatttttctgaatccatcccctgttgaaccatacttatctatccttaaatagaatgtaccaggacctgagccaaattttagtgggcctcagagaaatcttgtggtgatcattaaccatttgctgtacctggaactctgggttgggggtagggtagctgagacaattatcagttaggatggccacaatgtttatttagtggtttggtgagtgtgtttgaagacccatgagtttctcttctcttttgctaatttatcccttctaaattatgagccagtttacccatcatttagatttcttaaggagtaaacatggtagaacataaacatctttggataaataatacaaatagtaatagataccatttattgagcactttaactgtgtggcccttttggtgctaagcactttgtgtaattatctcatattacttttctagctgtctaggactccccattttataaatgaggaaagtgaggctgagaggtcagggcctccaagtcacatggccagtgagtttatgaggttggtcctgctccctatttgaggatgatctgacactaaggccatgttctttttttttaatgaagatggggtgtcactatgttgcccaggctaatctcaaactccagggctcaagtgatcctcccaccttggcctcccaaagtgctgggattataggtatgagccaccattcctgtaagatcatgtccttaatcacagcattggacagacactacacactgttaggagaaattgggagagttttgatttttaggcttgtactatattgcagttatgtaccacataaggatgttttcatcaatgaaggactgcatatatgatggtggctccataaattatagtggagctgccctgtacaggtgttccactttttatcttttaaaaccatatttttaccacaccttttctatgtttagatacttgttttacagttgcctacagtaatcagtataggaacatgctgtatagatttgtagcctaggagcaataggctatctcatttgcctaggtatgtagtaggctacaccatctaggtttgtataagtacactatatgatgttcacacaatgatgaaatcacttaacaatgcatttttcagaatgttatcctgttgttaagtgatgcatgactgtattatattgccagctaatgcaagttatcaacactttgaagctgcctgtaatgtgggtctgtaggaaggccactacggtaagagatggaatatttgggatctgatctcagctcagaaaacatttagaaatgtcagcacagattggcacttaatctgactttttgggggaaataattgatgctttctgagctttggtttcctcttctgtaaaattagggcagtaatatccatcttatctgactgatttgcagtgagaatccaacgagataatagtcttgcttagaaaactgtaaatgttaggcaacatgccttataagtgttgggtcattctctgtctttgttttgatttgtgttctctgccctagaccctgagaaggttacaaagtgaacactttttttccccctttgaggtgtagttctgatggggagcactgaatatacatttcaggatccttaagcagaaatgtgctatgaaaattgagggcaggggaggttcactctgaaatagcattgcccaggcaagaccttacaaagttcatggcataaagaattaattctattttagaattacgaagaatacttcattttgtggaaaatttattttgcttttaagaggaaaacagttaagaacttagggtaccatatgcttttgaaaaaagtgttatgtacttccatgagatgtgggactcttaccatcaaggaggagatttttctgctcttaaagtggaggatgggggcattttatgctgtcccatcttctcttgtgttcgtcctaccctacctttctcagaatagagacctgagaggagggagtcctctctgaagcttttagggcagcagagtcattcatcttaggttaactagcagtacattttcttctcctctattgaacagcagagaacacttactaattcaggatttttaaaaagattaaaaattcatggctgggcacagtggctcatgcctgtaatcccagcgttttgggagtctgaggcgggcagatcacctaaggtcacgagttggagaccagcctggccaacatggtaaaaccccatctgtactaaaaataaaaaattagccgggcatggtggtgcatgcctataatcccaactacttgggaggctgaggcaggagaatcgtttgaacctgggaggctgaggttgcagtgagctaagactgcatcattgcactccagcctgggcaacaagagtgaaactccatctcaaagaaaaaaaaaaaagtattacaaattcttatgaatagccttggtggttacaagcactcagctgaaatgaagagttatcagtcttgctttgggaaacaaggtgaccaaccatctggtttcagaaagactactcccattctagtgattagttaataaaattattcctgacagtggagagcctaggagctcaggcagttccatatttagagacagagaactcattgtccaaagatctcagaacagccttcactagctcacagaagggatttaggacaatttgcataagtttccctgtggatagcaacatgggtccagtgttgggtggttccaggaacctctccttggcttcatcatggggtggctctgtgcttggtgggaacccagtctcatgatgttttttgctaggaggattgggtgttgggacattgaataaacccactgtttggttccacataagggctcttttgtgttggcctgaggaagccatgttgaagtttgtcttgcttttccccagcaatgtttttggactttgtggcctgcagaattaagcacaacacccattctgagctaatctgtcaatttttgctcttcaaagataaccacagccacttgtatttctaaaatatgtagaataatatcatacctttggagacctatgatttattaattaaaaactgaggagaggaggagaggttctttggcatgcccaggtagtgaggtatacatgcctgttcatggtgaaactgtgagaagtaactcccttgagttaatatgatttccctagttcactgacttctttaagaaatatgttctcttggctgggcacgatggctcacgcctgtaatcttagcactttgggaggctgaggcgggcagatcacttgaggtcaggagtttgagaccagcctggccaacatggtgaaaccctatctctactaaaaatacataaattagctgggagtggtagtacgcgcctgcaatcccagctactcaggaggctgaggcaggagaatcgcttgaacctgggaggcagaggttgcagtgagccgagattgcaccactacactccagcctgggcaacagagagagactgtctcagaaaaaaaaaaaagaaatatgttctcttgcatagttgacaaacatttgtttacttaaattctcctgtgaaagggcatggtttacactggattataagtaaaaaatgacaggtgtttgcaatgtttcaccttttctttttaagaaatgatatacattcaacattagatattaagagattttgctactggttccttgcataaaattttatcattttagaagctgcataaggagtctaatttaaaatgggaagggggcatagtttatgcactggggcaacatggtatttaagtacaaaaatgaaatgcactaatttttaatctgagatttattttcctttagtcggctagcttgatttctcagctttgttgtaataacataaacatttttatgtttatttataggtggctttaaccaagagagcagatccagctgagcttagaacaatatttttgaaggtcagtataaaggaatctattttgtttcttgtttgatttgtgttctataacttttaaatattattttcaaacagctctttatttcgttgttatattttgaaaaagtcccaaagtgtcagcccggcacggtggctcatgcctgtaatcccagcactttgggaggctgaggtgggtggatcccctgaggtcaggagtttgagaccagcctggccaacatggtgaaaccccatctttactgaaagtaccaaaactagccaggtgtggtggcacgtgcctgtaatcctggctattcaggaggctgaggtgggagaatcgcttgaacctgggaggcggaggttgcagtgagctgagatcgtgccactgcactccagcctgggcgacagagcaagactgtctcaagaaaaaaaaaaaaaaagaaaatcccaacatgtcttaagaggggagagccttacaaatacgtctgctttttaaaatgtaggtgactgtgatgacaacatggcttatattttaatttcttttatctcatgtggtgtaaggtatgtgaataaaagcggttgctggagtattcagttttgcaacccatttacctttccaggattgacccgtatagctttttctcctaggaagtttaaagctcattgtaaacatctcagtaatccttcactcatccatgggactatactgtctctccctggtagaagcctattgttgtggtcatcatcattatcatcactttatgatgactgcggtatcctgagaggaggctccagtatggataatactagatactagagcacaacagacaccatggaagtttgtgtcttatactggcatcttatatttccacctattttgtgatagtgggcagtgaatgattaatagaataaaagtctgtctcaggttccagacaccgaaacacctttatgttattcagctgaaattaaagtactcagaaaagaaaaggccacttttgtaagataatatacacacatataatatatatgtatatatacacacacatatatgatatattattaataacatatattaatatacacatattttatatatatatgtttttctaaacattatgaaaaggcagctgagttgtatggaaagaggaccagggtgtcaaatgagaaatttgatgtgtactgaatatggtgtagaaaggtattaaatctatgaacctctctttcctcatcacaatgtgttactattaaaactaattgagacatcaaggactttgaacatggacaggatatttgatattaaggagttggtattaatcgatgtttaggctgataatattctcattatgggaaatatagagtctatgttttagagatatacactgaaacatttttacagatgagactaccgtttctgagatttgcttttaaataatccagttttgttgagttgaggaaaatgagtaggcagtatgatgataacttttgaaattgggaaatggaatattgggtttattacactgttctctctactttgtatatgtttgaaaaattttcttttcttttcttgttttctgagacagagtttcactcttgttgcccaggctggagtgcaatggcgctttctcagctcactgcaacctccacctcccgggttcaggtgattttcaggctcctgggtagctgggattacaggcatgtgccaccacacccggctaattttgtgtttttagtagagacggggtttcaccatgttgatcaggctggttttgaactcctgacctcaggtgatctgcacgccttggcctcccaaagtgctgggattacaggtgtgagccaccacacctggtctgaacatgttcataataaaacatttttttaaattgtaacgattcagtgaggtaacttatatgaaaggtgtcctgcatctgatatgtgttatgtattgattcagtaaatgcttgaaattaagtaatgatttaagtaaaggagaaataaagactccaaaagcaaatgaattaaaagcagggatagttttgtggggaggaaaaaaaaggacacatttgtaaggagatttagattatacataaaaaatcaggattctggacacctgtaatcccagtgagaggctgaggcaggaggatggcttgagcctaggaatttgaggcttcagtgagctatgaatgtgccaccacattccagcctggatgacagagtgagaccctgtctcttaaaaacaaagcaatgttctttataaatttgtttttagcccagaaatacagtgtagagtttcttttttttctttttttttttttctgagacagagtctcactgtgtctcccaggctggagtgcaggttgcgcatgtcagctcactgcaacctctgtctcccgggttcatgtgattctcatgcctcagcctcccgagtagctgggattataggcatgtaccaccacgcctagttaatttttgtattgttgttattattatttttttattatactttaagttctagggtacatgggcacaacgtgcaggtttgttacatatgtatacatgagccatgttgatgtgctgcacccattaacttgtcatttacattaagtatatctcctaatgctatccctccctcctccccccaccccacaacaggccccagtgtgtgatgttccccttcctgtgtccaagtgttctcattgttcaattcccacctatgagtgagaacatgtggtgtttgtttttttgttcttgcgatagtttgctgagaatgatggtttccagcttcatccatgtccctgcaaaggatatgaactcatcattttttatggctgcatagtattccatggtgtatatgtgccacattttcttaatccagtctatcattgatggacatttgggttggttccaagtctttgctattgtgaatagtgccgcaataaacatacgtgtgcatgtgcctttacagcagcgtgatttataatcctttgggtatatacccagtaatgggattgctgggtcaaatggtatttctagttctagatccttgaggaattgccacactgtcttccacaatggttgaactagtttacagtcccaccaacagtgtaaaagtgttcctatttctccacatcctctccagctcctgttgtttcctgactttttaatgatcgtcattctaactggtgtgagatggtatctcactgtggttttgatttgcatttctctgatggccagtgatgatgagcattttctcatgtgtcttttggctgcataaatgtcttcttttgagaagtgtctgttcacatccttcacccactttttgatggggttgtttgtttttttcttgtgagtttggctgagttctttgtagattctggatattagccctttgtcagatgagtagattgaaaaaattttctcccattctgtaggttgcctgttcactctgatggttgtttcttttgctgtgcagaggctctttagtttgattagatcccatttgtcaattttggcttttgttgccattgcttttggtgttttagacatgaggtccttgcccatgcctgtgtcctgaatggtattgcctaggttttcttctagggtttttatggttttaggtctaacatgtaagtctttaatccatcttgaattaatttttgtataaggtgtaaggaagggatccagtttcaactttctacatatggctagccagttttcccagtaccatttgttaaatagggaatccttccccatttcttgtttttgtcaggtttgtgaaagatcagatggttgtagatgtgtggtattatttctgaggcctctgttctgttccattggtctatgtctctgttttggtaccagtaccgtgctgttttggttactgtagctttgtagtatagtttgaagtcaggtaacgtgacgcctctggctttgttcttttggcttaggattgacttggcaatgcaggctcttttttggttccatatgaactttaaagtagttttttccaattctgtgaagaaagtcattggtagcttgatggggatggaattgaatctgtaaattaccttgggaagtatggccattttcatgatattgattcttcctatccatgagcatggaatgttcttccatttgtttgtatcctcttttatttcattgagcagtgatttgcagttctccttgaagaggtccttcacatcccttgtaagttagattcctaggtattttattttctttgaagcaattgtgaatgggagttcactcatgatttggctctctgtttgtctgttattggtgtataagaatgcttgtgatttttgcacattgattttgtatcctgagactttgctgaagttgcttatcagctgaaggagattttgggctgagacgatggggttttctaaatatacaatcatgtcatctgcaaacaggacaatttgacttcctcttttcctaattgaataccctttatttctttctcctgcctgattgccctggccaggacttccaacactatgttaaataggagtggtgagagacggcatccttgtcttgtgccagttttcaaagggaatgcttccagtttttgcccatttagtatgatattggctgtgggtttgtcatagatagctcttattattttgagatacgtcccatctttacctaatttattgagagtttttagaatgaagtgctgttgaagtttatcaaaggccttttctgcatctattgagataataatgtggtttttgtctttggttctgtttatatgctggattacttttattgatttgcgtatgttgaaccagccttgcaccccagggatgaagcccactttatcatggtggataagcattttgatgtgctgctgaatttggtttgccagtattttattgaggatttttgcatcgatgttcatcagggatattggtctaaaatgctctttttttgttgtgtctctgccaggctttggtatcaggatgatggctggcctcataaaatgagttagggaggattccctctttttctattgattggaatagtttcagaaagaatggtagcagctcctccttgtacctctggtagaattcggctgtgaatctgtctggtcctggactttttttggttggtaggctattaattattgcctcaatttcagatcctgttattggtctattcagggattcaacttcttcctggtttagtcttgggagggtgtatgtgtcgacgaatttatccatttcttctagattttctagtttatttgcgtagaggtgtttatagtattctctgatggtagtttttatttctgtgggatcggtggagatatcccctttctcattttttattgcgtctatttaattcttctctcttttcttctttattagtcttgctagcagtctatcaattttgttgatctttcaaaaaaccagctcctggattcattaatttttggaagggttttttgtgtctccatctccttcagttctgctctgatcttagttatttcttgccttctgctagcttttcaatgtgtttgctcttgcttctctagttcttttaattgtgatgttagggtgtcaattttagatgtttcctgcttctcttgtgggcatttagtgctatagatttctctctacacactgctttaaatgtgtcccagagattctggtatgttgtgtctttgttctcattggtttcaaagaacgtctttatttccgacttcatttcgttatgtacccagtagtcattcaggagcaggttgttcagtttccatgtagttgagtggttttgagtgagtttcttaatcctgagttctagtttgattgcactgtggtctgagagacagtttgttatagtttctgttcttttacatttgctgaagagggctttacttccaactatgtggtcaattttggaataagtgccatgtggtgctgagaagaatgtatattctgttgatttggggtagagagttctgtagatgtctgttaggtctgcttggtgcagagctgagttcaattcctggatatccttgttaactttctgtctcgttgatctgtctaatgttgacagtggggtgttaaagtctcccattattattgtgtgggagtctaagtctctttgtaggtcactcaggacttgctttatgaatcttggtgctcctgtattgggtgcatatgtatttagaatagttagctcttcttgttgaattgatccctttaccattatgtaatggccttctttgtcttttttgatctttgttggtttaaagtctgttttatcagagactaagattgcaacccctgcctttttttttttttttccatttgcttggtagatcttcctccatccctttattttgagcctatgtgtgtctctgcacgtgagatgggtttgctgaatacagcacactgatgggtcttgactctttatccaatttgccagtctgtgtcttttaattggagcatttagcccatttacatttaaggttaatattgttatgtgtgaatttgatcctgtctttatgatgttagctggttattttgctcgttgcttcatacagtttctccctagcatcgatggtctttacaatttggcatgtttttgcagtggttggtaccagttgttcctttccatgtttagtgcttccttcaggagctcttttagggcaggcctggtgttgacaaaatctctcagcatttgcttgtctgtaaagtattttatttctccttcacttatgaagcttagtttggctggatatgaaattctgggttgaaaattcttttctttaagaatgttgaatattggcccccactctcttctggccagagatctgtcgggagatcagtttctgtcgagagatctgctgttagtctgatgggtttccctttgtgggtaacccgacctttctctctggctgcccttaacatttttttccttcatttcaactttggtgaatctgacagttatgtgtcttggacttgctcttctcgaggagtatctttgtggcgttctttgtatttcctgaatttgaatgttggcctgccttgctaggttggggaagttctcctggatattatcctgcagagtgttttccaacttggtttcattctccccatcactttcaggtacaccagtcagacatagatttggtcttttcacatagtcccgtatttcttggaggctttgttcatttcttttttactcttttttctctaaacttctcttctcgcttcatttcattcatttgatcttccatcactgataccctttcttccagttgatcgaatcggctactgaagcttgtgcatttgtcacatagttcttgtgccatggttttcagctccatcaggtcatttaaggacttctctacgctggttattttagttagcctttcgtccaatctttttttcaaggtttttagcttctttgctttgggttcgaacttcctcctttagctcggagaagtttgatcgtctgaagccttcttctctcaactcgtgaaagtcattgtccgtccagctttgttccgttgccggtgaggagctgcgttcctttggagcaggagaggtgctctgatttttagaattttcagcttttctgctctgttttttcccccatctttgtggttttatctacctttggtctttgatgatggtgacgtacagatggggttttggtgtggatgtcctttctgtttgttagttttccttctaacagtcaggaccctcagctgcaggtctgttggagtttgatggaggtccacaccagaccctgtttgcctgggtatcagcagcggaggctgcagaacagcaaatattgctgaacagcaaatgttgctgcctgatctttcctctggaagcttcatttcagaggggtacccggctgtgtgaggtgtcaatctgcccctactggggggcgcctcccagttaggctacttggggctcagggtctcacttgaggcattctgtctgttctcagatctcaaaccctgtgctgggagaaccactactctcttcaaagctgtcagacagggacatttaagtctgcagaggtttctgctgccttttgttcggctatgctctgcccccagaggtggagtctacagaggactcctggagctgtggtgggctccacccagttcgagcttccaggccgctttgtttactactcaagcctcagcaatggtgggcgcccctcccccagcctcactgccaccttgcagttggatctcagactgctttgctagcaatgagcgaggctccgtgggcgtgggaccctccgagcgaggcgcaggatatattctcctggtgtgccgtttgctaagaccgttggaaaagcgcagtattagggtgggagtgacccgattttccaggtgccgtctgttaccccttcccttggctaggaaagggaattccctgaccccttgcgcttcctgggtgaggcgatgcctcgccctgcttcggctcacacttggtgggctgcacccactgtcctgcccccactgtccaatgagccccagtgagatgaccctggtgcctcagttggaaatgcagaaatcacctgtcttctgcatcgctcacgctgggagctgtagactggagctgttcctattcggccatcttggaaccatccaccaatttttgtatttttagtagagacgggtttccccatgctggccagactggtcttgaacttctgacctcaagtgatctgcctgccttggcctcctaaagtgctgggattacaggcacgagccaccatttctggccacaatacagtatacagtttctaagttggaaaaggattctggaggatgaaagtccagaaaacagaaaagcatttgttccttacctaagctgatctctatggttgtgcatgttgggaccaccatggttggaatgaggtctgtatgagagaaccagagaaggtcttcgtatgtgcatttaaggtgtgttgatattgtaaaactccagtgacagaaatctgaaagatcacttgcagaaaagtaactaagtgggctgccaaagatcctatcaaaatggaaagtagctcattagcttaagctggtaaagaagtcatcgttctttgaaccgaggacctatctgttacttctgttttctaaacaagcaagagtggtgggcatccttctgacaggaagtgggaacaccatagagggtgtctcaatacatggtgcatcttacaatctcactggttggtgtgatccattgataagactccacttaaaggctgtgtccacctttcgaggaggccacatggtccctggagaagctaggctgagaccttagtttggaacgatgtatctttgtcagctgctacatccactttcagcagccagcaggactatactgggggagagtctaattgatcaggtagacctagagagggtgagaattcatgcagagttctggagagacacctgtagtgtttctgtttaagtgcacttgaaggccgagggtggaatctttggtataaatggggaagtactctcttcccttggggtggctgggactatgtgacttttgagtaacagtttgtgtggcttggagtcctaagagatgacgtcagggggaccatacctgaagaaaacagcagtcagcagtttgtggaaaggattgtggatctggcaaaagttctggtgatctcaccaggcctggatagtgtggtaccaacccaaatctgccttggcttagcatgctaaggatgtcaggtttaccatttatcacagatggtattgtggtgaggggaagaacgggaaacacagcaatgtggggaccgtgccaggccgagcttcttagttaattatggatcagcagtaagcattctgtaaacctgtctactttgctgattttctgtgactttttcctgacttgactttcttcctagtaaaaattccatgtgaaatatcccagccttctctctgctaacctgtgtaaagagaggattcttctttagcttgggaggtggaagggagcttcattgcagccttcacaccaggtgtgatggtagcaggaaagttggcagctctgtagatcagcgacagccagtggaactgagccagataaggaaagagggctcctaggggattaaaatgagcccaattctgcccttttcatttgtttgagaatttagaatcagttccactgtttttttgaaggtacctagatacagtgtcatggactgggtgtgtatcaatgcatacatcatggctcctgtccattaatatcagagtgagaactgtgtgtaagtgtaaaaaaccccagaagccatgatatgattgataagtagtgtacaggattaattagcagaagatggtgtggtctaattatatctttctatggagagtcattaagttatggagaggtggtaatgtttgaattacgctcgaagatgagtaggtagagaagggtttgttggcaatggaagacctttttaggcaaagaaaacaacacatacaaagtaaagagctgtcagagtgccacaggtgtggagggaatggctaaacacttgggctggctcggggcacaggatcctgggtggtggtagtcaggacaggacttgttataaaacatgtggggctaaggcatacgacagattttttttttttttttttttgagatggagtcttactctgtcacccaggctggaatgcagtggtatgatcttggctcactgcaagctctgcctccccaggttcatgccatcctcctgcctcagcctcccaagtagctgggactacaggcgcctgccaccatgcccgggtaattttttgcatttttagtagagatggggtttcaccgtgttagccaggatggtctcgatctcctgacctcatgatcctcctgccttggcctcccaaagtgctgggattacaggcatgagccaccgtgcctggccaacgacagatgttttcttatggaggatgttcttgtggcaagtgtcaggtaatgtttcatctagatgtagaagttaaagtctaggaagtcagttttgtttctagtcttaacgacatgcgtttttctgtttgcctagtacttttggtgttgcttcctgttagtttaaacagatgtgtattgagtgcctgccatttaaataaaacaccaggaaactctgtggtgagtgggaggtgcaaaagatgtataacaatgaccacatcttaaaggagctcagattttatataagagaccagatggataggcatgcaggaggtaacaaagaatcttaaagttggcataccccaagggcctgcgttgtggttaaagcaaatgctgtaggaggtggaaggagggagcagcccccattgtggagagtggtcagggaaggcccttaggagagagaacttggggagtctcagggacaagttggagaggcgacaaggaacacgtttgagggaaggcctggagatgagttgaggagaaaacaacctctgcaggttgaaggagtattgctcatcctttaagtgtttatttaaatacaactctggctcaaagtatgctgagtatcacagggtgtgggtgacaggattggaaaggtaattgggggtttggaattccactaaacagtaggaagcattcgaggttttttgacgaggagatgggtgtgagatttgattggtgcagcaaggccacaagttaggcagccttagggttgcggcagcaggaggaatggagaatggcaagatagagtcactttgaaagaatatttgattaagatggctgattttttataatggatgagagagagcagagagaaaatacggtctgagtgcagagaggtgccagtaataagaatagagaaagtgagagggagccagtagctcgagggaggaaaagagatgatgcgtgctattgtattagtaacagagaaagtgagagggagccagtagctccagggaggaaaagagatgatgcctactattagtaatagagaaagtgagagggagccagtagctatggagagcaaaagagatgatgtgtactattgtattagtctgttctgttctcatgctgctaataaaggcatacctgagactgggtaatttatcaggcaaagaggtttaattgactcacagttccacatggctagagaggcctcacaatcatggtggaaggcgaatgagaaacaaattctcgtcttatattgtgacaggcaagagagcttgtgcaggggaactcccatttataaaaccattggatcttctgaaacttatggggagaccgcacccatgattcagttatctccacctggccccgccctggacacatggggattattacaattcaaggtgagatttgggcggggacacagccaaaccatgtcaactgtttagaagtatatagtctcaagtaactaaatctctgtagcgaaagatgggaaaattggggaaaagggctgaatgagaaacagaagacatattacagagtaacatagtgaattacacttggatttttataattgttttgtcagcaaaagcatgatatccacttttaaaatgtctgtaggcaaattttgaaaaacagttaattctgtttttggaaactttttatcacatcaattttatatgcattgaaaatttaaaaggcagatacataaacaaaagtaacttgtgatctttgtgtaggaagatagatatttatatatttatttatctctcagtctatgtgtctctctgtatgtatataattttttttccccttaggagaaaaaaatactgttttctatctagttttttcccttacctgctatgttacaaatactttttcctataattcagtgtgcttctatattttttttatttttgtaaattattttgtttcttccatgatgatttagaggaactacttttaaaccagtacaaatatgtcataaataatatctggccatcttctaaccagttgagtaatttcttgcgcagtaagttacctcacatcttttggtaagcaatacgttaaatttgattagtaaagacattatacagttaattaggacacaattaaaatttgctttaaatatttctttgagggagtggacaccacatttttacaatccagaggtctttttttttttttttttttttttttaaacacctatttgccatgaagtcataggaaatagcttccagcaatgcaagctccttcccgtgagttctcacaaagtgtgcttctctgcgtggagcaggctgacaccaggtacaccttctttttctgatcatttttcttcatgcatttcaggaagctatctcagctcttagagtgcttaatgtgcccagcacacacattgattctcttagcaagagtcttgcccttaacttgttgtttacaacagtgccaacagcatgctgggggcattgtagactcctctacttttgccatggtaacacttgtaaagcattcctttttgaacagtactcattcccttaatgtctacaatatcacctttcttatagatttgcatatatgtggccaaaggaacaactctatgttttctaaaaggcctacagaacatatattgagtgcctctcctctttccctttgtgttcatcccattttggtgaattactggaagatggtggttccagctgaaaggaaccctactacaatatttttaatgctgcataatattcctacatatggctgtttctgttttgccctaacttattgaagcactatttaattattgaatatttagttgtttcctgtgctttactatcatgacagcactgtaatgatagtattgtacctacatttttgcatatagctagcattattttcttaggataaattcctagaagtggcaccattgggttagaatgggtttagaacatattaaggcttgtgattccccttggtagactgcctctcatgaaggttatttcaatatttattttgggtgggaacacggaagtgttcatttcctacattatatcaactcagattattatgagtttttgttgcagcagcaacaaaaaagactttatgccaatctgttggttgaaaaattgtatcttatttaaaattttcatttttaaataaatagagcaatatgtttattggccatttatgtttcttaaatatgtttttaactttattgtgacaattttcagacatacagaaaatagaatagtaaacacccacataaccaccatctgatttaaagtaatacttgtcatgttagtttatacatttttttctgatttatgttaataaatataacttagctatcactataattcaccctaaataatttagcatagagcttcaaataataaaaacaatctcctacacagtcataataccattgtgcacctaataaagttaatgataattccctaatataaaatacccaatccagatgcaaatccttaaattatattttgttccatccctataacagggaatcaaagtaaaggatgggcagatgcagtgacctgttgtgtgcaccttctcagtggttggaaaacaatgtaggggatttgtccttcagtcccaggatatgagtgattcatgacaaaatgggtagctggatgattatggttctaccctggctcattcacagcttacaaacctttatcaatttactgtgactgatggtgagcaggccagataggacccctgccctcggggtatgggcatttgtagtgataggttccttctggtttcctttgctgtcatcttcactgagtatggtggtatttcttggtgatgacaataagtattatacaaggttgcatgaggaatcctaaaactcttcccattttgcaggtgtatgtttaatcataataaaactcctgaaaattgcaagggaggaaggcttcagctcactagtgaaaaatattcccaaagaaggattaatgacattttaaagatgtggtggatataaggatatagtccgttccccctatagggaccctctgctcactgctgcagggagagcagagctgcatttatcactaccctcatacatatttttattatggtctgcctctgtccatcaatcctaaggagcaacctttgacatgtttacttaaatcacagagcagactgcccagccgtggtgatgagcttgttttaaaaactggagaaaactatttctgtgcccagattaacatgctcttatatttaagaaatgatttctttattgcatctaaaaaaatgaagctgataatatctctcaaagacttctaaaatgtaaactgttgaaatataaattgaatgcatacatcacaaatgtacagccatgaatactcagaaagtgagtaggcccatgtaacgagcatcccagaggccctctgatgccccttctgatcagcacccaccaagggtaaccagttgtctgaattctggtcactgtatgttaaaactaactgtatgtaagttttgcctgtttatttcactttgcgtgaatggaattatacgctaggttttcttatgtttcttttcttttacccttaggattcgtctgttgtcatatgtagttggagttagtttattcttttttttttttttttttgagatggagttttgcacttgttgcccaggctggagtgcaatggggcggtctcagctcactgcaacttctgcctcccgggttcaagcgattctcctgcctcagcctcttgagtagctgggattacaggcctgtgccaccatgcctgggtaatttttgtatttttagtacagacggggtttcaccatgttggccaggctggtctcaagcgcctgaccttaggtgatccacctgccttggcttcccaaagtgctgggattacagatgtgagatgccgtgcccagctggagttagttttttctcattgctgtgttgtattccattgtgtgaattcaccacaagccattaatgtatcctactattggttgacatttgtgttatttttagttttttggatactacaaataatgccgctgtgggcattttcacatagtttttgtgtatatgcacacttctgttggtgatatacttctgattgaaattggtgggcttgtggttgtatgttcagctatagcagatactgcccagcatttttctaaaatggtttactcctttattctcataccatcagtgtgtgagagtaacatttgctccacatttttgccatcacttattattctttttcgttatcttgggggtatggcatggtattgcattgtaggctttttgttttatgttttgagacagggtctcactttgttgcccaggctggagtatagtgatgcaaacatggctcactgcagcctcaatcttttgtgctcaagcgattctcctgcctcagtctcccaagtagctgggactacaggtgcacgttaccctacctggttaattttttattttttgtagagatggagttccgccatcttgcccaggctggtcttgaactcctgggctcaagcgatctgcccaccttggcttcccaaagtgctgggatgacaggcatgagtcagtgtgccctgccttgcattgttttattttgcatttcagtggaatttttttagggagcagcaacttgataatgattctaaaggtcatttgtggaaaatcaaggagtgatcatggccaaaaaaatttccaagtgtaaaataattcaatgtcttttttaaacctttcattcttttaaaaaaatatttatttgaacatgtttcactatctaccaggtactagtctgggaatttgaggacacagcagtaaaaatgagagaaaaaaaattctgtcctaacagaactttccctctagttatagcatgtaatcttgcaagagtagacgagacaattgaaaaggatggtcctgaaacatctctgactgcagtgatgacaagagctgtcattcgatcccagcattctcccatggagcgtaggtcagcctcagaatacatgttggccctaggaagcctttgccagttcatcagaactggtactgcagatggagccattttgtcacgcctttccctggtgaccatatgataattaagtatgtgataaacatggcatcctaaagacctggaagagagaatgatttgctttgtgttcgtgggacaaccaagagattaagtggaaaaattaaagttgggggattcttaccttagatcacacacaaagataaagtactaatgtactaaaacttaaaggtaaaagataaacctactttaaaaaaactcagataaactctctgatatttagtcttgaaatgaagaaagactggtgatatggcttggctgtgtccccacccaaatttcaccttaaattgtaataatccccacatttaaagggtggagccaggtggagatcattgagtcatgggggtggtttccctcatactgttctcgtagtagtgaataagtctcatgagatctgatggttttataaatgggagttcccctgcacaagctctcttgcctaccgccatgttaagatgtgactttgctcctcattcgccttccaccatgattgtgaggcctcccagccatgtggaactgtgagtccattaaacctctttttatttataaattacccagtcgcaggtatgtctttattagcagtgtaagaacagactaatacagctagtgtctaagcttagaaaagtaatggaagaaatttcaaaggagaaaaaaattctatacactcaattatataaaaatatcaaactggaaaaatatttgcaacaaatataatagaccaaagtgagtaaagggcatgttcacacactgttggtgggagtgtaaattggtacaatcttttccggagagcagtgtgataataagtaccaagagcccagaagttcctctcctttgactcaacaatttctcttctgggagcctagcctttgaaaattgccaggaatttggacaaatgttatattcaaagcttactaccttagctttatttaaaaatacaaaaaactggaaatgtctactggtaggagaaaagttaaattgtatagtaaaataaattattcactatcaggggcaaacttaggtataattactaagtcataagattgctgtaattagcagtgatatttcctttatattttcatcttgttttggctcagttaggaaaatcaaaatataattctttacatgtccaaaaagccgaattaaatgctaactgaagaatagtaggatcactggggcatctttgagcctttcccttgtagtgtgctaaaaaaaatgttaactgtaagacaatactatagaacatttatttaatataaagtacttattgtgtatagggcgttgtgctaagtatatgacatgagtatctcatttaaatatttctagcatcagtcttatgaagctgtaatgttattctattcattttgcaaatgaggaaccagaggtaccaaaagctttagttacttacctgaggccattcaagtggtaagaggcacagtccagacccgtgggatgccaaagcatattactactgagtatctgagcaaagccttagtctgcattggaattaaaatgtagaaataacaagtgacttttaaaaacagttttaatcaggtttaactcagattagagagagaggggagacactgccctggcacttcactgcgcaccctccatcactatggctaccagtgtggttcttatcacccagctaggcttgttcttgtagatgcactatccttgcctcctcagtccccaaaccactgctttgtccccaggatcaagaggccgtctcctgcttcataaggacaccacatgatcccatgtcgtttctcagcatttctgcccttagggctccatgcaacagaaattaatgggctctctcttatccaggctggagtgtatcacattaaaggccagacctaggagaacactgtgaggaagcgttgtttgccacctaattcttactgagcatttctgcatggtaatgccttagaatggagaggacagtaactagagcagcatttactgcctccctccataagattgcccaagatgacacgcacttagtagtttgctgtccagcttagcttgtttgccatcctttcttgtatcattgatgctcttaaagcaggaatggggcaaaggaattaggttgtttgcctccatgacttcgtaattccactttttttttttttttaaaaagctatgtgcctttgctaaaaaacaagacatagtttgtctttccaaatttctataaaccagggtttctgaacctggacactgcccacactttgggctggagaactgtctgttgcagggagtcatcctgtgtattgttggatgtctagcaacatccctggcctctacctgctggagccagtagcacccttcctcacatgttatgacaatcttaattgccatcagatattgccaagtgtccctgtgggaaaacattgctcccagttaagtttataaacataaaacttgacttgttttttctttgaactgttgggagataatggtcattatgaagcgtacatgatcatatctgatattttatcgtttggatattttcaactttttcacatatcactctcatgattatatactgttgaaaatcaaatatataaaatactgtttttcttttttttaaacagtatgcaagcattgagaaaaacggtgaatttttcatgtcccccaatgactttgtcactcgatacttgaacatttttggagaaagccagcctaatccaaagactgtggaacttttaagtggagtggtggatcagaccaaagatgggtatgtttatttttaattattttatttaattctttttgtttgaaacagctttcttttgctctaatgaccaggaagtcattaaatgtataccttcccatctcttaggaccattttctgtacttactactattattattacattatttgagtaataatgtagttccttcaatcattgtttcaagttggggattcaatatgtatatatttgactcttttaaagaatgctttatcgtatcagagaactattattgtcaacaaggtggtgatgtgcagatgtatgagagtatttatatgcctttggtatttttcaaggcagctgtaaaattgtgagtaaatgtacaacatagctctatgaacgttacttttctataatctttctttctgagcaaatcgcctttaaaaattcacaggtgattccaaagccccaagaaaggcactctgcaaaagctagaggaaagaaactgtaccatatagaatcaaataggacacgttgcagaatgcctttggattctttttttccctaccagtcttctctgcttccattttgttggaacttttttccctccttcttttgaggcaggttctcactctgttgctcgggctggagtacagtggcatgatcttggctcagtgcaacttctgtctcccaggtacaagctatcctctcacctcagcctcctgagtagctggtatcaaagccgtgcgccaccatgcccagctaatttttgtatttttttgtagagacgggattttgccgtattgcccaggctggtctcaaactcctgggctcaagccatccgcttgcctctacctcccaaagtgttgggattacaggtgtaagccactttatctggccttctgcttacattttaaaaatgggttttccttaagctgtataagattgcaatggcttttaccattacacgaagaattttggactctgaactcttgctaatcaaacaccaatgtctgctaatagccaaagtataatgtacaagaactaaccttctctaggtaaactgtaaaggaccttgccttcttccttctctaggtaaactgtaggagactttgcttctgtccctgctgcttgccagcacccttttgacagattgcagttacctatcactctgaggtggagttctctagctctgaattttctctatttattggaatcttcatgtgtctgattttcccacatgcagcagtttgagatataacccatgtataatgtctttatgtacttcgaatactctcagttttcactagcactttccttttcttatttatgcacttgtcacccaatttttttattatactttaagttttagggtacatgtgcacaatgtgcgggttagttacgtatgtatacatgtgccatgttggtgtgctgcacccgtcaactcgtcgtttaacattaggtatatctcctaatgctatccctccccactcccccgaccccacaacaagccccagtgtgtgatgttccccttcctgtgtccatgtgttctcattgttcaattcccatctatgagtgagaacatgcagtgtttggtttttttgtccttgtgatagtttgctgagaatgatggtttccagcttcatccatgtccctgcaaaggacatgaattcatcattttttatggctgcatagtattccatggtgtatatgtgccacattttcttaatccagtctatcattgatggacatttgggttgattccaagtctttgctattgtgaatagtgccacaataaacatacgtgtgcatgtgtctttatagcagcatgatttataatcctttgggtatatacccagtaatgggattgctgggtcaaatggtatttctagttcaagatccctgaggaattgccacactgacttccacaatggttgaactagtttacagtctcaccaacagtgtaaaagtgttcctatttctccacatcctctccagcacctgttgtttcctgactttttaatgatcgccattctaactgaactacaaaccactgctcaatgaaataaaagaggatacaaacaaatggaagaacattccatgctcatgggtaggaagaatcaatgtcgtgaaaatggccatacaaggtaatatatagattcaatgccatccccatcaagctaccaatgactttcttcacagaattggaaaaaactactttaaagttcatatggaatcgaaaaagagcccacattgccaagtcaatcctaaaccaaaagaacaaagctggaggcatcatgctacctgacttcaaactatactacaaggctacagtaaccaaaacagcatggtactggtaccaaaacagagatatagaccaatggaacagaacagagcccccagaaataatgctgcatatctacaaccatctgatctttgacaaacctgacaaaaacaagaaatggcgaaaggattccctatttagtaaatggtgctgggaaaactggctagccatatgtagaaagctgaaactggatcccttccttacaccttatacaaaaattaattcaagatggattaaagacttaaatgttagacctaaaaccataaaaaccctagaagaaaacctaggcaataccattcaggacataggcatgtgcaaggacttcatgtctaaaacaccaaaagcaatggcaacaaaagccaaaattgacaaatgggatctaatcaaactaaagagcctctgcacagcaaaagaaactaccatcagagtgaacaggcaacctacagaatgggagaaaattttttcaatctactcatctgacaaagggctaatatccagaatctacaatgaactcaaacaaatctacaagaaaaaaacaaacagcgccatcaacaagtgggcgaaggatatgaacagacacttctcaaaagaagacatttatgtagccaaaagacacatgaaaaaatactcatcatcactggccatcagagaaatgcaaatcataaccataatgagataccatttttttttttttaatggaaagaacctcctgtaaaatgaaggccttgatgactgggagggagcaggcagggaattaggtgatctacttgttgcagtattctggaggattgttggattatgccttctctctctgttccagcggcagaaggtttcctttttaaccttcttacctttgttttctaccctaaccccaagggggattctttgcttggtaggaaaatgtaatgtatgagcagggtggtgcaggaaaaggctgggctatatttcacactagttcatttaagctgaaactatgcaaaacacagacttatgccagcaagcatttttctgtggaaaatctagttgttttttcacctcctagaatggctcatgtttcagaggaagtgtgaccaagttcacatgcaacatggattatctgccttaatatttgagatcagttttttgtaatttggaaaaattttaaactacagaaaaaaaaatctgagtcacaaaaaagttgagagaagaatatggtgagcacacaatctatacccttcacctagattgactttttattaaaatttttaccatctttgtgctgtctttgtacacacacattttctacacacaaacacgtacacacataatttctttttatggttggaacacttaagtgtaaattgtacacatcacaatatttcagcatttatcttctgagactaagaacattctcctacataaccccccatgctattattgcacttaggagaattaatgatcatgtcaagtatcagctaatgtctattccatatttaaatatactagaactttcaagtatatttgcagatctggtgtgttcacctcccttcccaacctcaaatggctctttgcctattcttgtttctttctttttttgttttttgattgaagattatactgcagttagttatgtctcttttactctaaaacagaacagaaatattatattgtttttcgtgatattgacttttgaaatccaggcgagttatttggttgaaggtcctgcattctggacttgtctgattgtttcctcattgtctgattcaattcaggataaattctggggtataggttaggagctattctatactacccattgtatctcctcaggagggatcgtgtccaggtgttggtgatgctgtttgataagttggtgaagctggcatccacctgatatttccattgtaaaggctacattttgttgttatatgagtagataatttgtgggatgatatgtcaagatcacatggatattttctccagcaacctttcacctgatggttttagcatccatgatgattctttgctgaaccggttattctattgatgtttaaaaggtggcgatttttctaatcctataatttctcctgtatatattgtccaacattccttggtaaacagaaactttctttcctcttcccccttttctttgtcttttaatcttttttatcaacataaattactggatttgcatactttaattctgtattatactccattaccagtatgcccttacaggcaaagcgtctcataactggtcagtgggagggctgggcctcaagctggcttctcattctcagctttcaggtgctccttgcttttggcaaattagttgttccaggctcaccttggaccgttcctgcctttgacctggaaatcacttttccccccaacaagaagctctgattccttttatttaggaatggtgcttaggaacaaagctctgggcactggcttattgttaccagggtgttactgcttctctgacttttcagtgaaaagagctgggaaatatataaactttaaaaaattgaaagttcataataacatctccttttaaatttaacattacaggatttttctttgttttttaaattttgtgtctctctctgcgaaaattttggttgctacatacattaatatgtttatgggcctttatttgatagaattggaagacctctgaaggtataagaaagagcaaaaatgtttaaaaaataaatgaataaataggctgagcgtggtggcttacgcctgtaatcccagcactttgggatgccgaggcaggcggatcacctgagatcaggagttcgagaccagcctggccaacatggtgaaaccccatctctactaaaaatacaaaaaaattagccaggcatggtggccgtaacctgtaatcctagctactcgggaggctgaggcaagagaatcgcttgaacccaggagctggaggctgcagtgagccaagatcacaccattgcactccagcttgggtgacagagcaagactctgtctcaaaaataaaataaaataaaataaataaaataaaataataaaataaattggaataccttctgatgtgctttgtgttctattttatcccccttcccattaatagacatgctttttctttttttaaacatataatatccaaaaatacagccttacatttatcagataacaatgtgtaatatatattttacatatatagtataacataatgtgtgtattttctcaaaagcttgtgacagatttgaaaggccgactttgttttcttggttttatcgatgagataactgaagctcttggtatttaagcagtttgtagctaaaaggtgctcaggcctgtcaggttttaaattccttggccttttcagtgttctgagctgcctcttctcataatctcacagtcctcttttgacattttcttttagattttgtattatcttaaatctcagtgttttactgtgacacagaaaatgttagatggccttaatcctttgccctataacaaaccttttagttgcaaaaactgtgaacatctcagttatttttttcctttcatttctagttggcgtgtagtaattgtacatattagatacagagtgttagttcagtacatgtatataatgtgtaataatcaaatgagggttttatatcaatttgttgactaaatttagttaagtgtactaagaagcatttttacgaaagcccgggaatagaagctgtattttgaattctgttactcaccttaacaggctgaataatggccacccaaagagatctattcctaatccctggaatttgtaaatgttaccttatttggaaaaagggtctttgcagatgtcattaaatcaagaattttgagatgaagatattactctggattgtttaggtgggctctaaattccatcacaaatgtcattagaagatagaggcaaagggagagttgacacagaaacagggaagaggaagagacggggtgaccacagaagtagaggttggagcgttgcagccataaaccgaggaatgcctggagtcaccagatgctggaagaggcaagaggggattttccgcaagagcctttggagagtctgtggccgtactgaactcttgatttagggcttctcatccctagaactgtgatagcataaattttgttgtgttattatgggaatttgttttgtttatttatttatacttatattttattttatttttagacaaagggtcttgctctgttgcccaggctgatctcaaattcctaggctcaggctatcctcctgctttagcttctggagtagcagggattacaggcatgtgccactgaaatcaggtatttatatttctcttttttttttttttggagatggagtcttgctctgttgcccaggctggggtgcagtggcacgatctcagatcattgcaacctctgcctcctagttcaagtgattctcctgcctcagcctcctgagtagctgggattacaggggtccgccaccgtgccctactaatttttgtatttttagtagagacagtgttttaccatgttggccaggctggtctcgaacttctgatctcaagcagcccacctgccttggcctcccaaagtgctgggattataggtgtgagccaccgcactcagccccagctatttatattttctaattgacaaaagttgaatatatttatgatatgcaacatgatgttttgaaatatgtatacattgtagaatggctaaagcaagctaattagcatgtccattacctgatatacttatttctttttgtattgagaacacttaaaatctactcttagcaattttcaagtatacaatatatgattattaagtatagtcaatatgttgtacaataggtctcttgagcttactcctctaactaaaattttatattgttggaccaacatcactccagggcctttccccatactgtccccttcccccaagggaggccctggcaaccaccagtctgctctctgtttctatgagtttgacttttttagattccatgtgtaagtgagatcatgtagtatttgtctttctgtgcctggcttatttcacttaacatattgtccttcaggttcatccatattgtcacaagtgagaggattgcctttttaaaggcttaatagtattccattgtgtgcatgtatcacattttcttcatccgttcatctgtaatgggcacttgagttgattgcatatcttggctatggtgaataatgctgcagtgaacctgtaagtgcagatgcctcttcagtgtaccagttttattttcctgttgtaatttgtcacagcagccccaggaaatgaatacactcatgtagctgttttttccgggacgttagaaagcttatagttgtgaagaattttctttgccaagggccagcctgatccggaaaaaaacctttttctagtggtagttttggcttgatccagacattttccagtcagtgacccctgttgtcaactgtctctgtgagggcatggctgcttcctaaagacttcacctatgtgtgggctgggatggaactctgggcagggaatttaaatgcctgtgcacttacggccttaacacctccagcttgctgagagagggatcctgttttctgtagcactcttgtttctagtggaatgatgcatgagtgccttgggtacattggtcagccttccatgttggagcttctctctgaacactctccagttattcagcagctctttgggaacctcatctctgtgcttggcacagttgtgtatattgaggataacatggtgaatggaaaaaaaaacacagtgcttgttgccctcttggagcttctaatttaatggagcagacaggtattcatcagggagcctgaaataaatgtgaattgatgtagtgatactgctatgaaagagagagatggtgtgagtaacaccaaataagggcttcatttggactgggaaattgggaagactttccatgagtgacatctgagttgcaggagttggaggtgggagtacagaggacagagagttgcaggcagagggaacagcagttgtaaaggtcctgtgttttgaaatgcagaggctggcttgcctggagcatggaagtgcagggcatggtggtgggagaggtgggctgtgcccagactgtgtagggacttgtacctcatattaaggattggggttctttatcttgagagtgctggagagccatcaaaggctaatttgaatgaggggattggcacgatttgcctgtgtaacagcatacttgctgttaatactctttgttgtgtttagacctccctgcattccactgttttaatctacttaatgatggatttaatcaatttatgaagttccgtaagggagatgagaggagactttgagtgtctagggctggaagccttttgtttttggtgggccttaatgaatgaagagggcttgtcccagcatttgaggaggaggtgggactctaaggacttctcagggcctagaccttactgtaccacgtaactgaactgtaccttttagatttggttgtgattattattttttcattcaaaatgagaataaagctttgtatatcttctaagtataatttttatacattgttcatacaacttacctgttaagagcaaggtgaaaattcttcctttgatctttgcacacgttctatttgttgttgttactgactgttatctcgttaaagggagtcaaggctaaagaactgtcttcacttgtgactgaccttctcacctgggaagaccacatgggactagaataagctggaggtgttgagtgcctgacttactgagggttacgggtaccaagcactgtctgtgaggtgggcaccgggtggctcagggatccagttggcttgctagggtcacaaaggaatttaccacacatatgtctttcatctccagtgtggaacctctttgcactccatgtgcaaacagaagttggcacttcttttggaaaagggaatgttagatatctcagtttgctagtgatgaagctgacagattcaccataccgccttgtcagccccctgccactttgttgtaccaaaatgacagcaatataatcaaacccttaatttttttttttttttttgagacagagtctcaggctggagcacagtgggatgatctcagctcactgcaacctcccttactgggctcaagcaattctcctgcttcagcctccccagtagctgcgattataggcatgcaccaccacacccggctaatttttgtatttttagtaaagacggggtctccccatgttggtcaggcttgtctggaattcctgacctcaagtgatccacctgcctcagccctcccaaagtgctggaattacagacgtgagccactatgcccggcctcagataattcctttctgttcagagtaaagagattgagtcctgggacagttcctgttttgatgcatgaagaataaaggcatcaaagaagaaaagatgaaaaagaaatctaaagtttagaaatatgtggcctatataaataaagcatgttctctgcctttcctatgtttgctattctttttctgaggaaagaatatatggccttttaaagatttcacaaggtgaaggaggatataataatgttgatgataaaatcatttttatatacctgttttcattttgtgaggctgtcgtgatgaaatccaggccttggccacatgctgggagttaatgaggtttacaattggcaatacttaaagaatattagggtaatatatttaaacatcagcagttcacagcctgaagtgctcatcatctgtcaagttataatacagaatcaataaggggaggtctttcaatttgctaatgaggaaagttttctatactattagggtagacatagatttcagataaacatctaaaattcataaactatagaatttggcgaaagcatctcttcgattaaaaagaaaccttgataataatcaatagcagtcacctgagaagcttagattttcttcttagtcatcagactcccaaattaatctaccaaaacaaaaagcctcattaacagctctcattgaatcagtgttattttttcctttctctcaaggtgtctgattaaccccctttctttttgcattactcactttgtgttaatatttgatgtctgaaatcatggggcaggggaggggttgtgcaatgtggtggctagacactgtctacaagcagtaaattaaaaagaatttttaaaaaggtttgtattatgttgctgatgtattagaaaatctctaggaatgtcaggtgcctgggttttctttttctttttaatttcagaaagggttgattgctgattgggtgctgattttgcttctcattcatatgtacagatagcgctcctcctcctcttacccagctcctcttgcttaccaatccaagccttcttttggagagttttattgaaaaggaaaggtgagaaataaggccataactggagggaaaagggaggttgaaggagggtcttttctaggtgaatgccaatgggaaagactcacttgagagtagataagattgacaatgtaggagagaaaggaaagacattctggagcattgtctaggaggttggcctcttgtaagagcatggagagttcatccagaacacctgacctcaaagtgtagccagtggactcctggaagtccctgagaacttttcagaagtccaggaggtcaaaactatttgcacagtagtaaaagcatgatctacctttttcaccatgttgatatttgagctgaggtttctaaaagcaatagtgcgtaaaacttctggtgtcttaacagcaaataaggttttgtctgaacattgatgtccctccaaaattcatgttgaaacctaacctgcatggtgatagtgtgaagaggtagaactttggggaggtgattaggtcatgagggctctgctctcacagataggattagtacctttgtgaaggaggcttgagggaatctgtttgccccttctgccatgtgaggatggagcaagaaggcaccatctatgaaggagaaagcttttaccagacaccagacctgctgctgccttgatcttggacttcccaactcctagaactgtgagcagtaaattctgttacttataaattaccaagtactaggatattttgttataataacctgaacagaataagacagacaccaatccaaacagagtaagcaatcattattttcttcattacacattcatcatcttcgtcatactgattctgcttcagaatgtccttgaagaagcagtcaaaatcattgattttattaaatcttgctcttgattacacaagattacattttaaaattctgagtaattaaatggcaagtatgcataaagaactctttaatgtagtatggtggttgtctgaggaaaagtacttgagcagttgttttgaattgctagttgagctagtcttctactagaggatacgggataccattcttatttgaaagaatgacttttttgaaagatttaaaattttcatgtttcatcttcctaatacttaaagactttctgatgtcattggtggtgatgttaatgaatgtggcttttaaatatagtttaatgaagtttcctaacatttggatgatctgcataatatagagaaacagtattttcccagttgaccggtgtgcatggtgttacaaaattatgcatgggtaacagatagtttgaaaagtgctcatagacccatgaattttaaggtaacagagaggagaaaagttcactgatacagtttcagattgcacattgccactagtctttaagaaactttacttgttgggatttggtgttgtatcaaagaagaacatccccagttatctaaaaaggccattaaaatacttctttcttttctaactatgaatctgtgtgaggctgaaatcctttcatattcttcaaccaaaacaacatattacagcagattgaatgcagctgttttccattaaagtcagacatttaagagatttgtaaagatataaaactgcttttctcactaaattttctgttttagaaaatatagttctttggctgggtgtgctggctcatgcctgtaatcccagcactttgggaggctgaggcgggaggatcgcttgaggccaggagtttgagaccagcctggctaacatagcgagaccctgtctctacaattaaaaaaaaaaaggtatagttctttttcatacaaatatatttatattaccatgtaatagagttactttttaatgaaataaatattttctaaatttcccaattttaatttctagtatggtaaatatgatagctataatccacataaataaaagctctgtggggacctcaacaatttataactgtgttaagaggtcctgagacctaaaatttttgagaaatgctgagctagaagagaagatagagactagagtagagagagagtgtagatgtagtggtgagatttggggacaggttgtcttttggtttctttgatttttttccaggaaatagatgagatggaggtgcaggttgaggtattggcagtttgtggagagagattcgtatactacatagttatctagaagtgggagggtgaatgtgtgaggaacagcatgatggctgggcaggacccacttgagtgcttacctgaggattagtggtcatgaaatttaaagtgagaccagttagtgtggctgtatgtttttcagataaggccagtcgttcaggcccaggtagtaagggttggatgtagctagggttgaggtcatggccactgaataatccagagtaggtgaggttccagggaggtaggtgcaggggcgtgcaagggagtaattatgatgatagactatagatttagtctgggcaaggagcaaagagaggacattgggtaggacgcaatgagggatggtgagaaggtgacatgcttaatgaattgtgagtttcagcatggttgaaggttgttgatcaattgggatgtgtttatgagggactgaacaggaagactagaatatagtggccataaagtgagatgcatgaaattgagaaaaaggagtttttggtaatggcaagtaaagtctagagtgtgaccatgggagtgagtggctgaggaaggatgaaagaaaggccatcggaggagatgagttaatgtaattggaggccttagtgtttgaaggatcagtatattgaaggataagtatgttgaaaatattgagaactaagatagaagttgagagagtgtcatcgagccaagagctaaaatacggggtgagaggggaatccagggttattagatcacagaaacaagaggtatgctgagtggtatagtcagatgatgggaatatttgaatgggtgggggttaggaaggagaatatgggatctacccaacctgcttataggcctggtgcaacctaggactgcaagaggaaagctcatccctacacgtaagaggggtctacagtggaagcattgtcctcaagggacagccaggtattggttagagcaagaaagtgaagagatattttatggaaggattgaggaggagattttggtcactatacactgaattctagagaacacagttggagggtttctgggagatggtgacagaataggcaaagtccagggcctctcagggattagacgtgagtggtaaagggtaacctgggtgtccgggactgttggtcaaggctgacattcacggaataaagagaagaatgcagttagtcctggtagactccagattgtgcctgctggttgatagggatctttgcagagaggcaaggaagcttggagaggggcaacttttattacttaaagaacttttaaaataaaaatattttgtgagcagtagctctgctgtttttttttttttttttttcctagatggttggaccaaaggatgaaggaaatgaatagttactgagcatatatagggttccatatctggtgctaacaatttccacctgttttcttatttaatcttcatacaagaccttaaaataaatattttcactgcccatattataaagggaggtggagaattagagaggttaaataatttgctcaaagtcatatagctaatgagtggtggaactagcatttcgacccagttctttctggcttgtgctcaatctgctctaccatgaaactttctatgcatagagaagaatatttaaaattgagctttgcacgagaactttgcttatgtctttgcttagaagttctgatggcctttgcaagattctttgcccttgagactagtcatttagccctcatatttggccaacataaggtgaatataaaacctccatgagaggctcttcgtcacccatacccacacttatgaaaaactggccttgcttacctcttactctttttttttaaactgaggagtagtttttggaacacttttccctttttactgttcttatattgaaccttgagttaccattgcgtatcatattctcagaataagaataagtatcgttactgggccaacttaataccaacagttcttccatattcttcccagcatatgatgctgcttagtgaatgcctgaaagagcaaatactgttctttcctctttctttgtttggtgttagtgtagaaagataagctggattaattgtttgatttgcttgatctagactgtaggtgtttaaaacataaatctaaaattttaaaggaaaggaaatcaaatgtaagctctgtttcctagctacttgagaatctgcttctttaccactgtcagaattagaggtacaggatgtggagttgcttaaattaaaacagtcttgtactgagctatgaggaattcatgaagcaaaactgctatagtttgaatgtgtcctgaaagttcatgtgttggaaacttagtctattgcaacggtgttgggaagtggggacctttaagagatgaacatattaatgcttttatcgcaggcatgtggtatgtgggagtgggttctttatctcaggagtgggtttcttatcaaaggatgagttggtcctcttccccgtctctttcccttgcccatgtgatgccttccatcatgggacaacccagcaagaaagccctcaatgtcagtgccttgatcttggacttccaaatcccacaacagtgaggaagtaaatttttaaaatgaattactcagtctcaggtaattctgttctagaagcataaaatggactaagacaaaaatgttaggagatatagtacccaactttcccattgattgtggcataattgtgccatgattgtcagtgagttgcttcctagtaaatacagtgagattcagagattttaatgaaggtttttgagagtaaagtaagacttctcttgcaatctgatgtaaaggttttgagatcttcagtctggaataagcaaaaggtgaaagaagataactgatgaaagaacttaattgtcagaaattttagagtaacttagtctgaaataaatgatatatggtaaggtaaaatggccttctgctacaaatctgagacaaccttgatacttgaaaaatatagattaatttcagatttggtaactcatttaacaaatatatattgacaccaactatgtgccaggcactgttctaaacagtgtgcttttatatagcaaacagataatgtaaacaaaagatatatatagatgatatagaggtaggttgttatatttattaaagtgctatggtcgataaagtggtcagggaagatctctctgaaaagtgacatttgggcaaagacttgaatgaaggagtaagccatgggagaccctagggattgagccttctcaatagagaagaatagaggggataacaggtgcaaagagcctgagaggggagggtgcttggcatgtttgagaagcagcaaagagaccagctagtagagagggttgataggagagtgaaagaagtataaaatgtatcccagggccaggttatgtagatgttgtagaattgtattttgagagtagtagaagtcattggagggttttgagcatgggaatagcatgatctgcattacattttgaaaggttttgcctggctgatttgagagaatgggatgaagtgggtgacagtggaagaaagggaaattaggactgtgctgcagtaatctgtgtaaaaggtgatggcaagactagagttgaatggtaagaagtggttggatttgggattttattgatggattagatatgaaatatggggaatggcgatataagcaaatgagatagggaatgttgggggaagagtaggtttggaagcaaaattaagagttctttaggacattagaatattgacctccctgttaaacatgcaattagagaggcaggctgtgagatgtatgcttagagatgagagtcaatgtaattacttatttggtctgagccaattctcagcataaggagttggtgctgttgtaacttcagtgagttgtgttttgtagggtgggggaattggggtcttttttgtattgattattatgaacttacaggtttttatatgtttgtgttttaattgcaatatctcatctttggccagtaggaacccttttatattatctcttttgtcctttttgatatgatccattgatttttggtagcttccttgtttctggcaaaataggttgttattttatatatttcctgccctgaacctggaatcagttgctctgcttgaatctcccccttttttaattattattatattttaagttctgggatacatgtgcagaacgtgcaggtttattacataggtatacatgtgccatggtggtttgctgcacccatcaacccagcatctacattaggtatttctcctaatgctatccctccccttgctccccaccccccgacaggccccagtgtgtgatgtttccctccttgtgcgcatatgttctcattgttcgactaccacttatgagtgcgaacatgcggtgtttggtttgctgttcctatgttagtttgctgagaatggtggtttccatcttcatccatgtccctgcaaaggacatgaactcattctttcttgtggctgcatagtattctatggtgtatatatgccacattttctttatccagtctgtcattgacgagcatttaggttggttccaagtctgctattgtgaatagtactgccataaacatacgtgtgcatgtgtttttatagcagaatgatttgtaatcctttgggtatatacccagtaatgagattgctaggtcaaatggtatttctagttctagattcttgaggaatcaccacactgacttccacaatggttgaagtgatttacactcccaccagcaatgtaaaagcgttcctatttctccacatcctctccagcatctgttgtttcctgacttttaataatctccattctaactggcgtgagatggtatctcactgtggtgttgatttccatttctctaatgaccagtgatgatgagctttttttcatatgtttgttggatgataaatgtctttttttcagaagtgtctgttcatatctttacccactttttgatggggttgtttttatcttgtaaatatatttaagttccttgtagattctggatgttagtcctttgtcagatggataaattgcaaaatttttctcccattctgtaggttgcctgttcactctgatgatagtttctttcgctgtgcagaagctctttagtttaattagatcccatttgtcaattttggcttttgttgccattgcttttggtattttaatcatgaagtctttgcatatgcctatgtctgaatggtattgcctaggttttcttctagggtttttatggttttatatcttacatttaaatctttaccatcctgagttaatttttgtatacagtgtaaggaagggatccagtttcagttttctgcatatggttagccagttttcccaacaccatttattaaatagagaatcctttccccgtttcttgtttttgtcaggtttgtcaaagatcagatggttgtagatgtgtggtgttatttctgaggcttctattctgtcccattggtctatatatctgttttggtactagtaccatgctgttttggttactgcagccttatagtgtagtttgaagtcaggtagcatgatgcctccagctttgttcttgttgcttaggattgtgttggctatacgggctcttttttgtttccatgtgaaatttaaagtagttttttctaattctgtgaaggaagtcaatggtagtttgatgggaatagcattgaatctataaattactttggtcagtgtggccattttcacgatattgattcttcctatccatgggcatggaatgtttttccatttgtttgtgtcctctcttattttcttgagcagcggtttgtagttctccttgaagaggtccttcacatcccttgtaagttgtattcctaggtattttattctttttgtagcaattgtgaatgggagtttgctcatgatctggctctctgtcttttattggtgtataggcatgtttgtgatttttgcacaagaattttgtatcctgagacattgctgaagttgcttatcagcttaaggaggttttgggctgagacgatggggttttctaaatatgcaatcatgtcatgtgcaaacagagatcatttgacttcctctcttccatttaaataccctttatttctttctcttgcctgattgccctggccagaacttccaatactattttgaataggagtggtgagagagggcatccttgtcttgtgctggttttcaaagggaatgcttccagtttttgcccatttagtatgatattggctgtccgtttgtcgtaaatagctcttattctttttgagatacgttccatgaatacctggtttattgagtgtttttaccatgaagggatgttgaattttatcaaaggccttttctgcatctattgagctaatcatgtggtttttgtcattggttctgtttatgtgatgaattacgtttattgattatcacgtatgttgaaccagccttgcatcccagggatgaagccgacttgattatagtagataagctttttaatgtgcagctggatttggtttgccagtattttattgaggattttcatataaatgttcatcagggatattggcctgcaattttctttttttgttgtgtctctgccagattttggtattaggatgatgctagcctcataaaatgagttagggaggagtccctctttttctattgtttggaatagtttcagaaggaatggtaccagctcctctttgtacctctggtagaatttggctgtgaatccatctggtcctggactttttttggttagtaggctattaattactgcctcaatttcagaacttgttattgatctattcagggattcaacttcttcctaatttagtcttgggaggatgtatgtgtccaggaatttatccatttcttctagattttctagtttatttgtgtggaagtgtttataatattctctgatggtagtttgtatttctgtgggatcagtggtgatctcccctttttcattttttattgcatctatttgattcttctctcttttcttctttattagtctggctagtggtctatctatttggttaatcttttcaaaaaaccagctcctggattcattgattttttttgaagggtattttgtgtctgtgtctccttcagttctgctctgatcttagttatttcttgtcttctgctagctttcgaatgtgtttgctcttgcttctctagttcttttaattgtgatggagtgtcaattttagatctttcccgccttttcctatgggcatttagtgctataaatttccctctaaacactgctttagctgtgccccagagattctggtacgttgtgtctttgttctcatttgtttcaaagaacttatttatttctgccttaattttgttatttacccagtagtcattcaggagcaggttgttcagtttccatgtagttgtgtggttttgagtgaatttcttgatcctgagttctactttgattgcactgtggtctgagagactgttttgatttccattcttttacatttgctgaggagtgttttacttccaattatgtggtcgattttagaataagtgctatgtggtgctgagaagaaggtatattcttttgatttggggtggagagttctatagctgtctattagttctgcttggtacagagctgacttcaagttctgaatatccttgttaattttctgtctctttgatctgtctaatatggacagtggggtgttaaagtctcccactattattgtgtgggagtctgagtctctttgtaggtctctaagaacttgctttatgaatctgggtactcctgtatgggctccatatgtatttaggatagctagctcttcttgtcggattgatccctttatcattatataatgcccttctttgtctttttggatctctgttggtttaaagtctgttttatcagagactaggattgcaccccctgccttttttttgctttccatttgcttggcaaatattcctccatccctttattttgagcctgtgtgtctttgcatgtgagatgggtcacctgaatatagcacaccgacgggtcttgactctttatcccatttgccagtctgtgcctttgaattggggcatttagcccgtttaaggttaatattgttatgtgtgaatttgatcctgtcattatgatgcttgccatttattttgcccattagttgatgcagtttcttcatagtgtcgatggtttttacattttggtttgtttttgcagtggctagtaccagtttttcctttctatatttagtgcttccttcaggagttcttgtaaggccggcctggtggtgacgatatccctcagaatttgcttgtctgtaaagtattttatttctccttcacttatgaagcttagtttggctggatatgaaattctgggttgaaaattattttctttaagaatgttgaatattggcccctactctcttctggcttttaaggtttctgcagagagattcactgttagtctgatgggcttccctttgtgggtaatccgacctttctttctggagcccttctttttagtaggcagttgtatttatagaccacaatctggggattaggtatgtttccttcttttgagttgtcactactttgagaccttttgtttttctcttctctttatttattattattattttgagttagggttttgccctgttgtccaggctgaagtgtagtggtacaatcatggctcaatgcagcctcaaccgcctgggctcaagtggtcctcctgcctcagcctccggagttgctgggaccacaagcacacaccaccatggctggctaaatttttaaattttttgtaaagatggggtttccctgtgtttcccaggctggtcttaaacttctgggctcaaatgatcccgccacattggcctcccaaagtgctggaactacaagtgtgagctaccgcacctagctgatgccttttcaattcattagagaaaaaattttccattcatgctgatatttcaaatgtaaagataaattgacacagttaaatccaaagtaattttattgttttgatttttctatctccgctctttcattgaaaatcctggttaccagcaacattcacagtattacatatttgccatgtgtaggatatatccaaaatagtaacacctttattgctgccaacaattagatactgaatgaagtttaagatttctttttagttctgttgtacttagactgtgttccacaaagtatatatagttaaaatactgtattctaaagttattggaaagaattcatttaattctgtgtggttttgccaccaacttaatatatatatagggaggttcattttttcagtttattttcaatttttagggattgtcttttttattttcaacttaatttaatttttgagtatgtaaaacatatgtttcccaaatcaaaactatacaacagaaggaaggtatgctcagggaagtctgtcttaacatgcccgtccttttcaccctgactcttccttcctttttataggtcattcttttttgtattagttttttggtttctcctcccacagggtattttttccccaaatataagtaaatttatatgtgtatttgtgttcatctttccttccccattcgtatccaaaaggcagctctatcaactctatatactatatatacgctcctttgagggagtgtgtatgtgtgtgtatatatgtagtatatgtgcatgtgtactagggtttgctcatgaaacagatccaatagggtatatatacacacacatatgtgggtatatatgtatatttatataaagagagacaaatacacatgtaaatgtacatgtaaataataaatgaagacatttattataaggacttgtctcacatgactgtggaggctgagaattcccagtatcagctgtctgcaagctggagatctgggaaagccaatggtgtaattcagtttgagtctaaagacctgagaaccagggagccaatggtgtacttcccagtctgagagcaggagtagatccatgttccagctctaacactcaggtggagaaagcaagttatccctttctccacctttttggtttattcaggacctcagtggattggatgttgcctaccacattgggagggcaatctgctttacccagactgcctatttacatgcaaatctcatccagaaacacccatacagacacactcagaaataatgtttaatctgactaccacatgttgctatcgaggtaacacataaaattaaccatcacagcatttgtataatgtttgtctccagggaagacagacagacagacagacatgcgcacacacacatacagcacacacacacagttgcttttatctcttagtcgtgtgttttgaagataattctataaatatgtaaagaaatcttcctcattcctttttatggctgcatagtgtaagcatatacatttataattatttttccagtttattccaatatctgttaaagtttacagaccagtgcttttaaggtttacattatttggctcatcaggatcttttcccaaaccattttagggctgttgtcaaagagcaatggacaaaccctaatgatgagatgaactttactctcagaataccgtctcacttgctcctatgttctgcattccctgcaccaaacacttcctatgctgtctgcttccctgtccactcatacaggaaagggcttcgatgttatagagtcactcttattgctcctgctaactgctgtcctgataacaatgggtcttttgcatgggaaaagcattatagagtgaaaggatcactgatagcagtcaaaaaaacacattttactatgtcttttaaaatctgtgggatcttagacaagtgacctatcccatgtgagcctgttttctcatctgattaaatggggttgttacttgctcggtgaatgcttgtgttgtcacccagtgaaataaactccagggaagtttagttagctttcccttctcaatttacctgcagatactgtttcaacattcctctctcctctcattccttccctctcttattcctttcctcacctcctacttttcttccccaattcctggcatctttcctggtggcaaacagaccttccatgtgaagaaaaactcctcataattgcactttcctcttcagattctgccccatttctcttctttctgcaacactcatcaaaagcactgtctgttctggcccttacaattaattcctctgcccattgattcttttttgagatggagccttgctctgttagccaggctggagtgcagtggcatgatctcagctcactgcaacctccgcctcccgggttcaagcgattcttctgcctcagcctcctgggtagctggaataacaggagcatggcaccatgcccagataatttttgtatttttagtagagacagggtttcaccatgttgtccaggctggtctcaaactcctagcctcaagtgatccacccacctctgcctcccaaagtgctgggattacaggtgtgacccaccgtgcccagcctgcccattcattcttgaatccactctccccaagtttcctctgctgctctactatgctctaatctgcccttgttacgatcttcaaagcagaatccaatgataatattagttctcaggttaacacacttgcctcttacccctttttgcaatactcacttcacgttcattataccatgttcccttgcatccctcagacctcactggttctcacatctctagtttttcctaactactttttgggtgatcttgtcccatctcatggtgctaaatacttcataacttctacttttatgtcttcagccctctcctccctgctgcttctgtgagagtccatttgcgtacctaataggcccctcaaatgtcacatgtcctgacctaggctcctgagccttctctctccaagcattctttcctattgcttgctcagtagattctgtcttgcagttgctcaggccccaaactctagggacatccttgcttccttcttttctttcacacctcccttcaaatcttacatccagtctagttggcctcactatcagtatatgtatcgtcagtactccctctgcccaatttcttggaaaggtgacagtagcagcaactgctgttcaggcttcatgataccagcaaggataatacaaaaaaaggaagatgctggaaagttgaccaagaaagagacccagtaaataagtctggactcaagtccccaaataaaaaaagattcaaaggcaaactctaagacaagctctgtttttggtcttgtttcataaagtcatatagaaaaaaaatataaagacgtttccaactgtagttcataactgctgtattcatctgtgaaggattgatgacttgaggctctctgaccagggtgtccaataagaagtgcttagtaaagactcatcaggttggtttccaacacacagcccacattcagtctatacccaaaatagcaaagatggtgctacaccaactgctagtgaagatgcttcaaatgggcagtaagatagtaaatgtacacacccctgcaggtctgcttcacttttattttctttccaagtacagtttcaagaacagtttattaagtaaagcaaaaaaatagaaaagaaaatagtacgactcaatcagttcactccatatcaatgcaaattcagatgcaatgcaactggtgattggtgtgtggcttccagttggccagttctgtagaatcattcccactgagtgattcaacacccaatgatgtgaccctgcattttacttgatttactttttaaaaattctgctcagcattatggaggatgttactccataaccagacgcaggcatgaccatctctcacctggattattgtaataacttctcaccaaatcttcttgtgcagccagagtgattctgttaaaatctgagttggattatgtcactctctggctcacaatcctttatggctctccattttcactcagagtaaaagccaaagcccttctcgtggccaacaaggccttgtggtactctctccttacgttacctccccagcccctcacttcatctgctgctctttcccttaattactttgttctggtgacattggtcttcttgccgcaccttgaacacaccgtgcttgccgtgcttggtcccacctagaggccttgtacttcctcttccttctgtaaggcacttcccctaagaatctcactcacttcctttagggctttctcatggtggttatcttgtataatacatgtgggtttcattaattttttttttgtctcctcctctttcccacacacttgactgtaagctccacgaaagcagggatttttgtctgtttagttcactgctgagtcagcagatcctagaacgtggctggcacatagtagcactccataagtatttgtctaatttgaatggattgaacacataatgttccatgcacatgtgaggtattatccagaagaggtgggattcttagatttctctctatggttccttctttgaatttttacatgttaaaatctctgctgtcatttttctcccaggaccactgtaatattttatggagcctctttttttttttttgtaacaggtctaaaacttttagcaaatcttttttcttctcctgtcttcacttttctcctccccaagtagactgcttccacagtattttggggttgttctagtttttgtaaactttttctgaggaattctttgtgttgaaaaaaccacctatatataggattagattctcatatttttgagaatcctgccccattcttcagcatccttacaagggactggactcatgtcccaaagtgttggtggattccaaccattcggcatgtcctcgctcatttatgtcttatggtctggtaagttaactgccttctgccgtagagttaagtaaagacagccatgtcgctgctcttttagtgaattttggctgttcacattattcttcaagttatttagaatataactttttagattcactgaggatattgcatctacttgggcaaaaccctgaaagcccctaaggatttagctgaacatgtaattcatattgaaacccaccttctcttgccttatgattttctgattcagtactttcttctagagttttttttctttttttgagacagagtctcactttatcacccaggctggagtgcagtggtgtgatctcagctcactgcaacctccgcctcctgggttcaaacaattctcctgcctcactcagcctcctgattagctgggatcacaggcgtgtgtcaccacacctggctaatttttatatttttggtagagatggggttcaccatgttggctaggttagtctcgaactcctgatctcagatgatccgcccgccttagcctcccaaggtgctgggattacaggcgtgagccaccatgcctggcctagagtttttttttttttttttgctaagttaagaaataaaacagtaaccaatttctgaaggaaaaagcattaaaatattgatgttgcttttctgcaatacttataccaagaaaatgcaagagagtctcaaaagttgtgtagcttaatttcctcttgcaaaaatataaagtactcccaacagtttctaattttgatgatcttttacaattactgttctgtgttgtaatggcctgcgttttaaaaaagcttgaaattgttaggagacctttagacatagaacttggtaagaagtgcagagataggatggcatagaatggggaaacatgccagatcaattgggacagaaaatttttcttaactgcttttcagcatttatataggttcttccatgagcaaaataaaatatgaacctaaatagaatgggctcaaacagtcataataaactcctttggttattttcagaaaatctatattcacaggtggcctgtgttaataggtgaattcattgtattttggtgtggctatttgtataacaaaacatgactaaatatgaaagatgtgtatgtctttttctttaccagatcttgcgccagtttttaagcaagcaaattatgttcatgtagtaaaattttaatctgtattgggaatagaggtgggaatagtagtattctgtttactgtggatttggagtaaaatctagaaatgctacttaatcagcatattgtaagcagaaattactttttgtcttttttacaaaaaatggacatgagagctcactccgttgcccaggctggtctcaaactcctgggctcaagcgaccctcccacgttagccttccgagcagctgagaacagaggcacgtgcaattgtgcccagctttagaaatcactttttattttaattcttatttgtaacatttcataaggtattaggctacttttcccagtcactaccgtttatacaatttagttttaatttcttaaaattttatttgaaattgtagaatgtcttaatcattcagaatgtgaattgtcatggaggtgtcagagatgcaatttaatttctcctgatagcagtatatcttgaaaatattttgcttaaagatttatttatccttgctgtcaatttgtttcttataatttgcctcatagaaacattcattcaaaacagagtgctgaaaccaaaatggaatatacaattaaaaccaaataatttttttcctgctaactacttcccagcccccagactgaactcgtgattgaggttctatttacttttgcaaacagatgaatatttttggagcagtggaggtaggagcatggtacctaagtccaagttgcaccattttgtgtggctgtttctttcttattttgcattaggaaacaggtgcaagaaaaagaaaaaaaattccacttcatcatcgtagtagtatctggaatctcattccccataaccaagaagaactcatttattcttggccaccctctctcttttgttattctaagttgactgtggacagctttgatgctgcccctgaacttctatgagtccccctgcccttgctgccaggattttagaatctacccttctcctatactaggagtggtaagaaaataaattcgggtagtagtgccatttgatgattcattttctttttatatgtgtcctttaaaattaacattgacaatttggagcccctttgtaatgtggatgatagaggaaaagctgtgattgcttataggctgaatttaggttcatctgaaattatgatgtatctcagaaacatcataattccttggtttgggagtggtaataggattaggactgttgagactgtagaaaaagcacattgtttttcttagatgtggatgcttgtttggggtggtgtaggctgatggagagtatttgagacagcggctactctttcttttttttttttttttcccagctgctactctcaatgcagacattgctctagaacaccctgtataaactatatattgccacatctaaaccatatagtacttcattaaattttgaacatttaaaatattttaactatatgagacaactatgtggtgcatgtgttaattagcttgattgtgataatcatttttcaatgtatatgtatataaaaataacacattgtacactttaaatgtatacaatttttgtcaattatatgtcaataaagctgtaaaaaaattttagataatgcacaatggatcccatactttgtatttattcctatataccttgatttttaagcaccttattctttaagttcattttgttgccgaatttgagtgcattctccctagtccttattaaagagggtacaataatctttcatctgagatacaattgatggaattattttataggatcgagtacattttaaagcctaatctttctttgcttacattgaatattatgaccataatattatgaaatgttattctgaaacttggtctgagttctcttacgtcatcagaaatttctgcaaattcaatctgaaatcaacacatgggcactttttttttcttttttatggtcttaaatacagaaaatcataatctattttaagcttagataaatgatggaacacttgtttacatgggtaaaatgactctatctaagtagtatattgaagttcatgttaatgtttgctatttaatgacacctaatgatattcagtgaagggttatgctaaaccggagagaaaatgtgttacccaggcaactgcctctggcagactagagattcgggcatatggctctatagtacacattatttcagcatctttaagcataaagaaccacacatgtaattgactgtgaaaaattactgctcagttactgtattgtatggtcataatagaagtaaatgaatacgtcattgttgttggaacaagtctgttgggaatcacttgtagactctactatttaagaagcaaaaatacaataagaagaaaatagctggtttaattaacatgtaaaaattgggttaatttgaattcagctggcacagcagatattaatgttggcttttttttgtgatattctggctcaagcctgggtatttttatttcttcttgcccacaccatgaataattttatttcttaaaatgataagggctatttcagtcatttaatttttgctttgccagggacttttattacagtcacatcaagagaggttttgtgtgtatccaaaatgtaggaattacagttgaatgaaagaaaatgccaaaatgttcccgagtaattgataatgtttctcaaagaggaatcagtataattttgatttcatgtattttttaaaaattttagtttactgctgatgtatttttatttttttaacagtgacaaactaggaattgatcaacggcagatgcaagaaaatagcatgttcttgtcactttttgtgtgcctatgcttatgtgccttttgttcgttttagaatattgttttaatcatcattaccttgcttcagagattcagaaaaacctattgagaaaggcattgtgttccaattaaaaaatcgtttagctcaatcaatttttggtattttaaaatgttatttgagctgagaacaaacataggtaatatgggcattaactaaaagtatgtatgggaacattctgttccttgggctgtgccttcggtaccctgtaggtacttttgtgcttttcagccctaaatcaagggaatgatcaaactggagactatggttagagaagtgaaggatttggcagtgtgtgcccttgcatgcaggccagtctttctgtccttgggtgcattcaaagtacctggttatccagtggtaatgagaataaaccaacatgctgctttatatagtgtaggccagtatacgctgacaaattcatatgcctgctggcttttcagttactgatttcttatttgtggtttccccactatccttcttcatttgccattttaataacattgagacctttttatccagccttaattagtagaacaaagaaagatttaggaaacctaggtttttaaatctgctttatttgccttaatcagttttccatcatggtttacaattacttttcccttttttcctcaatggtctttctttacctcttttgatttcctcctgctttgaaggcaatacgtaatttaaaatgaggtatttatggtgttttttgtttgtttaaacttagtagacttttcctttaaaaagaagtctttggtagatctcaaaatatccatgatgtaattaaaatgcagactatttgtcatgcacattattaaattctgctctcagtgttggtaattatacaaaataggaacaatgtagtataataagatagcttttcggggtttttaaatgatgtctactagtatttaagaaataaaggatatttatctaaagaattgtggagatggtgaatatgatttgtctctagttttaaaagcttgtaggcttgtagtggttcttttccttgatgtagaatcatctttgtagggattggccgtgatcggagcatttttgtgacttgaaggttaaaagagaggttgagggaggtggcaaggacactggggcagattctcctcatctcattgagtaatggttattttacagggagggaaagaataaatggggtataggaagagtaaagacattttctagtgttacttgaattaactacgtactagcaagtgagaactagaaaagggatgaatcatacctgtcaaatgtgcttgatccatcttataagaaagagaatgttggaggtataagaataccccagtaaatccccctggttggcacagtcagccttgggcaacttgactgctgtttggagtcagctgcaaggcgatgggctgccaagtagagctggcagtatggacagatcacttactgagttaagctcacaattacgagagcctatatatatatatatatacttttgccaatatggaggcagtgatatatgcagaggtgatatttataggccaaatttgtgataacgatacagtaaaattgccaataaaaatctttaataggtttttaaagccaggcagtagcctgcttgtttgaacaatattcaatctgccagatttcactggagccaatgaatttaaataggcccttggcaaacactgcagcgagatttgaaccagagtacatagtagagctgaagagccctgctggcctcagaacacatgcactccagggaatgccaaggtcctttctggagccagggtgggcacagaatggctgcctgtaacctaaaatggaagaaaacaggattttagaatgaaaggcatccgagaaaagcaccttttatggaacaagaaaggatatctgttccaacttgtccaacaaggtcattcagccagttaggcaaaggtaagaccctataggactcagcttctgtccaccttattcctgatggtttttagaagattgggtaatcactcattgtctcttttcagatcagattagaaacaatagtcatgaatttgcataattggagtcgtgagtcttcgtttgtgtgcttgctgaccatcaactaacatattaaataaaaatctttacttaggagcatcctcttcatctgcctaactggtagtttccatatcctcagtgacttccaagcctcagagtctgtgcctgtgactgccatagcccctggccactgggcctcctcttgatggggaggggctgagcagctcctgggctttaaaaactgcttgctgtgacttccaggacaggacccccccagaccccacgtaattaagccttaacagctgtttagaaaatgtatcccagatttgactgctccttggttctcttgctacgacccaggtttagcctactgtagccgcttctaactgggctcactgcttcacccggcggcccgtgctccacagtgtcttgagtgttcttcgtaacctttctaactctgaggcgagtcacatcactcccctgcataaaacccttcaacagcagctgatttccctaggaataaaatccaggcatccttttatgcccggcacctccctcatcctcatcccctttcccttcccctgccttctctactctccagctgctcgaggtctccctgccctttggaacttaacaagggtggcctgctttgggcgctggcactgatgtttctcctcacatccctgtcctccaactcttttcctggccgctgcttttcaccattcagatctcaatacctcctcaccagaggcttttcctgaccgctttaggcaaagtagccttatctcccaaccccattactctcctgaagttgattttcaagcctggctatgtagtacaatcacttgagaagtttaaaaaaaaaccaaatgagtgtttaggcccctctacagaccaatgaaatagagtatctggggctgagaagcatgattccaaggcgttgctctattttaccctatgcagtggttgtctaattctggaatttttatgtatgcatgtgctcatcctccacccatctgcaaatgtggttccttgaggacatagatgttgtcaattttgaggtatccttagtgcctggggcatggcttatcatataataggaacagggtacacatttgctttgttatcaaaaagagtcagactctggggccggtgtggttgctcacacctgtaatcccagcactttgggaggctgaggcgggtggatcacctgaggtcaggagtttgaggccagcctggccaacatggtgaaaccctgtctctactaaaaatacaaaaattagccggggatggtggcgcacgcctgtaatccccagcttctcaggaggctgaggcaggagaattgcttgaacccgggaggcagaggttgcagtgagccgagatcacgccattgcactccagcctgggcaacaagagtgagactccgtctcaaaaaaaaaagagtcagactgtaaaatattggaagagatttattctgagccaggtatgagtgaccatggcctgtgacacagccctcaggagatcctgagaacatgtgcccaaggtggtcggggtgcagcttggttttacacattttagggagacatgagatttcaatcaattacatttaagaaatacattgattctgtccagaaaggtgggacaactcgaagtggggcgaaggcttccaggttataggtagagttaaacattttctggttgacaattggttggagtttacctaaagacctgggattattagaaaggaaatgtctgggttcagataaggtattgtagagaccaaagtgttcattgtacagatgaagcccttaggtagcaggcttcagagggaatagattgtgaatatttcttatcagacttaagatataatgagacatgtccaacccccacttcccgtcatggccagaaacagtcttttaggttaaatttgaagagtgccttggctaagaaggaagtccatcaaggggtcttagaattttatttttggtttacagcttggttgcctgaataatgtgtatttgcaaggaatatgggcgggaaagagaagagctataaaagccaaaagctattaaaagatgttaaaaatcatggagaccaaagctttggataaatttggataaactggtgatcacaggagagtccagttccagatttttcttaacacccacatatacttgtgtggtctgatggttagaactgtgtttttggagttagattttactttcatctctgccattgaccctggacaattgcttggcttctgctgtaacacacagaagaggtataaggagaagttatttttgtgaagtactcttgtggttaggaaccttcagtaaaagtggtaattggattttgatggtacattgtctacaaccaaacttcctgaagtatgaacagaacaattcctatgtgctgttgcttaaactttcgtagccacagagttggcctggagataggagccaggcaggagatgaaagggatcacatggggtctaagcctctgctgagtgagaataagcgaggacagagaggaggagaagaactggaggttgtccgttagtgtgattctttcagatcctttgtttcttttttcaatttgtcttcctctccccaaatctcttatatagtcctcctgccactatctaagttgaggactttgctattttgtttcatatgaatttttatttttttcttactgtaagaacagtgcagtatgtatattattgaaaggattagaaaatatggacaagcagaaaaaaatcttaaatttctaacaatttaaccacctagagatgatatccactgccaacactttggtgtgccttcttcagactttgtgtgtatgcaaaatattattgtccatttttaagaaacaaataattttctacacatcattgtgtaaatgactttttacttactaccatggatttgtttataacactttttagtggttggatagtatcctgcatatcaatgttctgtattcagtccatcacatattgttgtatattgaggttgtttgtacttttttcaccattaccagcagtgctgggtaaatatccttgtagattaaagtttgcacgcatttatgaattattttttaggataaactcctagaagtgcaattgtggtggctgaggagtaaagaggtgtttttttgtttttgtttttttctaactgcttcttgtggggcagggctaacccataggctacccagagtggccataaagacatctttgagactcttgctgtgttgtcaaattgttctccggagatgctgcactcccagcccttggtataaagtgcctttctttctttctttctttctttctttctttctttctttctttctttctttctttctttctttctttcctttctttcttttcttttcttttctttccctcccctcccctcccctcccctcccctctcctctcctttcggctttcgtagctcttccctggattctgccatcgcatctcctcaactctggtctcttccccttaagttcatttaacactcctctgtcagattaaatgttctgatgcacaaattgatcacatcactaaaattatcagatcttggtctaccatcacaggacctcataatcaggatgtgagcaactttgtagggtttttttctttcttttctttttttttttttctagtagatggtgtctcactctgtagcccaggctggagtgcagtggtgcagtcatagctcactgcagtcttgaactcctggactcaagtgatccttctgccttggcctcccaaagtgctggaattatagacatgagctgccacacccaaccccggcactgtattttctgttctagttttcctccagcaaatatggatttcttgtgattcttcatctctggtcttccttccttggtacctggcttaccttctgcccctctggaccaccatttctggggagcagagattgcgtccctagaactgccctctgccaaacatgtagaataggcattgaagtcaaactgcagctggtggactctcctcccgcatctcccatctttacttgatcacatttcacttttattgcaagactgagttcatgttcaccaaacacatcttccttctggtgtcatgtgttcgcaatttcagtaaggctttctccatctcctttcactcaacatgacagtaatctttccctcctctgaattcattgagtcatttatttccagttctcttatgttacttaacctactttttccataatatcacaatttttagtctgtattctctattatatttcagatatctccaggctaagtgctatcccttgcaaagctggggggaggagggacctaaagttacgctacagtgaagaagcaccatcatcattttggtatatatcttgtagtacctttccacatatgtgataaatgattaatatttacattgtgtaagcatagcatacagatgcaattcacttttcaactctttcttctttggcccagtattttatagtactacgcagtgctttggctattttattattacttggactataaaggagttacaaagtcgctactgttataaatggcttccagaaggagaacagcagctctaatgctttgtaaaacaaaaatgacttgcttacagaaaatatctagtagcatcagaaccatgaaatagagtagttagaaacctaccctcccctaatctctgagtggtataggcctgtggaaatgtgacttgtacatttgctttcatgttagctgacccatgttctactattagttcctgcagataagtgtggtggcaaatactgttccttagattctagtcatagagttaatcagagctgcatgattcattttaaagggaatctaacattgtcaaagaagttctgggagttgcgggtggaaaaggaactaagtgagttcaccagccaggtctgaacttgattaagcttgaattctttgttgtaacttacgttaatgctcattaaatctgtaaagcaagacggaagcactgtttgtctatatatatatatgtatatacatatatatatataaacatttttaggtatcatgctgtaaagtaatatagtactacataattattctcatggccttctagtcagattaccttgaaaatccaaaatgatcttggtgaacaataatacattatgattttatggttcatctatatacctcctgcatagatgtataatactcatatctaacaggattaccaaattacataccttttggtatcagtaacatgcctgaaataccagagtatttattggctattctcagttatgaaacattaacattgccagacaaggctttgtatatacatacatacatatatatatatatatatatatatatatataaaatatatagtcatatatataatatatattatatatatgtctttatatattataagctttgcatatgtatatggtctcctatatatgctttttttatataagccttttatatatattaagcctttctttattcagaccatgaaaccaaaaacatcccttttctagataacgcatagtgtgattctatttaatgaacctaatgtctgtgaaggggtaattaagcaaatatgattgttttcggcctcaacaaactgccagcaagttcccctggagagcagcactgtgtggctgcgtggctgtgggtgcctgctcagcagggttgggggatgtgaggaggcgtggcgactgggaagcaaagggccagaaacacatttgtcttctgtccggcttcagaagtctatagtgtggcgggcctgtcggtgaattcctcaaggtcttcttttattacagcatgtcttaaaaggaaaaggaaaaggaaacatctctaaatgaaatgcttgtgggcacttttattcacagctttaagtaacctttctttaaaaactgccagatctgtgtttccaatcttggcctctatattagtttcctcaggctgctgtaacaaagtactctaccgcaaactgggaagctttaaaaaaaaaaacaaattagttgtcctaagttctggaggctagacatccaaggtggaggttcagcagggttggtttcttctgagggctgtaagggagaatctgttccgtgcttctttcctgtcttctggtggtgggcgggcaacctttggtgttccttggcttgaagaagcgtcaccctgatctctatgttcatctttacttggttttctccttgtgtgcatgtctgtttttaaatttccctgttttataaaaaagactccagtcatattggattaggtgcctgccctactccactatgatctcatcttaactagttccatttgcagctaccctatttccaaataaagtcacattctgaggttctaggggttgggatttttggggacgggggacacagttctgcccataccagcatctctcttgagtccattgggtctcttttggcttctggctggacactgtactacatgtcccactgttacctcaaacacagtcacagttggttacattctcccacaggtcccttctttccaatttttacctttttttcttttttcttgtttatctttggtggtggtatcatcatcccactcagttatccaagttggaaatgttgggaacatcctggcctgtttccttggccttggcctccaacatccagtcctaaccacattttataatttctgcctctgctgtgtttctctagcctttcttctgcttccattcctagggcccccactcaggtttagaaccctgtgatccctggctgccaggctgtctcccacatctcatctctcctttaaattcatcttccacaccagttctttttctaaaacaaagttttgaatgtgacatttcttaatccagaaactgagtgatttttaactgtctgaaaaaaaagtcaagattctgttgcttggcccttaaggtccaccctaggtggctggcatctcgctcttgccagtcttttgctcctcatgacctgctagatggagaattggtaactcctacatgcttctccaaatacagcacatccatttgttttcatctctgtactttgcttccccagtgtagaatgtcctctctctacccttccctcctctctccattgtcaccaaaccaaagtcggtccatttgcctgcacaaaatggaaagccaaacacaaagcaccagttttttgcagcaagaaagtttattgccaggcaactgagtaaggggagaggagtcacactcaagtttgactttctctaccagccttacagccatagatttaagggagggcttctgagtgtggagtttaggtggtgaacagtgattagtgattggctgaaaggaaagggggtttggaaagtgtcttgggcatgctgttgcccttccatgctgcttcatgggttgcacctttggacagtggtggcattagcttgaactgagggtgagtttttggccctctaacgtcaaaaggttactcaacaggagaagaagtctattctgcccagactccagtcagctatgttggttccaaccagcctcagtctgtcagccaattttgtggcaaacagagagaactgtaacaaatggttttcttctctgctgtcctgcaagacaagcttaataaatttttgttagttaccaaattctttaatcctgtggggcatggtttcaccatcttcccacagcagttggaattctacccaggttaaatggaagccaggagacctggttttcaggccaaaatgtcagaagccagttgttttgcctaacccaggtcattaactttttccagtttccgtttcctcacaagtaaaatgaggaggttgaagtagataatccctaagatcttctcagctttaaaatttgttcttcaaataccatgccgccatgaagcagtccccaactcttccaggcagaataattcaccccttttatgccccttagtgctttactttttcttttacagttaactcttaatttctagtggttatgtgtgctcatgactatctccccttcctccaaacagctggtggtaagctcctggagttcagccaggaatgcttgactcatatttgccccccttcttgcctcctacgcagagtctcggtgagagagaccttagtagaggataaaatgtccttgggaagtactcccctgtaacacatgctcttcctgagtgttcccaggcattgagaagcatgtgttttggatggttaatgatacagagatgctatattgaacacactgcgtttttcctttctttgtagcattattgtaattgggtgacattctgggaaacagctaagttcactttgtaacagtttttataaaaatgtgttctctctataggatgtttagaagtaactaagttttctgtaaaatatatgaaaaccattcctattttcttcctccttccatatcctccggaaacttggagtatctcaatgtatcattaaagtatttggatacttaaaatagcagttgttaaaaaataaaatctaggaaagcttttatggacccatttcctctttggaagtcaaaacgtccttggcctctcatgttcttcctaaagcttagatttgacccacattttgaccttcggaaagttaaagtcactcctttttcctagagaagaatgaccaggcccttttctttcttcaaggccacctctggtcctatatttctaatcttattttacattgttcttttatgcactccactgtccagacaaaatctgtcactcatcagtttccctgtacactccttagctttcttgcattagccttctgcctgaagtgccctctagtctacacccattaccgcatatccaagttgtactcattttttaaggcctagctcaaatgccatttctgccacaaagacttttattaccatactagttcttgtgttatgatttgtccttcctctatacactagtctgtttctagaccagtgctgtctgcctcactagactagaagtcccttggggtcatgtttcatgtatcatttatctgtattccccttgtactagccctaggtcaattcacaggtggtcagtaaataccagtagtgaatcaatatctgtgaaccgttttttgcatggtgtataaggatactaatgcataacaaagttgctctattttgctgttaggcagtcacatcttagtctaaagtatctgcacttttattatagaacccaaaaacatgcctgaaggaagactgaaacatatatgatgctggataaaacagttatatttgaaattataatgtatttagtgtgtaacttcatggtcaatgctgtcatgtcttttagattctgtgcattattatttcagtccactatatgtaaaagtaaatgctaaatgtttataaatgttttcagtttgaattttatgttttggcagtgatatcttattttttccctcagtgtatgtttgtatatgcttctgttttccacaagctactgacttttgctttatgtttgttttatgttgcagattaatatcttttcaagaatttgttgcctttgaatctgtcctgtgtgcccctgatgctttgtttatggtagcctttcagctgtttgacaaagctggcaaaggagaagtaacttttggtaagaagcatgcttctgtgcacgtctgtgtaagtgtggacttgtgtgagcattttcttttttttttttctaggaacaaaataaagtgtatggaaattctttatagaagatagtatatcccttttagtaaagatacttcaatgttttggagctccagttcaaacatcttcctattcgaaaaaaacaagtttctggcttagtagttttgatactctgatttagttttaaggtgagggagatgtggcatgactgttttcatagagtcatagcatgtgagagccagacaggacttctgtttcttccctgcatcatcagtagtgctttccactgatagaacgaagaagtgaataatctgcctacacacagaagttacttatgcaccctatacttcttgtcttcacgttgttcccatggagtagtttgcggccagagctgctgcacaagatggtggttcagaatggtacatgaaggaccttgttctaaacaacccccgctcccccgacctgactgctgtgctggcagtgtctgctctcctgtggccttctttattttgcaaggcacaaacatcatcatgggaattagctacaaagctgcagaaaaccctgatgtttttcaaattcttagaagaaagggaaggcttggaagtggtgggacagtggtaagttattttttaaaaaactggctactaaggacagatttaacggaaagtaccatgtttcccttggactctgtggtgtccagcatatgttgtctctgcatgcaaatctgcagtagcattgctcatgaagaattttggagccctttaggcatgtggattgtgctttcatgagagatggctttaaagattagggagaatgtggcatgactgttttcatagcgtcatagaacgtgagacccagacaggacttctgcctgtcttgtgcttggcatgtgcccattttaagtgtctctattcatagtttctaattcattcagacctttgggacttgtcttatttgatgtattgtggaaaacatacagatatgggaaaaatacagatggtgtaacagtgttgcttccagaatcagataagcttagccccttccagctctgctgctgttgtctctgagccaaattagtgatcctctccagtcctcatttatcttatcaagaagtgaatataataattagataaagtattggtaagatagtataatagatttattgtgccaacccccttcgccattccgtcatactcatttggcatgacagaattaaaggttaaatcatcttgagcaaagacaaaaaattatatacttgcccggtttctagaagatcagatgctttccattaatacttcatgaggattatttaatatttacagatcctcagaagaaatttatttccatcacccagttcctcttagcaccactgcaaccacaacttttcaatggaataccaatttttagaaagtccccatttaaatcttcaagtaatgagtaagcagctagctcatggtgttattgatttactcaatggaagcgagtttggtgacattgttataatagcgtttcctggggatgaacagaggaaagcctgtgagtgtaagcatgttcagcataggtgtgttctgtcttgtcctcctactttccccagcaagtctggatgtgaggaatggaagagagttcgatttgatattagaggactgagaaatgggcttcaggtagttccttgatatagatccatcttcccttcatgcgtgtgaagtggcaagggatattggtgacaccagctttaccactggtcctagaaagacgtaggagacttccaccattgcagggcaaagtgtgtgtgttagtgtgattagaagaaaatgatagtgaagaagcaggatgtaggaaacaagagctgtctttgaattgtagaaggcatagttgcataaggattttgtttctgcttcttactagctgaaggacaagtcatttcaaccctctgagctttattttcctcatctctaaaatcggggtaataactactttacaggactatgtaaggattaaaagattcactgcataaaaggcactgtctgaaaaacaaaggcctttatacaaatagtgatactaaaagaaatagcctaaaagaggaaaagattttctgtttttttttttttttttcatttttctttgggaagcccttttttttaaaatttttttaaattttttttttttaacgtaagttcaggggtacatgtgcaggtttactatataggtaaatttgtgtcacaggggtttgttgtacaaattatttcattactcagatattaaacctagtacccattagttatttttcctgattctctccctcctcccaccttctaccctccaccctctggtaggccgtaatgtctattattcctctctgtgtccttgtgttcttatcacttagctcccacatatacatgagaatgtttggtttttggttttctgttcccacattagtttgctaaggataatggcctccagctccatccaagttcctgtagaggacatgatctcgttgttttttttaatgactgcatagtattccatggtgtatatgtaccacattttctttatccagtctatcattaatgggcatttaggttgatgccatgtctttgctattgtgaatagtgctacggtgaacatatgtgtgcatgtgtttttatgacagaatgtttatatttctttgggtatatacccagtaatgggattgtgggttgaaggataattctgtttttaggtctttgaggaatcaccacactgttttccacagtggttgaactaatttacactcctaccagcatttacactcctaccagcagtgtataaatgttcctttttctctgcaaccttgctagcaccagctattttttgactttttaatagtaaccattctgattagtgtgagatggtatctagttgtagttttgatttgcatttctctaattaccagtgatgttgagcctttttccatatgcttcttggccgcgtatatgtgttcttttgaaaatatctgttcatgttgtttgcctacttttttcttttcttttttttttttgagacagagtctcactctgtcacccaggttggaatgcagtggcacaatctcggctcagtgcaacctccacctcctgggttcaagcagttctcctgcctgagtttctcgagtgcctgggactacaggcgcgcaccaccacgtctggctaattttgtatttttagtagagacgtggttttaccatattggtcaggatggtctcaaactcctgacctcaggtgattcacccgcctcagcctcccaaactgctgggattacaggcatgagacaccacgcctggcctttcccccactttttaatggggttgttttttcctggtaaatttaagttccttatagttagttgctggatattagacctttgtcagatgcatagtttgcaaaaattttctcccattctgtagggtgtctgtttactctcttgatagttgcttttgctgtgcagaatgccctttagttaattaggtcccatttgtcaatttttgtttttattgcaattgcttttggtgtctttgtcatgaaatctttgcccattccactctccagagtggtattgcctaggttgtcttccaagaatatagctttgagttttacacttaagtgttgtttgtttttcagatgaactcttgctctattgcccaggctggagtgcagtggtatgatctcggctcactgcaacctctgcttaccaggctcaagtaattattgtgcctcagcctcccaagtagctgggagtataggcatgcaccaccatgcctggctgattttttgtatttttcagtagagacagggtttcaccatgttggcgaagctggtctcgaactcttgacctcaagtgatccacccaccttggcctcccaaagtgttgggattacaggtgtgaaccgtcatgtctggccacatttaagtctttaatccatttcaagtttatttttgtatatggcgtaaggaaggggtccagtttcagtcttctgcatatggctagccaattaacccagcatcgtttattgaatacagaatcctttccccattgcttgtttttgtcagttttcttgaagatcagatagttgtaggtgtacagccttacttctgtttataagtatcttgagatatcaacaggtatatgacagggtgttggtatgactggtaaattctagttaatttgtgattctgtatgtgaggagaaaaaattaaatgtttccatttgtatttttagcctattgtatgtgacagtgattttttaaagtacactttgttgaatgacagcatacatgcagaagaatatacaaatggtgttaagtgtacatctttctgaacttttacatctggatctgcttaccacgagccagatcagaaagaggatggtaccagcagtttagaggtctcatcccagtcactgttccccaatcccaatggtaacaactgacatttatcactatcaattggttttgcctgtttttaaacttaatttaattggaactatatagaatgtactcttttggtctggcttcctttgttcattttatttgtgagattaatccatgtcgcatgtattttttgtttttcttcactgtattgaattccattatgtgactctatcctaatttatttatccattctattgttgataaacattttggaacattttcatttttggctgctgcaagcaatatgcttttgacattgctttacatattttttggtgtgtatagacatttctaggaatagacttgctcggtcacagaaaatatgtatatttagcttcagtagagcttgctaaaatgttttccaaagtaatggtgtgtctggaattggtgggttcttggtctcactgacttcaaggatgaagctgcggaccctcgtggtgagtgttacagttcttaaagatggtgtgtccagagtttgttccttcttatgtttggatgtgttcggagtttcttccttctggtgggttcgtggtctcgctggcttcaggagtgaagctgcagactttcgctgtgagtgttacagctctttaggtggcgcttctggagttgttcattcctcccgtccagagttgttcatacctcccggtgggttcgtggtgtcgctggcctcaggagtaaagctgcagaccttcatggtgagtgttatagctcataaaggcaatgcggacccaaagagtgagcagcagcaagatttattgtgaagagcaaaagaacaaaagcttccacagcgtggaaggggaccagagcaggttgccactgctggttcgggcagcctgcttttattcccttatctgccccacccacatcctgctgattggtccattttacagagagctgattggtctgttttacagagagctgattggtccattttgacagagtgctgattggtgcatttacaatccctgagctagacacagagtgctgattggtgcatttacaatcctctagctagacataaaagttctccaagtgcccatcagattagctagatacagagtgctgattggagcatatacaatcctcctgctagacataaaagttctccgagtccccacccgactcaggagcccagctggcttcacctagtagatcccgcactggggctgcgggcggagctgcccatcagtcccacgccatgcgcctgcactcctcagcccttgggtggtcggtgggacctgggcgctgcggagcagggggcggcacccgttggggaggctcaggctgcatgggagcccacggggttggggggacttgggcatggcgggctccagctcctgacagccctgccccgccgggagtcagctgaggcccggtgagaattcgagtgcagcgtgggtgggccaggagtgctgggggacccagcacaccctccacagctgctggcataggtgctaagcccctcagtgcccagggctggcggtgctggccatccactccgagtgcagggcccgcggagcccacgcccacccagaactcacgctggcccacgagcactgtgggcagccacggttcctgcccacacggtctatctccacacctccctgcaagcagagggagctggctctggcctcggcccagagaggggctcccacagtgcagtggcaggctgaagggctcctcaagtgtggccagagtgggcgccgaggccgaggaggcgcctagagcgagcgaggactgccagcacattgtcacctctcagtggtaccagttaacactcatgccatcattgcatgatggttttattttagatctttgccagttggtatcagccatttttattttagtgatatctcactgtgtggcttcaatgagcatttatttccctgattcctaatgggttatatgacatttttccatatttattggccatttggctatcttcttcagtcatgtgcgtattttctggatacaagacctctgagggttatatgtttcacagattctttactctgtgacttgcactgtaactcatttgagtcttgaggaacataagtttctaattttaatgtagtacaaattatcagcattttcttttgtggatagctctttttgtgtcctgtttaaaaaatctaggccaggcacagtgattcccacctgtaatcccagcactttgggaggccaaggcgggtggatcacctgaggtcaggagtttgaaaccagcctgtccaacacagtgaaaccctgtctttagtaaaaatacaaaaatgagctgggtgtggtggcagcacctgtaatcccagctactcaggaggctgaggcaggagaatcgcttgaacccaggaggcaaaggttacagtgagccgacatcatgccattgcactccagcctgggtgacaagagcgaaactctggctcaaaacagaaaaaaaaaattctttgttttcctccgggtcaggaagatattctcctatgttatcttccagaagtttgctttcctttcagatttacattttaatctttctagaatttgttatatttttgcatggtactaaaggtaaaggtcaagattcttccctggccctcttccccaaggatatgtcgattgcctggcaccatttattaaaaagatggttcttttctttattgcactgcagtggtactactatcataaatccagtatgggactgtatctgaatgctccattctttttacattattgtatattctccgctaatactatactatcttaattactacagctttataagtcatatctggttaggttttcaactttattctttaagattatctcggctattcttggccctattcactatcaaaacaattttagagtaagtcattaatttccacaaacatcctgctgggatttcacatgctattgccttgaatatgtataatatctatatgtatatgtataaataaatgttttattcctttaagaatttttaaagtttttaaataaaagtttatttaataacaagtgttagtctgtctatatctcactactctggaaattttgagttgatgaacactacaaattttgaaagagaaaggaacacatctatgttatttgttatctaaagatgctggtgcatgtgtacaattttgcagataggactactgccaaggatgaatcagtgctaagtacctcagaaggaaggtagtagaaacgtgagctgaattttatatttgagataacaaataagtattaccttcttaaaagttcataaatatttcaatagatatattttactacatattgaatataatacatttaaagaaacttcagaattatgtgagttggaatgttaccaatactgtcaaattttggttaccatagtggatgggaggggtattcaaagggagtaaatcatggtggaagacaagcagggtaagaagaggaaagaaaaaatgatattaattgcctagtcatttgtaaccaaagcagagaaataataaataagggaataagctgtcattatattaattataaatctgtgctattatgtgaggagacatttacacaaatttgtttttgaaatttaaggtcttttctctttaaacttagtgtttcgaatgtcaacatagttttctttttctttcttttcttttttatggtgttattttttatactagatcacgggtggcaaacattttctataagggtaagatagtaaatgtgttggtgcagtccctgtggaaaatagttatggagattctgacaaaaatttacaaatagaagtaccatatgatccaccaatctcacttctggatatttatccaaaaatcaggatctcaaagaggtatcagaactctcatgttcatcgcagcactgttcgcaacagccaaatgtggaaatgacctaaatgcccatccacagctgaatgggtaaagaaaatttatatacatagaatattattcagccataaagtcctgccatacatgacaacatgaatgaaccttgaggacactacgagtgaaataagccagccacagaagacaaatattacatgattctacttatatgagacacctgaaataggcagattcatagaatcaaagagtggtggctaccaggggctgtgaggagggggaatggggatttactaatcagccggcataaagttttggttaagcaagatgagtaagttctagaaatctcctgcacaacattgtgctgatagttaacgatattattttgtacacttaaaaatctattaagggtagatctcatgttaagtgtttttttccaccaaaaaaaaaagattttattttcattttttgaaagaggtgaggtaattggtcgtgtagatatggggatggaggaggggagactgtcgcaggcagaaaataatagccatttcccgggttctaagcgcggagtctgtttgatacatttgaggaacgttttagggagagagactataaacaaatacaaaaaatatgatgtcagaatatcctgtttgtatgtaaagcaggctaagtgggtagaaagcatggaagctatctgagcagatctagaggagtgaccaaagatgcattaatactgaactggcatgatatgggctttgtattccatgaagggttggagctgtgggggtctggaagtgatggccactttggaagtgccacaaacagtggaggctgggaataacagaggcctggactggagtcatatctcgggaccccacctgggccattccttttttttttctttcttggtttctttcttttttttttttcttttgaaacaaggtctgtcacccaggctggagtgatctgggttcactgcagcctcaacatgcctgactcaagtgatccttccaccttagcgtcctgagtagctgggactacaggtggcgctaccatgtccagctaactttatttttattttcgtaaaggtgagtttaactatgttgcccagactaatctcaaactcctaggctcaagcaatcctcccgccttggcttcccaagatgctaggattacaggcatgagccactgcacactgggctgttcctgagagctaatctgtatgacttggctcccgattggccatgggtgagaggaagggggccaaaggaaaggaagaagaaccaggtggtagctactggtcttgttctgttcccaagatatgtggttttacataatctcatgagagaagtaaggtaaccatcatttttattttaaaatacatgccaacctctgggctaagtatttttggtataatttattatttaattattgtagcctagaaggtctatactattataattctcattttctgtagaggaaatagacatggggaagttgagtaagtggccacagtcatagtgttgcctgtgatggagctgggagagcagcctgatcctggctgactgttcttcactgtgccacactgcctccctctggtgttgatactcatgcttttggagcaagcccactgtaatccagataggtgtcagttagcccattgtggtctcagtctgtatcagacattagaaggatttaatatttttcatgaagtaaagaacaataggcaaatgcattagttacgattttttttcactatggtggaaagtaataaggaagagaacgtacctggcttagagttaccagtgtacatagaaagttgccttggttccagctatctggataacttgttgagatgcacacgatgtgagttttacccagaaaagctttatcttttgatatgaacagaattctgactgaaggggagaatcacaggacgatagggaagggtgaggagatggtctgtgtccaggttgaggatagaggggaaccatagtagaggaggcccttgattgaggggtgcagcttaagagacctgagtacttgggagggtggttgtcagggcaccaacgacagggccgggcccttaagcaagagtaattatttcatatgagaagcaattaggagtcactacaaggtctttggaggacagggataggatcagaatgatgcttggaagagatgatttttgctgagttgactagagtggggcaaagccaggggtaccatgccagtgatcattatttaggcttcacagtatctatgtgaagccagcgtatagtcaccccactttgtgagtggaagagctgaaagtcagggtttggaaggacttacctggtgtgtgagcaggttggtacagacatgttgtgagtgatagtttctcagacactttcctgttactgtatttcttatttaatgttgcggggggtgcaaaacatttccattgtgggttttaagaaagagtacctgtgtggatgtgtgggtgtgtttaatgaaactgtcgatctgaactatttggcatatataccagtgatgtatcttataatgctaatttaagacattacctattcctacttactgatatttcttaagttgttgtaccacattaatagcctagctccacagtagcagagagattgaatactacttttttttttttttttttttttttttcagagatggagtctcgctctgttgccccggctggagtgcagtggcacaatctcggctcactgcaagctctgcttcccgggttcaagcaattctcctgcctcagcctcccgggtagccgggactacaggcgcacatcgccacgcccagctaatttttgtattttagtagagatggggtttcaccgttgttgcccaggctggtctggaactcctgagctgaggcaatccacccgcctcggcctcccaaagtactaggattacaggcgtgagccaccgtgcctagccgagagcttgaatacctgcttttatctgaggaaagtcacaagtagaccccctgaaaattcaaagtatgatctatacaataccagtttcttaggttaaactcccaaatgttttcttgcattatgctattacatgtttctctcttcctttgactttttaaatttatttttcagtacactgaacaagatttcatgaaatatgttttacgtgcaattttaaagttatccttaatacctgaatgtaacccaatttcattacaagtgttggtggtaatgatggtgtgtgcatgtttatgttctgcagtttttaattaaactttaaagtcaagggttctcaactctttgcctggataagtatcagggagtctgtgaatggctatggttgtttgtaatatttcgtctaaatgagctttttttttttcctggggaaaaattgtgtaggttttagcaaatctcacagaggtcagtgagctgccctttaaagataaaagctgctttttatagaggggcagttgaactagtagacatatatcttatttaacacttttccagcattgctgttaaagacattgattgtagaatagtttatgtatgacttcaaaatgtaatgataatcagtttttggatgccttttggttttggatatatgaagaaacaaaatgtatcagacaacctatatataatacaagagacagattggaaaatacatttttctgtaactgaagtaaatgtagagtaactaacgaattattaaaaatacaaaaagagccgggcgcagtggctcacacctgtaatcccagcactttgggaggctgaggcgggcggatcacaaggtcaagagatcgagaccatcctggccaacacggtgaaaccccgtcgctactaaaaatacaaaaattagctgggcatggtggcatgtgcctgtagtcccagctactcaggaggctgaggcaggagaataacttgaacccaggaggtggaggttgcagtgagccgagatcgtgccaccacactccagcctggtgacagagcaatattctgtctcaaaaataaataaacaaaataaaatacagaaagaactgtttggttggctggctagtgagacctctgaaagggaattggttctgattctcatgaagaccaaaatggaagaaactagtctacaccctgtgccacactgggaggcctgggctggctcgccactgcagctctgccagttagcatggagtctgaaagaaactggtccagttttgccctttattggaaactacagtgaccttttgtcctttaatcttcactattgaaatatattgtaagtttagtaactatagagaagcgtttcttgtttatgttaataagtggcatgtggaaaagggctctcctaagagagaatcataaagcctggaacttttaatttattaaggctctgagaagtcctgcggaaaaaataaatctatttaactttgtttaaattgtagtttagcaaacttattatatttgcaccaacttttctcttgtgtctctcccactaaacaaaacccacagaaccggggcgatttctaagctagttaattcttaattctaagcgagtcctcagttagttaattctctgatgtggatgtaattgtttggagggaccctttctgagttcaacttagattgtgtccaggaacacctgctatgatgaaattggtgtgctttgggaaaatgggtaggctagatgacattaggaaatgtgtggaaacacccactcagtcacttcgattcaggttgcagaaaatgatgggagttaaaagtatggaaatgagaagtttcgaagttaagcactcaaatttaatattaaatatataaagctagaggaatgctggtattggattggaagaaggcagactttacccatcatttttaagcttgctggaaaggaaggtcatttgttactgtctttgtaaagacacttcgaaaatgaaatattcgaaaagatagctgagggagaaggtggtgaagaatcagaagaaacgttacttggggaaagttcttcattaatattggttctgattttggtgtttcacaaaaataatgtgtcattttgatgaaagaaaaatattgccctgcagtagatttgattttattttatgagaggtaaagagggggctgagtatattctcttatacatgcttacatcccaaatagagagtaagaatttcgaataagaacagtatgagttttgaaagtaaatagtctctatgttgataagaattgtggcatgcctgggtactgagtatcttttcagagatcctagagactgtccagaaactgttccagttcattgggtcaaaaatccactatttacgaaaagctaaatacggatttgcacgattgaccataatggcttcaattttgaaagatagtagtatcagagagcacttccagttggtgggataatttaagaatcgcccgtgctcaaatggctaaaatattgtactttttgctacttcatcactccattttaaaaatagagagggggagaaaagaaggcagacctgttgagaaggtggaagaatgtcagttggagagcaaatcaaaataaccatgtgaagccactccttagttaactactgcctgaaggttaactgttccttagaagcctgtcagggagtggagagactggactgggggctgctgtccctgtgtgtgcatgtgcacctgtgtgtttgtgtgtgcatgtgtgtgtgtgtatgtgcatgttcatgtgcatgcatgatgaagggtgaagagaacttgtgagtaggaaagaaggtgtagagaacagaaagctaacataaaatcctgaaacttagagtcctaggaaaatttgactattttaaactaactgtactgcttatttaaagataggaaaattataccattcttcttctggtataagagagagataaaaatacagtttttctaaattggaaaatttgctgtaatcttgctgctaatgactgatttcttccaacagttgcaaggcagtttttgctctgataggttgataaaggaaacaaaatcaagaacatattggaaattctcagagaaaattacagtttaggtatatgttgggggtggatacttagacattttaattgaaataaaacagttttatactaatatgggatcactgtgggtgtacatttgtagtacatctgctcttgaagcatttaagtagggttaaatgtatgttaatgcttttgcaagaaaattttcgataatatccgtctaaggaaactagcttaggaaataggtttttgaaaacaatatagatattatatttgcatttagagagtgaattaggactctgtaatgctttaagaattttaaaacattagttgtattctctagtggtaatgaaagttaacaataattaacacacagcagatgattaaagcaagcttacacatctggagagtggccacagtctgctatatgcctctaaacaccattttaattgacctacttttgatattatgaaaggctaataatgatttattctacccagttgaaaatactttttctagcagataattggaaacatctcagttggcccctctgttgatttagttagtgtgtgtgacagatggttaatatcttacgctaaatatctgccagccttgagccattttgttgttgttgttgactcacagtcactatgatgacttaaatagtgtatgaatcttgagaattgatagatctgtcagattatagaggaggagggagtcttatcaatgaggtagaccatgggttctcattgtaatagtgtagaatgttggttaactgtggactccctggctctgtctcaaatctactgattcataatttttgggtgtggggcttgggaatgtgttttaaacaagctctccaagggaatgtagttcctacttcaaatgaacaatggctgagtatagtttatggctttctttcatggatgaggaaacaggcccagaggggaaaaggtgactagtttcataagaatcacaactttgacttctggcactagaaggatagggttctttcctgaatgccacatgaccttaactcaggctagttccatccctaagtacagaactggaagagttttaaattagccctaatttttacatacaccaataccacatatgactttagtataatatttggctcagcttggctgtgtgtgtgcttattttttgaaagatacctatcaccactgtacctacatgttcagaataataataataaaaagtttacaggggattatagagaactcaattttaatgtgaagtacttatgctctacttactatgttttaatggcaaccattttccccctagaagtttcttgagcgactctgaattgtagccagaatacgtctttcctcttcagacccttagctgtgattaatgtaaaaaggcacttgtcaaaagggtttgaaatggcaaccttgatattggagcatatggcagtagagataggtctgcatccacttactccattatgttatttaatgtacgaattcaacaatttgtcttttgctccctgcttaaaagatgatggccgtagaagctggttgttaaccatatcagcagggtggaatattacttcccttagagaaaaaccacaactttctttgaggatttagcatgcattagaaaaagcatgaaactgttcagagataaaatgctgggccttcagcagtcctctctttgcctccaagaggggttacttttatgtttaacacaaacatcccttttgtgtttattgtattaatggaatttttaaaatccatgagaaagagagagagattatggtttagtgtttgaaataatatagcttgatgaatcttttttattttaatgagaaactctttttcatagatatgctgcttcaaaaagtgaatcttttagaaattaaaatgcattaatttagttattctgtatggaaacaaaaacatggaaagttaaaatttgcataagtgaagaccttgatgatttcagattatagtgtggtggaggttaaggaataagagtccatagaatttgtaaaaacaaattcagtctaaccacttaatggcatgtgcaagtaatttgccaattaaatatctctagtgtctgaaagatcttcagagaaaagagtggaggttcttaatctttcttaattttatactttaagaaacataatagaaaattacttagtttttgatcacttttcattcaaaattttagcatatgagctcaagaaaggatggattttaaatatttgaggaaaattattgctttttgagaaattaaaaactatgatacttccaaatcacactgtgctcatttaaaaaatagtatttgtaaatatttggtgcccagataataattttcattataattaagactttatactttggagttttatgattttgatggtcacctactatgtttagaacattgtactagtcatgcttaactccagaaaaactgtctaagatagatattcccattttaaagattgagcgaattgagtcagagtaagtaatttgcccagggttactcattagtaagaggcagatctctgacagttctaggtgttttttgtttttttttttcagagaaagctttgttgagatataatttacccatttaaagtatataattcaatggtttttaatatattcacagatttgtacaattatcaccacattcaattgtagaacattttcatcaccccaacaagaaacctcgtaccacaccttagcaatcaccactcccttccatccagtccctccatcccctggcagttgttaatctactttttgtgtatatggatttgtctattctagacatttcatataaatggaatcataaaatgtgggctttcatgattggtttcttttacttagcataatgtttccaaggctcatccatgatgtagcacatatgttattcctttttattgataaataatatttcactgtgtagatatagataggtcacattttgtttattaatcagttaacaggcataagagctgttcccagtgcttggctattatgaataacgttgctgtgaacattcatgtatgtgagtttgtatgggcatatgttttcatttctcttgagtatatacctgagagtggaattgctgagtcatattataattctatgttgaactttttgaggaactgccagactgttttccaaagtggccacaccattttcttaaatatattcccaccagcagtgtttgagggttgcagttccttcacatcctcaccaacacttcttattatctctttttgattataaccattgtagcagggtgaagtggttatctcatcatggttttgattttcatctccctgatggctaatgatgtttaacatcttttcatgtgcctcttggcaattttatgctgtctctggagcaatgtctgttcagatcctttgcccatttttaaataggattatttgtccttttattgtattgtgagagttctgtgtgtatactagggttccttatcagatatgtgacttgcaaagtttttctcctagtctataggctattttatctttttcttttctttttttctctcttttttttaaacttttttattttaagttcaggggtacatgtgcaggttcattatataggtaaacttgtgtcataggggtttgtcgtacaaattatttcatcactcagatattaagcctagtacccattagttatttttcctgatcctctccctcctcccaccctttaccctctggtaggccccactgtctcttgttctcctctgtgtccgtgtgttctcaccatttagctcccacttaaagtcagagcgtacagtatttggttttctgttcctgcattagtttgctaatgataacggcctccagctccgtcgacgttcctgcaagggacatgatctcattcttttttatggctgcatagtactccatggtgtatatataccacattttttttatccactctatcgttgataggcatttaggttgattccacctctttgctattgtgaatagtgctgcagtgaatgtacacatgcatgtgtctttataatagaatgatgtatatgcctttggatatatacccagtaatgagattactgggttgaatggtatttctgtttttaggtctttgaggaattgccacactgtattccacagtggttaaactaatttacactcccaccaacagtacataagtgttcctttttctctgcaacctcaccagcatctgttattttttgactttttaataaccattctgagtggtgtgagatcgtatctcattgtgttttaacactttctttttttcttttttttttttcttttgagacagtctctctctgtcgcccaggctggaatggaatggcatgatctcggctcactgcaacctccgcctcaggggttcaagcaattcttcctgcctcagcctcctgagtagctgggattacaggcacgtgccaccatgcctggataatttttgtatttttagtagagatggggttttgccatgttgcccaggctggtatcaaactcctgacctcaggtgatccgcccatctcggcctcccaaagtgctgggattacaggcgtgagccaccgtgcctggccattttaatactttcttaatggtatccttggagtataaagttttaaattttgatgaagtataatttatttttttttctgttgcttgtagttttggtgtcaactaaaccatttcctaatccaacatcacaaaaattatgtctatatttttttctaaaattttcttgaaaatatgcctatattttcttctaaaactattcacggttttaagtcttgtagttaggtctttgatccattatgagttaatttttgtatacagggtgagataggagcccaacttcattattttgcatatggatattgtccctgcaccagttttttcttattgtctgttacctttgttggaaatcaattgactataaatgtgagggttaatttttttactctcaatttcattctgttgttctctgtgtctatcttataccagtactacatagtcttgattactctagctttgtagtaagcttgaaatccaaattcgtgccaggcgtggtggatcaagcctataatcccagcactttgggaggccgaggtgggtggatcacgaggtcaggagttcgagaccagcctgaccaacatggtgaaaccctgtctccactaaaaatacaaaaattagctgggtgtatcaaagcgcctgtaatcccaggtactcaggaggctgaggcaggagaattgcttgaacctgggaggcagaggttgcagtgagccaagatcatgccactgtactccagcctgggcaacagagcaagactccatctgttcttctttttcaagattgttttggctcttctgaattgcttgaattttcataatggattgttggatcagtttgccaatttttgcaaacaagccaaccaggattttgatagggattacattgaatctatagatcattttagggagtattgccattttaaaattaactttggagagttttgccatcttaacaatatcaagtcttttaatccgtgaacatgggatgtgtttctatttatttagattttctttagtttctttcaatgctgttttgtagtgtttagagaatcagttttgcacttattttgttaaatttatttctaagtattttattgtttttgaggctactgtaaattgagtttttttaaaattaattaattaattaattaatttttttgcaacggagtctcgccctgtcacccaggctggagtgcagtggcactccactcactgcaagctccgccttccgggttcacgccattctcctgcctcagcctcctgagtagctgggattacaggtgcccaccaccatgcctggctaatttttgtatttttagtagagatggggtttcaccctgttggccaggctggtctcgaactcctgacctgaaatgatccgcctgcctgggcctcccaaatgctgggattacaggcgtgggccactgcgcctgaccgagttgttttttaaatttcatttttggattgcttatttcaaatatatagcaatacagttgatatttgtatattgatttttctgtcttccaaccttgctagacttatttattagttctaataattttttagtgatttcttaggacttttctgtatataagatctgtgacccaacttttaaaggtctcaactcttttcactataaccataccctgtagcctgggaaacttactaacttgggagaaataggttgactttttgaggttatctttaggaagtaaacaactgccactttgtaattgtcttctcatgatataaacaaatgcggcagacttttaagatggaaacttttgtggagaaagcaaggttccacaagtaaaaggaaccttgagcttatttggtgaggtcttactttaaataatatcactattatttggtgatattatgggaactacaggccttccaaacatagcttgtttggcacagactgaaataacaacaattatactttactttaaaaaataagcattctaatttggctttacttttaggaggagtggctgaactaagaaaaatatgactttatatatccaaaatatatactagtgctacatgcacattttaatgctaattagttttgtttctttgcctatatgacctcaacatggggaaaagagtataagccttgtattttagaccagaagagacctaattctaattatttttacatttgagatagatctagcaggtggttcttacctgaaagtcttccacgactgagttacgagttattctgaaccaagtaagcaaccaaaaaagctaaaacatgttgggtttcttctttcctctccaggactgcaagttaggtttggaatggtcagggaatggtacgggtttggtgagagggcaactctaagtttgactcctggagtctttcatagtaaggctcatggaattgcccatgtgggagccagagtatagagtagaactgggcttgaaaatcgctttggattttcatttctgatttttcagctataaaatgagagctgggacttgttcctcttacctctgagagccttacaagacatagaggaatcttaaacaatcaaatgttaagtgagaaagctatttgtgcctcctaaaaggagaaaagaatattaacctgacgtggtattataatgtctcccagagtgagggagaaatgcaaggaacccatagtgattattgagtttatagatgtttctattcatgagcctgcaggaaaacgtagagaccaaacatttcagaaaatgaatgccctaggatgattcattagagcagaatgaaatattcagaaacttatgagtctataaaatatttttggagaaaatgtgtgagttttccagaggaacaagatttaatattttgttttaaaagactttattagttgtgagatgaatagaaatattggtaggtttcctttaatcttttgcatatcatttggcttctccaattagaatggcttggcaatcttatgatatttgagtacataatcctgctaggtaggtcaagagagtaaaaagtaaatttcgtagaaattatgccaagtggtaaacaacttcaggcctttttttccctgcagagtcccatggccaactgttctttccatagcaaacttttcttcaccataaacatagcatcatgccccgggggctttaaaataatgtttgctgctggcaggtgatgccaatgtctgtggctacctggagcaggatctatcatgtctcagtgatcccaggtggctttggtccaaagcactgtaactggacctttgattcacttcaaaagaaatgaacctttcttcatgccattgatcgccattgaaaagctccctcaaaggtccctcttagtaaatccttgacacctttcaggtcccagatcatggtttatctgctccagtaagcttttctctcttacttctctccttaaatctccatttccttaccatgaggccaccctgtggtttagtgctgatacagtgtactgtttgaatctgctgttgaattatttctcaagtattagacttggatgtagcctcataccttttactacccttcctcttcccacaggacctagtacagtgctcccaagctgtgctacttagaaggttgctagctagctagctaagccctgacattcctacaatagccagtatattggaacagccacaaagctaataatgggcctacatcctcagggtcatgtgtttgatacactccccaactccaggaggcaccagtcacatggaccatgaagtgaatgccatccactagagttgtgcagcatgggagccctgaatgacctaggtcacacatgatctgtgtttacacattcctgcattacactgcttggtctggagagtcttctctacctccttccttttaaatttttatccatttcaatgagaagttaaaaattaggagtgaatctaacccttccatactccctgataatgctttcagaatgaggtcctggacccttgcatcaggaaaacctggagtgctggctaaaatgcagttttttcagcccctcaacatgtttaaatcagtttaggaccgggcctggggattttgataaacgatgttgactgatgatttgtatgcagtgcactgaagtggtgagaaatgactgttgaatagtttctcagcaagggaaactgtagtgccccaaagggttaataccgctgtccttaacctgttgcattatctgttgtaaaccttttctggctcatttaaattcagcaactacttagtgagcagttgctctctgcctaccactgtgccagccatagtggtagaatcagatgcgaagaatggggtctttgctgtgaaggggctaataatcaattaggaaataaaagacgtgcaataaatatgcacaaacacattaatatgtgcatacatatgcatactatgtaatgatttatattacatcatatagagatcttttatatacatctagtatagtatactctagaagatttatagagagatcttttttcaaacaaatcattattggtagtacaggcctataggattgtcagattttagatctgagagatatcttagggataatgtatagctctatcctgcagaggagatttcagtacatcagccaggcatttcatagaggcacacacacagtctatggtgtagtccaaaaaactatagcgtttagagtttcggattcaaatgtgagctctagtaagaagtaaatggtagttactttaattatagataaataagattgttgtttatggtgagacacattttacatgcattcactaattttagaaaaacttaaacctactttcatgtatatttataattttagaccatataaatataaaaatggataataagtgccttagctttacataccagctatttagtaaaaaccttctgttactttctatgggaaacagagattgaaggagagatcaagaaggggaaaaatcttatttttgacaattatcctatgattattacgttaaaactttatttcactggaatgcttggcagaaaggaatttttaagttaactgaggataaaccagaaaaccattttttcttgcatattatttctctaaaattttattctagtataaaattttatttacagtgtgaattttttttcttttggtcacatctttatcatttgagcattattttcattagataatttattcatctagattagaaggttatgggagcctttattaaaactttattgggcctgcttcctacagagatacagacacttacacctggaaaggagtcacagattatctcggttaatatgttttgcactgaagaaagtcatgttttaagatattaagggacttacagccattagaacaatacttggcacatggtgagtgcccaagaaattttagctgctgttagtagaatttgaatccaagtcatttgaatttcagtttggtgatttcttctcagaaatcttctacttaattccttttattgacccctggtcagactcactgagaatcttttttgtttgtttgtttttcctttaaatcctaattctggattcacttcattttccttatatcttatctcttttttccctaaaagtaaagaagacagaataaattcagtacttgtactttaaaacttttattgtcctcatcagggccagtctgaggatttctgccatgttttataaaatttatgcccagcataatcctgattttttactgccttctctgtgcaaatacacacctaaccttatgctaatggtggcactactgtttcttcatgacaaggctttaaaaatttctggaaactttaaaaacgtggaataaaaactgtgggtataatgggggtgggagcaggaaatttgaggggaaaccatagacacattatgccaaaggttttggcacttttcagaggactaaataactttcttcttctttttttgttttaaatagaagcaaaagagaaaaaaaggtatcaagcacagtttgctcatagaaatgagcaggtttggtagatatatttaaagatgtgaaagccaggaaaaattattaatatgctaataatttgtatttcctccattctccaaacacatacttttatcaagaggaggaggctaaaaataaaaatagaagctttagaaaagtaaggtttttcatgtttttttcttgtttgtttgttttttctctgtcagtcctcttacagtttttctgtagaggctaaaaagagatcctaagccaggaccagcacattcagtggcccatcttaaatgggattatttgaacaatttgagaactcttgggtcaagccaaaagagtgcagtagaaaatcaaagacttgggctgctgctggcttttctcctcattttctttgtcttcacgtgcagctcgataaagtgttggactttttcaaacacagaaacagccttaggggtgttaaatatgtgtgtcaaattttttcctaatggatttctaaatcttccaaaaacttttaaataacttgttaaaggctatatgtaacgcttgtatcgtgtgtgtgtgtgtgtgtgtgtgtgtgtgtgtatgtgttttcctgccactaagattgaattctgtcctctgtacctagaaaataatcattatttcttgaaacaaaaacaaatgagatgataatagttttagctttctacttgggtttcctacagcctttaggttgtgtgtgtgtgagagacttcttgattttccccccctttattttatttggtgggattcttgaccttgatttcttaactgattccttgagggttcttttatttctgccatagtttgtaatctgtatgtctatttaaaattgaattactttttttaataagaaaaagcgatatccattcaataacagattttatcagaaagaacttcatttactttgttttaatcaacctgtcttttctcttttcagaggatgttaagcaagtttttggacagaccacaattcatcaacatattccatttaactgggattcagaatttgtgcaactacattttggaaaagaaagaaaaagacacctgacatatgcggaatttactcagtttttattggtgggtctagctcttaaaaagttaaaagggtatggccgggcacggtggctcacacctataatcctagcactttgggaggccgaggtgggcggatgacgaggtcaggagatcgagaccatcctggccaacatggtgaaaccccgtctctactaaaaatacaaaaaattagccaggcgtggtggccggcgcctgtggtcccagctacttgggaggctgaggcaggagaatggtgtgaacttgggaggtggagcttgcagtgagctgagatcgcaccactgcagtccggcctgggtgaaagagcgagactccgtctcaaaaaaaaaaaaaaaaaagttaaaagggtaaataagtaaacctggaatcaaattgtgtgtaaaagtcctgattggagtcttgaactgtgatttacttactacatactgtgatttacttactacatacttactacagtttagcctggcaaaactgtcccattgagaagtatttctttattaatatgttgaaatcatagaattaaatgggatttccacagatttatgtagaactcctccatgtttagaaggaatacacattgaggccccgggaaatcaagtgattttctcaaggtcacttagatcaggaggggcaaaattacaacttaaaattttggcttgtgactcgctgtgttactacttaccaatattttgttttcccctggaaatggacagatttgtcttcagcttcagaatcatttcatctgacaccttttatagataagacactagtctcaaacttggctgcatgttggaatcacctggaagctttaaaaactaatgttgcctcagtcccacctctagagattagatttaatgggggcaggggggaagcctgggtatttgagggctatttaaagcttcttgggtggccctcatggagaaccagtgtgctaagggcacttgcgcactttcttatgtgggttaaccgctgtagcagttgtctacatttctggggtgcactttccctaacccagtccctgctgcccttctctcgtgacccccttcccccacccatatgatcatatcattgggccactgatgatgcaaggagaagagtattcacaaaatatgattataacttagttttccttcagcagcattatttaaaaatactttaaatacaacattatcatgtagtcactagaggtcaatatctataggctatatagatgtttatgcatttgctttgtttctaacagttacattttatttatactttattaaatatgtttaaaaagactcatgtaaggggactcatttggtatgtttacattttgggtcttgaggaaaattttcaattctttgttactagaaatgtccttagtgggtatcctggtgcccctggctttttcgtgtgttccagaccttgccagagccctctggggagtggttggaatcctgttctgggtagaggtggagggtgcacgggttgtggtgctcacttggtaaagattttgtggtgtccattcttagcaactagcatttgtgataggttaacttcaataggtacttctctttttgaattttcatggtattattatgattcatataatttgtcctgctgtctagtttgcttttattttccaggcctttggaaacataaacaagatgccctaaacctgcctttgtattttttaaaaacaaagcgttaatgtctgtgaatccctgttttcagttctctgtaaacataaacctacttacgtaactcagatggagaatgtaatgtgagttgccggatttttgctgctgtttccacaggacattgttgtgctgtaggaggcggtattcattttgatgaggaataatgacaataatgttattgagacaaatgcctcaaattgactttatggaacacagcctaattaacttttagttttaatgggatgttagcagtagtaaggatgatcgtgtttcctcctctaagcaagtgtcaattatactgaattgagtagattttcaactgctcacagcagcctctgggccttcctccagatatggggaagccagagtccaggattaaataactcagggactatggttatgtttccaaacaatttgtaaggcattcacttaaatttgacttataatggtaaatggaaacatcccacagtgtcctatgtgggatgattttgcctctgtagccagaatagaagtactgaacttttactagattacaatggttatagtggtgaatgatctcagtcagggccttgcttttgtgtcctagtccagatccggacttataggaattaatggatggaccatgataggctttacctgaatgccagttttaatgtctaccattgggtttcttccttccttccatttcatgttttgtttgcttcatttgaactcttttctgaatgtaggtagagcttcagacctctacttcagatgctttgtttgcttcctttgggctctttctggatacaggtaacttcttaaagatattagtgaatttaatctgctgtgtttcaggctcttgctttgtcaggcaggtatccgcctttctgttcttgggcaggactcagaaataggcaccaactccctggctgatgccaaagctgtgaaggcagatgcttggttgcttgaaatgtgaacaagctgccactgtgcatgctgctacctgtcacatgatgaggaaggggagcagccgtagggacagccaaaaagtgcttgtgatttcagggaacttgtatggcatgtagagacagcactcctctattccactgagggtccctagaagatagctcaggttggttccggccagcacattacctgtgcttattatgtatgtatatacatgtgtgtgattggtggggcagtgcagttctctgcagttcctttttttttttttgtcacttaataaatgttttactatatctaagcaagtgtgagcttcttagaaaccaccatgtggctgtgaggatcttacttgggtcatgtgtttatctgtgtagagtctggacaggtccccacccactaaggtgttggcagtcctgggcattgcttacatggtgagttgctatgtccttttctgtgctttggttgtaaaagtcataaagtggtgaatcaatttgatattatttgagctaaacttgactgatttgtactttgcaagtggtaaatcaattcgatattatttgagctaaacttgactgatttgaactttgcatctagtaacattgaagcaagtggcagggatacaaagcctccttcctgtagtcttcttcctcattggaatggaaagatttcagcagggagtggggtcacatttctcttaccccattatttatactgttacatctgttgctgctattttttaatgcccagttaacttcatctccatataacttcatgaatgatggtatgtgtgaatgtgaatacagttgtatatgtgggtaggtatgtgtattttaaaatattctgtaaacctctccacgtatgtctactcccagctcctagagcaaagcctctaattttatagccgctagttttaaaatagattttaatattctttgtattttagaaaataatttggagaaatttttctattctaatctgatggaactgtaattgataaatagtattaatgggctgggcgtggtggctcacgcctgtaatcccagtactttgggaggccgaggcgggtggatcatgaggtcaggagttcgagaccatcctggccaacatggtgaaaccccatctctaccaaaaatacaaaaaaattagctggacatagtggcgtgcacctgtaatcccagctactcgggaggctgaggcaggagaatcgctgaacccaggaggcagaggttgcagtgagctgagatcaggccactgcattccagcctgagcaacagagcaagaccctgtctcaaaaaaataaataaataaatagtattaacctaaaactcggtattttttgtgtgtcatgatgattactcatgtcgggcaaaccatccaattcagcaaatatttgctgagcatgtcgggtttgtcaataggattttgcaaaggtttgaaaggtgcagagactataatcttgagacactcataatgtaaaaatctaggacttgtatctgggtatatccacctgacagtgcaaaaggagcaactacaagtaagtataaaatgtttgccctatgagtttgttgttttgtagcaaaaacccttaaaggtttgtggcataaaccctaatggcaggtattcacatcctttgccaaatttttttttcctttttcttttctttcttttttttgtttttgagacagggtctcactctgttacccaggctagagtgcagtggtgcattagcgctcgctacaactttgaatgccagggctcaagtgatccacccgccttggcctctcaaagtgctgggattacaggcatgagccaccgtgcccagcctgctttgccaatttttttattgggtgactgtcgtaggcacttgggggcacagaatgaaaggtttctaaaacttttctaccaaattattgtgtagtcagtactgagtcactttcaaaaaagttacaataactaatatctgtataatgtttataatttacaaagtgcttttaaatattatttctgataatagcatcctcccaataacctaaaaggtgattatcattatcacatattgtatgcaaaagaataaacctactctatggtaaaattttgcatttaccagtaattttccagggaaatggcccatagctttcattatgtttccaaagaagtatcccaaaagggtggtaaagagcagctgttctagagcttagcttctgcagtcagatgacaggtgtgtgacaaattcaagaatacgatgccgttcccactctgttgcactttctccagatctaaggctatagacagctattttctgttcctagaagttaccatgcatctgaatggcagtgcccagtcatgcattgctaaacatctagcattcctgacccctacccattaattgccagatgcgatcatcaacaagttcttaggggtgcattgtactgtcatttccaggtttttttgtttgatactgttttataatcttgggtatctattttacatgtaattactttaatttgaaaacagtctacacataggagtttccactggttccaatctcaggatagaaaagtctaggattactacaaaattcaatatttctgttaactagaacaacattgttattagctacctctcatatagcattttctagctaagaaagttcttgtattaatatttgtccttacagtcaccttaggttgttggtgttgtttccctatgaaagctgagtgaacagaagcctaaagaagttttctggatttgttcaagattagacaggtggatttgaagttgaaattaatttttctaaatctctggcagtttttaccccccaaattttagtgtaaaaattatctgagatgcgtatttagaaatgcagagtcccaggcctctccaccgacctcccctcccaagactcaaatttagtagttctgaatagggcctaagaagctgcctttccaataagcatcctaaattgcgatgctctggatggttcaggaaccacattttggcaaactttggtctggactaggcaaccctgaatgtgtaaaggtaaacggctctttatcctaagactaatgggaagtctgtcgaggcaaacctcataagatttgtgcttcagaaggatcactctactattgtgtggtaaatctaatggagaggaacgtgaccaaggagagggagaccggttggttgctttttaagccaagagtcaaacaactgtggtctcagttggatggtaacagtgatgggccagagtaaatggagtcaagagaacttacagggataggccagacaaagcttcatgatttaatgggaaggggacagtcatagatttgcagaactcaaggttgactcttgggttttagccttgggctagtgggaggatggtggtgtttcattgaaatagggagtacaagaagaagaggaggttttaaggaggggctacagagtagtgctttatatgtaagagctgttcacgtgtgttggtgtattggctctgctgcctcttttcaattctttggtgttgagatgatttactgtaggaccctacctacggcccctgtatagttgggttttttgaaggaattttgttctgcactttatgtcgccaggaaatttcttctgtttccaggggtcatccagctattgctctaaaagcatcatccagaaattgcaatgctctgaattgtggagaggcctgattttgaggttgtggattccattccactggctagctaagagacaggatagctgacctgagagggaatgaggctaaaaatcctatctaatggcttctcatcaaatagagtttaagaatgaggtcacctgacccaacagagagctctaatcacaagggcttgagtattttatcatagttttactctggtcctcattttgtcagaagaggatgatgaaacccaaagacatgaattgtagtaaatagagctaggaatagaacctggggatcaaagctgtgtctggcatcccagactggtcattcatattagtaaggatccttgtcctcagatcacgagtcccgtgataacctggttggatgccaaagcatacccatgctagtaatgcaactgaacaattttggttctttttaagaaagcagattgaccattattttggcttcttggtcagcacagtgtagaggtcagcctacttcttttctgtgtaacatgaacattttggttatttagatcctgagccctagagagtagaactctagaagtctgctgctcccgggtgacggtagttgccaatgtccctctacaagccagagattcactgctgctggtcagatgtggtcctggctttttctcaccatcagttacggtttgcgactctatttgtcatagcatcctggtgtaaggcaacaatttcaacacaagaggctataggtgttaaaaacaaaattgctactacccccgcccaaccaccaccaaacaaaacataccttcatccatggcaaccccaaattttctagctttagaattaataagcgatttcatgtgttcataaaaaataatcgcttgtagtagaactggctgaagccgtaattctttacagatgagtggacaattaacaaggtccttgcttaggtttaggtttgagtaatctgagccatttgcctctcccttttgtcccccaacttgtcttgtttgtattagtgaaagtatctagaccatgaatttttttttttttttttgagacagagtctcactctgtcacccaggctggagtgcaatggcgtgctcttggctcactacaacctccacctcccaggttcaagtgattctcctgcctcagcctctggagtaggtgggattacaggctgcccaaccccatgcccagctaattttttgtatttttagtagagatggggtttcaccatgttggtcagactggtcttgaactcctgacctcaagcaatccactcgcctcaccctcccaaagtgctgagattacaggcatgagccaccgtgcccagcccgaccatgaatttttagtggcccaagaacccagttgtattttcattttcactatgtgaatgccttttatgttgattctaagttgtatcaggtggggtctgtgatgtagctttggtattgtttcataaacagcatcatttggtgttctcaaatgaactagtgagtagagcacattagtgttgtttgccttcaactcttccactagatgagattctgttttgtgtccaaatggaagccattgctagtttggtgatgagtaactagagatgtgatcacttggacagtaagatgcaggacacgttccagccacagcacacactttctactctctgggcaaagaaaatcaggattcattgtgctgttgtgtttgtggtgttagcttgctgttttgttgagcagcctgttgtgcagggtttttacagtagcatcctggtaaaaatgaacactctatacagcatctccccagctgttacccactgtgaagtttaacgttaaattagaagagcaaggaaattgagatggaaaagctctgtatttggtttctgccaaggtgttgcagtgcatgctgagccacatgtgacactgcttccaaagacccttttaattaaaggcctcacccagtgaattggggatggaatttcaccctcaactctgacactgactgcatggccaaatggggggtggggggaggtacacatagaacaaaattaagaatggtaactacttatctctctacctattttattgctatgtttcatttttactttgttaaaaaatatgtggatcttcattttaattagaatgtttttcttcaaattagcatagattatgaaaataaagtggatatttatatgcaaaccagtatacaggtactgatatgtgatgtaatatagaaattgtttgggctaaatgtgatatggtattttttaggcaaatcgtctttctacatttttgtttcctgtttcgataaacaattagctgcattttgcccagaattcttctattaccatgtctaaaaaggaattattttgaatcatttccttattaactctttgcttttattaatattttagattttgttaaaatttcaaaacacaaaaatgcaaattaaccagggttcaaaaaatatatatatttattttttggcatttttggctttataatataaatcacctggctctcctgcttgttttgagggactgggttttttgggtttttgttgtcattgttgttgttgttcctgataaattgttctcaggctaaagcacaaacttgcatgtctgaatagagatggagagaatattttatattcaaaatatacctacctgaaaattggagattattaaggaaatgacaggcctggaactattagaagcacgaatgttagacctaaagtagtgtaacccctatatatgtttattctgtacaactagcaattttgaagagtttgattttttttttctacagcagtctgaatgggtgtgttgaagtagttggaaactgctgcaataaaagcctgttgcattaatcatcatgcaccagaatagagggaacagaaaatagttcactggcacatattaaagagaaattgggcctcctttcatgtacttgagtggaactgccttagagatagctgcagaactcctgctcttggaccttctggccttaggtgataggaagggccatttgtcttcagttggtaactgtcttcggcagcagcatttagtaagcacccattgcctggtactgttaagagctctctttagagagacacttcattttctcagctctctggatttgctacaaggtttcaggccctgtgtcttattttctttattcacttatttaggtatcagtttgatttttgttgtctgcctgctctttgtatgcactgtgggatgatctcacccatttctacaatcatctttttcttcatctggtttttggtaggtcccctctaaaaggaacaggcagtctgtgtaggctaacatcatggctccagaagccgactgcctggatgcatattcagtttcatccttgcccgtgtcacccttggctcattcttacctcatttttccatcttcagaacagaggtgatggtaggaccacctcggttgtggagaggattcaaagagatgaagcagggaaaacacaacagtccctgggacatagcatgcacttaataacttagtaaacgttctccttgtgatgttttctctaaaatcctgttatctgaatttcccagatctgtatttctacctgtaccttcagctttcttttgtgtgcctcttaactttttgtttataactgaaactcacttcattccaggtttttcatcatggtcaaccacctcatctctttccccttaagtattttcctttgtggtagagtatcttccccatcattcaaaatgtggatttttgagatatatcttacttcatttatatattcaaatcatcatcaaaattttcttaaagtctcttttcctacctgtccaaatctagttatgacccccttatttatgattttgcctgaggcagcataagttagtagttaagaatctcagttttaaaagctgacatcccttgctttggatcttaactcttccactttttagttgtgtgactttaggctagttacctgacctctctgaacttcaggtgcctctgtgtaaaatgaagataataatcattacttcacagaagtattgtgaggcttaagtgaaatgctgtctttgaagttcttggcatagcccctggtctgtagtgagtgttgaagcattcagcttttgttatcctccatcctggctgatgttcatttttccgttcctgtggctagttcagaatgattgagcagaaccactgtttcatattgcaagagactttagaggtttttaaacctttcacctggacaaaaatcaaagccactgttttttaaatgcctgtcattcatgacctctggtttttacaaccctgcacagtaggtggtgttgtgcctattctgtagaagaaaatctgaggctctaagatgcaaacaatcacctgagctctcccgggtggcagtgtcatgacttctgtttacgctctacccatgcctgttccagatttcttattgtcatcataatgtatggcttccataactccctctattaaagataaggttaaattcttgacatgtgttcctcagcctatggttgaacacgtatttctggtgtcagggaacctgctacttttcaaggtagcccattttactgctgaatagttctataggttaaagacttcttctgtgtactgtgctaaactctgacccctatagcatctctccattttttcaaaagaaatagaggggcagcctaatattttttttacttgatagtcttttaacttttaaatatgtgaatgtaatgattactgcccatattgttctcccctcctctgcacagatgactcgtttacttctgatccccttcattttagaaataaatactattttgtatatgctatatttcatgcatactaaaagctctctgtctctgttttatcccttctgagttgagatctaggagctgtcagtctcttgacaacccatagtatacattcagattttcattaaatagcttttgaggtgcaaaccaggagctttgattttaagtcattctgccatgagtagtgagcctagtcatttatttcaaagaccacacatttctttcatatttacggagtaacctatgtgttagctcccactggcctcctgatttaattttttcctcctttgtctcttggggctatgggaaagagagcaaaaagggagtgaggccaggagaaggccttttagatttggtttctctcctccttggtctctgctactattggtaaaacaatcctgatgctctgggtgtacagaagccctttgccttaatggaaaactttagggaattttattatttttccacaaaaataggcaacagtaaaatctagagcattaaatgcaaattgagtttttatctttccacagctgttaagatttcttagtgtcaaatttattttttaatcaaattcctgacagtagctttgtctgaggttccccatgcagttgagtgaagtattaggagcatgggtagatagagggctggggagtagaaatgctgaggcttgaattccagctttactgcttcctgtcagtgagactttagtttgctcaactgctatagtgaggttaataatagtacctaccttataggcttgcagtaagcattccatgaattaattcctgtaaaatgctttacagcagtgcctgctgcataatacatgcttgctaagtgctattgcatggttgtcatactggttgaggtcatggtttcatttcttcacccggaaggagaaacagtcacgacataaacagatgatcttcagaaggcaacccacgtcttcagaatgctgcttttaaagttggagagccacctaactgcgtgttttcactctgtcctgctatttagagaactacatagatctagcattttgtcttctgtggaacttataatgcccccaatctttaagagctgttggaaatgtattctcaggttgttcatcatcagacttaaaataactttcttactccaacttgaggggtccctgctcatagatgtttaatcatggaagcgtgggcacaggatgtgttgtaacactgtcctaatcacaggtatgtcccctgtcctgctatgtgagcaccagcccccaccttggcatccattcccaatctggaattctggacaggctggtcttagcattgtggcttcctgctttctgaggagatggggttgccagagaaagcggtgccatttttggtataattgtctgaggatctctaagatgttgagttataaactagggaaaatggtaaatcgctgaacataccttctactattgttgagagtagtcttggcttagctagctttagcaatgggtctggtaattcaaaggagactgttcatttactttcaattgaatacgcactgtggtcatttttcactacagggtgtttaacagttgatttcttcttccttaattggaagcactcatatagagaacctcccattgttcaatagctcacgatttgttcattcagttggttttacagaatacttttcactgatgagaatgcctgtcatttattgagcacctactatacatctaaagcattctgctgagctgcatgtataaatgtaagtagatgcttacaggacttcaaaaggttatactgtcttttccttggtaaggtaggtgtaaaggcaggaatgtgaataactgattatgatgtaagatcaaataagacaagttttataattgatattcagacagggggccaccggaagggacatcagttatttccagttataaggcctggttatatttgcctaagtggtaccatttgagctaagcttaaaggaagtggcaggatttcaggagctggagaaaggggcagcagtctacactaggtggaagtaacgatgtgggcaaaagcccaggtgtgtggcaggtctggcaggggtgggcatgggtgataggagatgaggctaagactagttcctctgggggcttgtatgccttgcttcagagacgggtctgtatgatgaagggtcattggagatttccatggagggggagggagtcaggtttttaattctgaaaagcaactttttatgtgtgcatggtagaccacagaggtccagactgcaagcccaagctccagactgacagtcagaaccactgactctcagtgataatttagatgaggtctgaggaaagtctgaaccagtagcatcaggaacaaaaaggaaaaggtgcatttgggcaaactttcaaaggcctaagggacagaatttggtaactggtttactctgggagaaaggaagcttgaacaattcagaatgacagctttctaggtgaggtggccaataaaactacatgcctaataattaagctgtgaacatagaagagagaccaggtttgagcactgggttgggggatctacaatatggggttagcgatgtgtcattttatggcctttacacgatacccacgtggatatattctctaaacagaaattctggtccagcagaaaggaatgagacttgaatatgggagttaagccttagcttttaagaaatccttgagggcttaagagagagagcactctgtctaggagagtagagtgagaagatgtgaggacagagggccaacagatgcttcccatttaaggagccagtggtggaggctccagaaagactgggatcccagaagagagtttcagctgaggcaggctggttcgaaactggcagatggctacaaatgaggagattcttttaaataggataagaactctgattcttactattaaatgtcttatctttaaaatattttaaatgtagacattttcaaactgcaaaagtagaagactataatgacccatcatgcaactgctatttggcttccgttattgcaaatactgtatttcttctttcatctccctgcctttctggggaaggaaaggaagatcgagtactttaaagcagtatcagactcatgtcatttcccttacactttagtttgcacaaattcataaggacaattattttttacataacttgaataaatacgatgtcattatctcactaaaattaaaaattaatttcttaatatcgtctaaaaaaactccattatattcaaataatttgaagtttttgagagccctgttggtgttcctttttttttttttttttttttttttgagacaaggtttcactctgtcacccaggctggagtgtggcggcatgatctcagctcactgcaacctcctcctccccaggctcaggtgatcctctcaccccagtctcccaagtagctgggactacaggcatgcacctccatgcctggcaaatttctttttttttttttttttgtagagatggggttttgccatgtggcccaggctggcctggaactactgggctcaagggatccatccacctcagcctcctcaagtgttgggattacaggcatgagctactgtgtctggctggtgttactttttaattgcatagaagttagctgtcactgcaagggccctgtttgggaaatgagcagagtgttgtgaggaagataataaaatgctctctgcaggaggaatgttccttccatatagtgcacagtgagttttgatgggaggctgttttcttttgtgtacacacttatcccctgggaatagcaacagagctctgtgattggactttctgtcttcagatcattttaattaaacatatgcaatgataccatgacaggtttacctcccctgatccacataccatgcaactacttagagcagtagtccttaatcaagacatatggctctatgcagagacatttttgattgttatgaccttagagggaaggggctacttgtatctagtgggaagagaataggggtacacacgacagccctcccgtaataaagacttaccctgtccaaaatgccaataatggcaaggctgagaaaccctgtgttggagaaatagcagagaagaaccaccactcttttctatctattgttacatcatgtgtttgggtaccaggttgcagttaagaatttttctcttttctttggagagaagttaaagtccctggcagtgtttttcctcagatcatctgcatcacctaagctggggttggccagatctttgaacctacaacacttcattccggttttcattttctttgtgttcatggactctagagagcacggaagtaattgggtttcattgggtagcagagtaaggtagagtgcactttctcaagacatgttcattggtctgagcaaagttctgtctcttggaaggagacagtagcttggtggtgctattaggcagatgagggcttgttagatcaagatgtaaactctctttcttcagtctgattttaaaatgaactgtcatttgtagtaattattaaatgagaagcataaattaagtattttactttctttatttgtaggaaatacaactggagcacgcaaagcaagcctttgtgcaacgggacaatgctaggactgggagagtcacagccatcgacttccgagacatcatggtcaccatccgcccccatgtcttgactccttttgtagaagaatgtctagtagctgtaagttgtaacttgccctaatgaagtggtttaactcagtaaataaggaattataaaaacaattcttataagttatgtagtgttttttttctgttgcaaacactaacattttaatgtgatcacatacattactaaactcaaacaaagagtgtgttttggctagttttagtgggtaggttaatttgttgtctgggtaatacggaatatcttcgagaaatacattagctttttaaagataaaaggaaaaacagatttgtgatctcatgttaattttgttttagattttgaagtatatcaagggctgatttttgctaatcttcttagatgctctaaggcaaaaaaaaaaaaaaaatagtgcacatgtatatcatttgttagagtagttagcacaacagaaactccaaaccttagattccctttcaccgtgtatgtgtcgaggccacagagttacatgtgacagcagagccctgcagttgtgtttcatggagcctccctcctccaggtgtcagctgctgtccttccctcatgggccctggggatgtcctgcaacattctgtggtggtggttcttaagacctgctcgtggagcaccagaatcaccactaaaaactattaaaactacagattctgagatctcttctaggcctatcatacaccatctataggcgatgaggtcttagaatctaattttgtaaagcttctgggtgattttggtaataactcagttttaggaccaatagcccgtggtaactctccttttgttaatcccagggagaatactgttttcaccatcatctgggtttcccacagtgcttaccataggcaggaactcagagtagcctttcagtttcctttcttcccccaagtccttagttctagagacatggtattccaacgaggcctcttccattctggcactgtgttaatctaactccttttcttgggcgcccccttctctactccatactaaactttcatgtcagctattttaaatgattactaagtgaagatttatgtggttgttaccttgtaaagaagtgctttcctaataaaaatattttgccttgctagggaaggatagaatttgaaactccaaactgaagtctcattcataatggacattctgtctgtttcccttgtcccctgtgaagaaatatggtttcttaaaaattctgattatcagaatttttactagtcttaaccccccatgaaagtatatggcatctcataattttaccataatatgcttgtttgctagaaatcccaccaatgtaaagtctgtacctaaatgattatttattactggttataagtaacttgacaagtcttgatattaatgttacattgactacttttcatagtatgtttgcattgatacaatacagtttttcatgcataagcacacacatgtgtgcatatgtacttatagtttttgcatgtttaagcctttaagatttgctcattagatgaaataaaccaacttataaaacatttccaattgaaatttgaactctaaattactactagtcctgttataatcctacacatgtatttatttagttttctaggagttgtgtatggagagtacaagttctggtcatgattagttgcagttgcttctaaaaatcatttatagcttttttttaatgcaaaagaaaaatacttatagtcatttcttcttgtacatgcatttttgattactttcaaactagttttagatgtatgtacttctgaatcatctataaatcttttgtatatttttcttctctcttgttttcaatttatttgaggctgctggaggtaccacatcccatcaagttagtttctcctattttaatggatttaattcgctccttaacaacatggaactcattagaaagatctatagcactctggctggcaccaggaaagatgttgaagtgactaagggtgagtgagaatatatctgaattctagcctgcaagtattgtggtgtattattattagggtgaagaaggcaactagtactttattatttttctatcccattgacacatattaactatatgataacgtgtgtttttcatcctttgatcagacaaacaaaagcaaacaaaacaatcttcaccaagttttaaacaaactgggcccagcttggtgactcacacctgaaatcccagcagtttgggaggccgaggtgggtggatcacctgagatcaggagttcgagaccagcctggccaagagggtgaaaccctgtctctactaaaaatacaaacattagtcgggtgtggtggtgggcacctgtaatcccagctacttgggaggctgaggcagaagaatcgcttgaacctgggaggcgaaggttgcagtgagccgagatcacgccactgcactccagcctgggcaacaagagcaaaatgccatctcaaaaataaataaataaataaataaataaactgaagacaccctttgaataaggaaaacatgtaaagtttcttaaatattttcaaatcttgctacagcttgagctaaattggcaacctctaaggaagccttcaggtgtatatgaggaattccataaagttgcattggtgacagtgtaagttggtctgtaggcttgggacaggatattatcagcattgtaatgggattaagaaaaaaaatcagagccggtgcggtggctcatgcctgtaatcccagcactttgggaggccgaggcgggcagatcatgaggtcaggagattgagacgatcctggctaacacggtgaaaccccgtctctactaaaaatgtatatataaaaaaattagcagggcatggtggcacacacctgtagttccagctccttgggaggctgaggcaggggaatcgcttgaacccaagagtcggaggttgtagtgaaccgagattgcaccactgcactccagcctgggcaacagagcaagactctgtctcaaaaaaaaaaaaaaaaaaaatcagaattcccttaggaattccacaccttcattaatataaccacctaaattaatataattaataatcctaatttaaccagttaattagattaatataacttcccctcctgggacctatgcatatgaagtttcatatatgattccttattttctctgattggcaatttgaataacatcagatgaccccaagcttttaaactgtatattcaagaacatattctgcacacgctttccaaatggatgcaagaactgcaaaaattcttaccttatttggattgacttgaattctacaactgatgataataataaagttttgtgatgttcactcattccagtgccttgagttaatgctgaatttagtggctatttcttcttgaatctttcccttttaacttttcttccatacagaggagtttgttctggcagctcagaaatttggtcaggttacacccatggaagttgacatcttgtttcagttagcagatttatatgagccaagggggtaagttggcttttttttttttttttttggaattagcttaataaaaggaggttaggaggagggcagcaatcaggagaaaaagaagccaaactgaaggctatactgaaatatgagaaatgaaaaaagggatgtttttaaattttataatgtaaattgtaataaattggtatatttgttgcttgtgtttgtttttcccctacagacgtatgaccttagcagacattgaacggattgctcctctggaagagggaactctgccctttaacttggctgaggcccagaggcaggtgagcaaagaggagcaaacttgcattctggggtttccttagcaggataccccaaccctgttccacttgcagttgcctttgcggcattggtatctgacttaaccatttttctgttttgcaccaaaactctcgataaattttaaaggctgtaaagagaaattgcttagaaatggtgtgataaacaggtatttggcatttgctcatttcttgctaaggtggagtgatttcctaactgcaccagaagcctaatgctccgaaaacatgaaggaggtcttttctcctttcttgaagtctcatgttgagagatgtagcgaaagaatcccgtgttggtgtcactgtgcctgtcggcagctgcacgttgctaaatgaaagccgtctttgctctgtggagcagcccttcatcagcgcatcgtctaactgccatgccttccgtttttctgaatatcaaaatgagataattttgtttagtctggagttacagtttaaaggctttcagacctattttctctgtgaaaggattcataagttatatggaaacaattttaggaatgctaaattttattttatggttaacagaaaccaatctcttgaagttgtgggagtcagaaacttaagacatggaactttctcctttaactcttacccagctttctgtagatcaggattagagaagaaaagccttcatagcatgtgttagtaaaataaatggtgtttgtaaaataaatccactcacaggcgagtgtcgtttttagaaaaatttctccttttaggcagagccatctctgaatcctgtgagacttcgcagtttctggcatggagctctgggtttgtacagagacgccagtgtgaccacaatgggttgctgcaggctacacttttaggactgtcagaccttgagccagggcccccttcttttagctctttcccacccaaatgcagcggtgagttttgtgtgcagcatgcaagtcaaagtagtgggtgtgtgctcagtaaattctaacgagcacctctggaaaaccagctggccttgcttaaaagaggaagccgatttctctgagtgcaggagaaataactataatcacgtgtagaggtggaagcaacactgctctcccttccctttgatttttaacactgcttaggagatgattatctcttcgtctgtatgccaccagctattgtagaaatttggggattaagagaagcagagaagttttttttagatccctcctactcttcagctggcagcggcttcccacaatttttcctttaagctctttgcagcttttgagagtttatgatgggtgcttgttgatactggccatgaaagggttagaccagattgatgagatttatagcaggaaatgattcgctgccgcttagaggtttagagcaattcacaatggccttacctggaataggctttttactgcatgaaccctagtgggcccgacaaattcaagcaagggaggtcgtccacctgtgggcacagcgctgcctgtccagcactgtgcagcacttgtagcatttatcctggacagaggagtgaaggagcagagttttgtctcatttcaagaacatgctacagttctggctttggaaaagttaaataaaagtctaggatttcatttgtcttttaggagaggaattaatggtggtggtaggtccctcctccccccaccctctataattttcagagtattttcactcattattttgatgccagaacatttctaagtattgcatatttatatccctgtaaataaaatattgcttctcttttggatgcatctgtcaaaatgaaggtactattgatttccatctatatagggctacagttggaaacaactcatagaatttgcaaaagaaatgttttgtatcttaaagaggcatatttctatgtaaagctattttcagttaagtgactttgaaggagattccaaatgatctcattgtattagaattgtgttacattgacagcaactaaaattcagtgggttgatagctggggttgctgattattttcattgttcactgattttaattatcatggattctgaaaaacaaattttattgaatgtatgtattcattcaacaggtatttattaagcactgactatatgtcaccctcatttgacaactctctgtgacataaaattactgttttatttatgcagacagagaagtgcagcactctgaaatgttctggcatcaaaaacactgtgaggataataggtcaaaagaaccagaaaacaatgactgactgacctgaagtatgaatttagaaaagatggacaaaaaaagagaaaaagtaacgatcaactgtaatacagccacctagttttagctactgtaaatgttttgagtatctctgggtggtagggaggcaaaatattagtattaattttatatgcatatatatgtaaacctcttacaagcatttttaataaaaagtgacatcattttgtatatagtcttaaaaattgtttttaaaaaaattaccaggaaataggtcaaacatttaaataggtacaaagaatcatatgacaaatacctatctacttaccatgctctttttagcctatgttttcttttataattccttgtgaacatttaatatcaaatattcttttacagtatcattttgaatgatagggttttgttttaaagttattatttttaaaggctatagtcctccgttattggacatttagaatatttcccaaatttttgttctttttgtttaaagagcaaaaatttgggaaataatcgaaatttccaataagtactacaaatgttttttaagtgctacattcttgtagcttgttacatgcatgattatcttctatcctaacttttttctttttgagacggagtttcactcttcttgcccaggctggagtgcagtggcgcgatcttggctcactgcagcctccgcctcccaggttcaagtgattctcctgcctcagcctcccaagtagctgagattacaggcatgcgccaccacgtccggctaattttttatttttagaagagacggggtttctccatggtggtcaggctggtctcgaactcctgacctcaagtgatccacccacctcggcctcccaaagtgctgggattacaggtgtgagccactgcacccagcctattctaacttcagaggttatgtacattttaagggtttgggtgtatattactaaacatctctctatttatgcttgctttaatggcaaatttcagaaggcttgttatcaacttttgccaggctgggtattgccacttaaaacaaaaacaaaaatacatacaaaccaaaaacctgccaatttgattgatgaaaaatgatgtctcattgatgtttttatttgctttatttactttattttattttatttttttgatacagtctcactctgttgcccaggctggagtgcagtggcgcgatctcggctcactgcaagcttcacctcacgggttcacgccattctcctgcctcagcttcccaagtagctgggactacaggcgcctgccaccacacccagctaatttttttcttttttttgtatttttagtagagacggggtttcaccatgttagccaggatggtctcaatctcctgacctcatgatccacccacctcggcctcctgaagtgctgggattacaggcatgagccaccgtacccgacctatttttatttttgagatagagtcttgctctgttgccgaggctgaagtgcagtggcgtgatctcagctcactgcaacctctgccccctgggctcaagtgattctccctcctcagcctgagtagctgagactacaggcacatgccaccatgctggtctaatttttgtgttatattatagagatgggctttcaccatgttatccaggctggtcttgaactcctgtgctcaggtaatccgcccgcctcagcctcccaaagtgctgggattacaggcgtgagccaccgtgcctggcctcagtgatgtttttaactgtgcattttttttaatgagaatttgaaaataggcttataacatcatttttgtcaaaggatggttttgattatattgaaatttggttttaaacattaatagcactaaaatctttttattaataagaacttatgaaatccattcctacttttttccttgacattttagttgtatcatggatttagaacccaatgagtaatgtttaaagttaatgtatggtcatttttgttttatcttcttttctgtcacctgttttcctgctctctgattcctgtgcatgcaaagcagaaggcctcaggtgattcagctcgaccagttcttctacaagttgcagagtcggcctacaggtttggtctgggttctgttgctggaggttagtcatggatgagagaaaaattttcacttttgttattcctattctcttttctctgattttccatcttgaaatgttaaaggacaaagtcttctctagtctttcccaatgccagttatcagtttctacctgtgaggtagggcaagagtaaagggaactcttttcccatacctgcatgtgatcagggacttacaagtggcattttcctctatctacagatcaggccttccaaagacaggttactaatgaggttgggctgtagcaatgtgccttaatttaaaatatctatgacatccttttattaggggatacttgaatgaaaaccctcaattgtttattaaagatataagaaaggtagtactgttttaaaatctgtatttaaaattcaaaacacatttcttttctcagtcttgtccttgactttaactaccttcttctttcttctgacctatcttactttcttctgagataatgatattgtttaattttagctgttggagccactgctgtgtatcctatcgatcttgtaaaaactcgaatgcagaaccaacgatcaactggctcttttgtgggagaactcatgtataaaaacagctttgactgttttaagaaagtgctacgctatgaaggcttctttggactgtatagaggttagtgccacatgctcaatacctgttaggtgaaataacactcaaaggtttggtttctcatcttagtgcctgacatgaattagcaagactgcgttaaaatggaaatacagcagattttcaattatccatgctaatgggagtaggctggaggcatctagggcttggctaatcaaaacagcccataatctgaaaattatttatagtgctctgttgtatgttttatttcttaaaataataaattatttttataagcatcttccgtgaatttttgaaaggctcacattgtttgcatccttgaagtactctattctccagctaacagggaaaggtattctgccaccaggacaaagcctactcaggattcatgattttcctggaatacaccacaaaaaagataacgaagggttcagtagagctctcttttgctgcttcatcctgaattaaagttgccccttttcttcatctgactctcaacccaatggagttgattcacacacccctctagccaaggtttccccccactgagacagcctgaaacaggtaatccttctttctccaccttttcctttaaccatctaaggttcattaagcaatggaagtagtagcagagagtatgtcatcactgatggaaaggatcccacagaccctgactgcttttccactggcattggccgaaggagacttctcaactgttctttcggggattgccttctacgagaaggaaacagtgtttctgcatcagttaaaatacagtatcacaaggcagttcaaactcagctgctttataatttggcagcggcaaagctggcagagttttccctcctctcccctactaatgctctctctagatgaagaaaacagtatttagtactctgctgaggtggacggtgaaactggcagacatggaaacctgtgcctctgggcctcttctgccatctgctgactctagtcttcaaattaattaccccagttaaaaaaaacaaaaaggataaacctttcttgaaacctctcaccttagaagccagaaagtctcaaactccagagaagttccattttgcaggtcctattgtgtaggtaggtagcccccatcaaaggccttttgatctttgctctgccctcttttccttatcccctgcctcttcttacaatttggaaggtctttgacctcaggtgattgatgatgaccctttcagggtcactgccttccatttgaaatgcttttcttccctgatggcaacaactttgcaaatgaaatggcttccaagtagtacaaggttaatgtcacagttcctattctgcagtgagtcaggcaaaattggccgccttacctgtccatatgggtggtttttggaagggaaatctcgagtctcaagtctgggcagacatctgagcattgcttcataaactactttttgggcttttcttggtattagattaaatgtcaaggatgcctttagaattgtaagaatgcttcccaacactgctcagtgtctttaatttgcttaagttgattttttattttgagtccttttttctcgatctttgaccatacctggcaggtctgatttttggttacgtctatatttcccttttgcaacctgtactgttggcaactagaagtgtgcctgagtactgagtgctgagctaatgtgggctatgcaaagaggcttccactcttgccgtttcagttcttttatctgtaagatgagagtgactgcttttaacttctcagaggagtagtaagtcaatatattaggtacagacagaggctcactgtaaacacccaagtggcagctcttcacccttttcctggtttagaaatggccatttatctttgggtgccccaaccttaagggcaagagacagagctgtctgtcaggatgatgagtagagtgtgaatataagattagttctaggagtcacctgtgttcatttcttcctgatatcttttctggtaaaccattttaaaacaaaaaatttactgtaaaatttttgtttagtcccattctgtaatttggatcatcttgagagcaaaatgatgactgacagttcaggttaaaataataatgatacataactttgccatgaaaatgacttgttcctattcttgattggtcagggatcagttctctttagtttcttgtacatcatcaataattaataattgtatataactgcatatttgtaagtgcttattgggtaagagagatcagatgaaaatgtaggtaactcatggttattgttgttaatttaaaaaattacaatataagtaaaaaagacctgacatatttctgagactcagtattatcacctttatgtacaaagtcacattatgaaatacctatatgtgattctttgtacatttctcataaaatgtaactttattttaaaattatattattccagaggaaaactgttacgtttaaattaggaaaatatagtattgctgctattaatgctttcacctagcaatatttgagaaggtatcagagtacatctttaattcatacatgtttttaaatattgagcatagtttttagtattacagaattttgctcaacatgtaatttttctctatcaaggcctatgtaattgctcatatttcctgaatgagataatttgggaatgttgcagttgtaagatctttctcctactttaaaattacctttgtgtatactttgaaaaaagttggcatctggcctcaaagaaggtgtttttgtagcatgcgatcttattatgaggttaataaatatctctttttcttataacaagaatatcagaagctgtttttgcatttaaaagcctttccctgtggcattagaatgaaggttattttaaaagaactcttgtagtgctccaccacaagttttgttctttgcctcccccgcagctggctgcatcagaatagttgtggaagttgcttggtagtcatgagagagtgcctagcagtgctcttcaatagaaatatacctcagagagtcatgagaggtgttgtgagttggttaattcctgctctccatgtattggtataactccgttttctttatttccaggagcctctctcctatttttgtgtaagttttagttgctggaaaagagctccttaaaaatcccatgagtctggctctgcaaaccttctctacagtgcaaactacttttttcctaacaagaaaatggcaaattttcctagtttgttgttgttgttgttgttgttatttctgaaaatccaacccccaggccaagcctgtctgtattaagggaaatcacacctgagataatccaggtcttcctgaagtcacttttaaaattctttctctgtttcctccccagtcttcagagtgatttaatgtgctcaggtatttgaaatccttaatgaattacctgacaacttgtttggtttgaatgactggcataaccaaatgaatcagtcattggcctgctatagatctggcgtattaaagaacaacaattgattgggtaatcatccataattaaatgctcttaatgttccaggaataaataatttctgcttttaaactttgttgcagtcttctctctcagatctttcaggtgatgagatgagcagccttagacactggaaaatgttttgggagaatcttggggaaaaagatgtattaagagaaatatggccgggtacggtggcttatgcctgtaatcccagcactttgggagaccgaggcgggtggatcacctgaggtcaggagttcaagaccagcctggccaacatggccaaactctgtctctactaaaaatacaaaaattggctgggcataatggcgggcctgtaatcgcagctacaggctgaggcaggagaatcgcttgaacccaggaggatgcagtgatctgagattgtgccgctgcattcctgcctgggagacaagagtgaaactctgtctcaatttagaaaaaaaaagagatagaaatcagggtctatcagaaatacttcttagacgaaaatttttgtttctattgatgggagaagccctaaagaaaatctcccagaaagagtaattagatcattttatgaattaaacttaatttaagcagtgcttaacctttgaggaaattggcaaaaaaaaaaccacattttttaatcagcccattgatccaagcttgcagagttgtaaatatttctatttcaagttgtctgtgtagtgcaaagcagtcatcttccatcctggaatgttctcaaggtgacatctagaggatgttgtggtgatatctcagggagttattgatacttttatattgcagagggaagttttggcaggcagctagtttaagccaggtcccttatcattgatggtactataaaagggagtatccagattctttagaatcacagtgagattcttcattcttgcataattcatggggataaaataaactttaaaattctggcaccaaaataaaatgattgaaatttccatgactgttttgcattacttaagaacacatgcatcttgaaacaaaccatagttaatctgtgaactgcactcatgtccatccatgtccaccaaaacttttaatgattgcaaaatggataggtttgagtctttattttcttggccaatttctgcacgttttcatttagagcattaagctataaaaatatcagaagacatgtatttggttataggaagccacataagaatgagcagaagatttcaacagatcatttgttgggttagccaatctccagaaatctacagtgagctaactttagtgagcacagggcattgtaatctgagactgaggcgacacacactggatctaaggtgggtgagagaattgttagagacttgagagtgctacagtaacaactgatgaccttagaaaattggaaaaatatgacaaaaagatagacgtgtaggtatcctagagaagaggttaatgaatgaattagttccacacctcaaaaatgataatttataaccagctactgttgctgagactaaaacaagggagatagattaaacctcagtaggagggaaatagtttagatagaagaaaagataaccaggatcctgaacgttctcatgtactatggtgaaaaactgcaggagtatctgatcgttttccccaattctctttacttctagaaagccccagaatagaggagttgaggaactgatttttttccagaccataatcataatcacttattttatgttttaacactttgtctcccaaaggcatcctgagccatagctaagataacagacagtgcttgaaattttgagtgtaaataatttaacctagataaactggcatttaaatcttcatttctgcatttgtccctggctatttccccagctccactgtacagccaccttggggtagcagcccaaagagcctgtcagaactgggttgtaatgaaggctttgaaaggcgatagtgtagttgggaaggtggaaatgcctcatgcctaggggcaatctgagtcaaaagcagacagacaaatgggaggaggaggagggaggaaagaatgcttgagcaagtgaagagagaagggcatggcaacaggagcaggaataaaaagctctaaggcagggcacacaaagtgctgatagctgcagaatgaaggttaatctgatgttgaaagcaaaggggtttctcggggaagatagggacaagtgttctggtttcaatagtgaggtcagaagggtaagaatttgacatcggaggggttgctaccaggtggaaactagataacacaacagtgtgctggctgtggcttcagctacaggaataggggtgtcttctggattaatttttccttccaaagtttactgctcgtctctgccctgaataccttctgccctctattagatgctctcagctgtctttctctggtttgggctggcccctgtctcagttctatgctgagatagaactggtaactactgccttagttaccaagtttcttccttggtagtagcccctccacctctgtggtcctgctagcgttgcccagcgtggtcctttggcaccctggccactctgggttacagtagccgctcagcgtggcttcaacccactcctgaccctgcgccttcttcccagtatattcctgctctcactggttcaccaggttataacctacagcttggctctgacattcagtgccttcgaggttttaaggagtctaatattcaccatctgtagagacgggggaagcatgatgtggatgcctgctacatgggcaccatccctttgttgtgtacaagggtcaggcagggcagggtgctgacccagcctgagctgaggcctagagaaaagtttcagaacagtctagttgggaagaaatgcctttccagggcagaggaggaacttggagcagtaagtctgttagagaaaactggtaccgcagagaattaaggagcacagagccctgatttgagagtactggcaggcctgaattcaactttgagtgctactacatagtcgctcagaagttagtgacttgaaacaagctgcttagcctgtctggattccagtttccatgaaggaggaggaggaagaataagtgatagtgatgatgaagatcaacaacaacaacaaaaatccatttctgtagtctttactgtctgtacttggtactggtctgaggattttgtgagtgttaactcatttcatcttcacgactaccccgtgaaaatggcatcatgattattcccattctacagatgtggaaactaagatacaaagagattaggtaacttgtccacaattacacagctaacaaatagcaaagtcagaattgaagctcagcagcctggctccagacctcgtgttcctaatcacttggctcttttgtcacctggtagaaattacattgtgaaaagttgcttgtcagcagaggttaaggatcatttaagtttttaactataatattttatttcagcttaataacatagttgaaatgtgttgttttgtctgtgccactactttaccttgcccaaagtatacagggcccctggacacttccagaccacatgtgctctcactgcttggggacagctgttctaagataggcataatgtcatgggcacagcatgatactccttagctaatggtggactgtgaacatgattcaggctgaattgcctcttgcaaacaaaagaaatcaaggctatgtattgaaaagataggtagaaagaagcattatgtcttttggaatacataacatatgaggtaaatagtgtctggttctttgtacacttattcatataattatcaaaataaaccaatagatagtaagtagcacccttgttttgccaagagggaacctagaattcaaagaattactacccaagatcactcagtgtgaaagatgcacagacctagcattctagcccaggtctgtccacctccaaagcccatgccctagattgttcattttgctgccagcccgttggaaatagcctaaaattagtttaaattaggccagcaatattgagtttctttcataatcccttccaaccctgaaattccagttatatttctaacaggttcttaagaatagcatgctagccctctagttgaacacagtgggcccaggaacctcttttggggatgtcctgtgaagcttgagttggagacccctgatctgggcttggtccccacaccttcagctccttggtttgcgcaagggactgaattcagaggggatagtgtgatttatatctccaacccatgaaatgtgaagacaaaatactacattaatactgtaccctgtaaatcttttctcgcattagcagccttctggtagagtcgagttgccaaggaagcattgccatatgtgctgatggagctgaactaaaaggagaagattggaaaactaaccacactaataaatttcttttgaggcagttggaaaatggactgctgttttgacaagttagaaacaacacacacatccattctctgtttcaaatggttaaagtgaatttccaggacccaacagaaacatcttatattagaaacctgatttttctgctgaattacccagatgtcagatatatatgcactttagacttaattgtggttgtgatgaagtgcctcacctagactctctgctttaggcattactgggctgtgctacctctcctccctctgaggtcaaggtacaaggagggagtttggaattcccacctctttgacttttcattgtttcacagatcatgaccttcttacaaagaccatttacccaagactcatgttttcaaggcccacatctgtagtgggcctcagattataatccagtcaccttcattttcctgtttaaccagacaaggtagtcactacaagaatggttcttatcaacaacttccgtgagtggcagcatctggcctaggtcttaggaatggatttgtgctttggttttattctaagttgaagttaatcatttaatataaggaagctcggggcctctaatatattaccttaaactcctagtttctctagcttcctcaggtctctgctcttgcaaactatccttcacctgcctctagaactttttactttttgaactttactttttaccctaaaagccaccccatgcatctacagaatttggtgcatgctccttagtgggcctgggagagaagttgtgcagcgtaccaggtaagagcacaggctggagtcggacagcctgggtggaaccccgttcccccatcaaacagctgagccaccatgggcagctcccttaaagtcggcctcagtttcttcttcagttgctgtggataaaacaaaagccactgtttaagtaaggtattgtgtggattaaatgtgttcattcacataaaacacacagtactgtagtatgtggatatagcgagtgctccccaaatattggctgttgtcattatcactactattaataatattgttatttattatctggtcttctgtgatccaagcacagcctccagtgccctgactccatgccatagccttaagatgttggtgcctttgcacaccaactgtttcctctgcctgggtcaccttgccctccattctgctcattgtctcatctttccggggaacctctgctcacccttgaagtcccagggcaaatatctcctcttctttgatgttttttcccctcctgcaggcagaagaactggttctctccactgggttctcatagtcctgtgatgcccctggggtctggtatgcagcacctgctgttgttaggtggtttgtcccccatctggcaggtggagacaactagcgttccctttccctctaaactctgagcttcttagcggggaggcaccagtctcactgtgttcatcccagttcctctcagtaccaggcagacagagaaggcatttggtaaatgtttgctgaacaaatagctacttgttgccttctttgtagtcttaaatacggggttttcccttctgttttttgccgttcacaatgcattactaaatttatggtgagaaggataaatttcagtagtttgaaaggctggctgaagtgattgtatctaacacagtagtcattaggctctgtggcctgtttttttattagtcatttaaaaagactgtcacaggatagttatggagacaagagttcatcatttaaatcacagtgctttcaacccatccacaattttggtctacaatttaatgatgagaaaaatacatctagcaagtaaatgtttaactaagcattttgttacttgatgtgaatacagggagaaagatgaaaatttcaattgtgaagaggtagtttaaacaggcgtatgcccacatattactagtagaaattaatgttgtacttttattaggtaataaccaagccttctcctattatagatatcttactgaaagatcagtgagtgagtgtcatgagtatagtttaggagagaatgcttgctttggataagaatgcttgctttgcccaaatggttgcatattcccgttttttctcatatgctgcctcagctcatttaaattctaaagagcacagccccactcaagctagcaagagcttaggggggcttttgataaacattcacacaagagagaaagaaggtagaaatctcagatccaagagcaggagctgcactggaggctggcctcagtgggacccaaaggtgatggggacaggcgctcccacctgtgtgcctttcatgggctatgtgcattctctttttaatctctattccttttgctccacattctcatctgtccaccaatgcacttcctctgcttattcatggtttctgcttccttgtgatattagcacacacgtgacttccaattggctgctttccttgctccacccatgacatcttttcatcttgttgcttctgtgctaacttgtcccctcttctctaaagactgtcagtcatcctcctggagaaggcatcctaattggccagctctatttttggtagcaggctcaggttgctgaactcttgatttgcgtgtcttttaggtgttttacattgtccagtcagctgtggccctggggatgaagcaggcttagatgttatagttgcttagtgaagggctgcaaactcaggacaggtgagatggctcacacctgcaatcccaacattttggaaagcctaggcaggaggattgcttgaggccaggaatctgagactggtctgggcaacatagtgagggcttatctctttgttaaaaataaaaaatgagaaaaaacaaaaagaagcgttgcaaactcaaatgctgataggatctaggcaggttatataagtgaacaaatgcagctgggtgtgtgagatgcaggtacacatttgcacattaacacagagttgagttgtatataaagatacagattttttgagtaagatggctaaagcttgtatcccagtctcaccacttaacagctaggtaacttggaagaaattactttatctctctatgccttggtttcctctctgtagagtggttatgaagactaaatgagttaatacattttgtaaaatggtacctggcacgtaataaacgtgatgcacttttaaagaaaattttcattaacatcaccatccttatccttgtttaattccacaatgaaggacttcctcccatttttccatgaaaacatgaagctgtattcatctttttagttttccccctttataaggctatgagcaaagaaaaaattttatcaattgtgacgatatcagtaaagcaataaaaatagaaactggaggccgggcgctgtggctcacgcctgtaatcccgacactttggaaggccaaggcaggcggatcatgaggtcaggagatggagaccatgctggctaacatggtgaaaccccatctctactaaaaatacaaaaaattagccgggcgtggtggcaggcgcctatagtcccagctactcgggaggctgaggcaggagaatggcatgaacccaagaggcggagctggcagtgagccgagatcgcgccactgcactgtagcctgggcgacagagtgagactccgtcaaaaaaaaaaatacaaactggcgcttgtcctcattgaggtacgggcctcaaagcagggtgggcaccaccttgcatggtttctgtctgaaggatggagcctcatgcaatagagcagatggctgggatgtcagaaagaggcccggggtcagtcagagttcggtcagaactgagcccatgaactgactgttaggtcagtgtgttcattgatctttttttttttttgaggcagagtctcgctccattgccgggctggagtgcagtggtgcaatctcggctcactgcaacctccacctcctgggttcaagcaattctcctgtcttggcctcccaactagctgggactacaggtgcctgccaccacacccagctaatttttgtatttttagtagagacagggtttcaccttgttggtcaggctggtctcgaactcctgacctcagatgatccaccctcctcagcctcccaaagtgttgggattacaggcataagccaccgtgcctggcctcattgatctttcttacaaggaggtcagattatgtttgaaactttttgttactcaataaaacacacttataggttggatacatatggcattcaagctagtgacctctcaggctgctcctttaggaagagagtgtgggcagggctggtccctcagaagaggctgtgagtggactttcttacatagataaattagaaaattgtacttccaatgaagaatattaccatgaacctctctcagtatgacacagggtgcaacatgctcctaccttcagggttagcttggtgtgtgtttccaagaaaaaacaactgtgatttaatttttttttctttaagaagaacaaatgaaaatgatgacattttttagttcagatacgtagctccactaaatgttctaactgccttccccaaaattggtccttgttttagaaaatcaagtggtccactgatttagaaggcagaagggaaggagcagactttgggggaataatgagatttcctatatcactaatactgttgatttacccaatgtgcaaacgatccagaatgtgagatggaatgtacttgggactgatgcggctgttagaagttagtacttaaacattccatttcaaatattctcattaagggtaatagcagaaaattgcagcagagattaagcagtttttaagtggtaatcccctctgtagaactgttgatttgtttagttaatgctaatttatttaatatacttctactttttgttgatttttaggtctgttgccacagttattgggagttgccccagagaaggccataaaacttacagtaagtcttttgagttggtgcttcttattaagggattttgtacatactcaagaatctagcaggtattcttataggaaacagcaggtttgttttctcagaggtgctagctaatttgaaagcaggggaactcaccacacacattttttcattattctccatttagcagtggacatccaaaaatgtgataataaacttgaggacttttggtggttgctgccatcattgttgtcatcacagcagtagcagctaaattcccttcagtatctaccatattaggcacatgacgtatattacgttttactggtttaatctcaagcaaagcatgatccacagtttacggataaggaaactgaggcctatcgggcttaagtagcatacctgtgttcacacaaatcatgagtgggagaactagaatttaaaatcacacttgtctgactccagagcatgtctttctattacacctgctgtttttataggattcatggttagggtgtgttctataaagccaaatgtgcagggatctgggttctagttgaagttgatcctttatcagattatttgcccagtgcttggctcacatttgacagatggttgatattcagtttaagcgtttgtggaatatacaaatatttgcatcactaaggccacaaagccccagaaagtaaaactctagctttaggttgggctgcgtagctttggagcctgaaattcttcttttaccattttgttatgtgaccttgagatagctaatcttctctggcctatgtctgccaaaaagatatgactgtttcttaaaatttcttgtactacataccattttgagaatattatattaattaattaatgtaatttatgttctttgagaatccttgaggaatttttagatattgaatttcttctaagctgaaaaagtctgctcagccaaatttatctccatgatgagtactgttttagattaattcttgttagaagacttgaaagtgatttttaatcaagccttataaaacagttttaagttgtaagatgtatgtttttattttgtcactattgtcagtgtgtctcccttcttaagctattctaattgcagaacatatttttggctttcatttatcttttaacttttctcctgaaacatcagtgatgcatatatatttttcattttttaaaactattatactattaagagtacttctcaaactattttaagatctgttaaattgtgcaatttatgattactccaatagactgatagaaaaaaatagcatatattgacagatgcatatttataagtgtttaatgactttctttatatttttcatcagcttctataaatatttttcttcaaggtgaacgattttgtgagggataaatttatgcacaaagatggttcggtcccacttgcagcagaaattcttgctggaggctgcgtaagtaccttttgaagctctcttcattgaaaagacttgtttcacatatatatcactaccatggtcaacaggtgtggactaaggcttctgtttaaccacagatcctgcacaagggcagagtctactagggcacctcggcttttcctagacaggcgaaccattccagaggtggaagggtaaatgtttctgaccttactgcctgttaagtcatgcctgttaaattcgtcattgcttatggtttgttctgcaatggaagtcatttgtggcagaagtgtttggcctttgaaaaatctttgctaaccttttctaaagttaatttttagtacattctttcctcatggcaccctctgctgggtcaggcactaaaacttgtagtctgaagtcagcaaccgtagctctctgcttggctttgccttgcaagtggcagaactgttcaagcttccactgcttttgggagaacaatgctgggaaataactggctgagtgtgcgctgcattgtcaaaaatgcttggaatgattgtttccttatatggatgaacaacttgcatcttgttctgaagctcagcaaaacattgtgtctcgttttatctcgtactggtttgttcatgcgaatgtaaatactttaagtaaattaaactcttatacaaagactagtgttatttaaagataagattggttaaataacaggctttgatcactcaggcgatacaatattggttttttttatccgaacctatttcttataaaaaagatgaagtcacttttttaaattggcttactctgggcaggaagtagtattcctaaagtaatttttttcttgaagatccttgaatgtagacgttgggcaatgtttgtgtggaaagggcttattgtcctatctaatggtgaatgatggtttcttaaatgtagcaggacctaagaagtcctagctcctggtattctttagagatggatggaatttggctactgcctgactctctgtttgatcactgacctgttggagatgggcaggcaggatccccttgttctgtaactttaggagcgttcaggatggaaaaaaaggagcctttaatgtcctaaatataaagggcacacaataataatcaaagagaattttagaagttgctcttccccataactactctccatttaaaacaactctgtagtttccatttgagtaagtaggttttctaatttttgagtaggtatatccataggctgtgcctagcctagtccttcaggttgttgcagggcccaggatatagcagggttttttggtaggtcaggtggggttgttgtttttttaagttacattttaaactttctgaaaagatatgattatagatttctgtaagaattaaaatgtaaaattaattatgtgatactactcaagatgttggcaatcatcatggcatggtgcccagaggtttattttctttttaatgaaagcattttgcctgcacatacctctgggtgccaaggagattggttgtggcacgtattttctaggtgccatctgtaggtggtcttgtttttgcatatgcggccgcccatttcaaacacaaagcacattggcatcagaagtggtgcctagttatgtaaagagatgtagcccttttcaaacctgatctaaacacaggcttaaaattggagccacttaggctttacagctacttaaaatatctgtgaaatgaggtttgccatccttcatctcaaagaggtagacagtggtccttagcttttcaagtcttctcccttgcctttttcccccccaatcattactttaagaagtaagagtttattttcagttaagcaatcctgtaggtagcagacaacccaggtccctttagatctctgagtagatgaatggatggttccattttctgtgtgtgtgtttgtgtgtgtgcacacgtgctttttttttttttttttttttttttttttttcagacagagtttcgctctgtcaccaggctggagtgcagtggcgggatcttggctcactgcagcctccacctcccgggttcaagcgattctcctgcctcagcctcccgagtagctgggactacaggcacacaccaccatgtccagctaacttttttgcatttttagtagagactaggtttcaccatgttggccaggatggtctcaatctcctgacctcgtgatccgcctgccttggcctcccaaaatgctgggattacaggcatggggccaccccgcccagccatgcattttttaagtaatagcagcatctttctttgcaggctttggcaaagtcttctctataattggagtcagtcacacaccttagagggttgttgtgagttccacagcctcatctgtcctattgggaatacaaagggttttgtaaggttgtgtcacatgagcggttcctcatcttagttcatccaagcattgctaggtgttgacttttaagtccctggggagctcaccttgcttcatgattactgagaattagtacacatggctgacttttgcacttgtaaccaaagctgctcatttctttgaacaaggcttattctgttttatgatctgttttctgcaaaaatgaggaaagtatgtagggagatctttgtctcataacttcataatgtttagctaaacagcctgttttattgtatatatttttttagaatgaaagtgttagtaaatttggaggggaaaaaatgattgtcactaaaaaggaataaagtttatcccatttcttatttattatttttgatataataaagcctgtaactgaagagatgaaaaaataatcttctgtttcactgacatatgtaaaagggctaactttcacgtctaactttatttttaaactcattttttgcatttgagattagttttagtttagagcactgttaaaaattgacttcagttttctgagcatttttatagattcacactttaacagtagtgatatattcagcatgttttaagacaaaactcgatgctgagactggggtttacaaactctaaatctgaaagaatcctttgtggtttgtgttttctccctaacttgggtttctgcattctaaattagggttgtagttgtgggagttctgatggagacttggaccttcagtcttccctgcatgaggtatatatatatatgtataccttctgtttttttccatcttttcccttcttggatcaaaaacttggcacctttagagggatgtgattgaaaatctgtgttagtgaccgtgtgtgtcagaagacagaggttctgttaccactagccacttccagttaggttcccaatgattctgaaaattgatgtattacctctgaatatattgtttttattgcttttttgctgttactttaagaaaaaaataaaaaataatgtatgtaatgcaatatgatctgtaggctgcagtgcttcattcaacaaagtaagtgtatgacttttatatatctagtgtaatatgcatctaggttgaaatcttgaggagcctgggatctttagcttttgatcctttgatctttaaaaaaaagtcaccagataagaaatacaagtggtgcaatgactagtttcaaggaagaaatataaatatgatgattaatttatttggcctgaaaataaatctaatattactaagaaagaaagtcatgaaagtatgaacatctgtcttataaagccatatttagtaaaaactgtttatataacaagagaaagtaatagtattgtgtagtaatttttggaaagacaaattaacatgttttttaaactatggtcctttgataatgggtccagggtattttttcattgtgatgcacacatgtgtgtgcgtgagtgtgcatgttgtaaatataattggtgtttatagaagtttatattcattttgactgcattttgagttggaaaaacagtttatatgcttgtgtcactggttctaaaagggactggtgagactaacactgttgggaaaacatggaatgaagagtaatcttaattacactcccctataaataagtaggaccctaatgcagtttcctgcctgattcctaccataatggtgattcccatatgcatgatgtgtttatgccagtttgtccagccacgtatcaaatactgtttttaaggcaaggttttattactcatctcatacattacattcagttgcagttaatttatattttgaaaaattttgaaaaacacaacaatacagacacaggtgtgcctaccacttagattggtgacaaacttgacagtgcagttggaggcccttaatgtacctgtccaaattgcttttcattcccttacctctgtctcccaagagaaaactctgtcctgacagtggtgtttttcattctaagcatgtctctctactttttattacctgtgaatatcctaagcagtataaatgtttgtttttgaatgcctcatcctaacccagtgctctaggaacacctcatatgattcccagattgatgcctttgcattttttcccattagtgcaactcatgtgctttgcttatcagaaaataatagtaaatgggagtattacattcaaagtgttggaatgcggcagatactgcgtatgtctgttacagatgtgtgggtttctagatggacttatggttggaacagtgtattcatttaaccaagtttttggttacttggggtttctccctagacaacagtcatttcttcagtcttatgatttaaacttatacatgatacttagtttaaaaatgttaaccctccccactgccagcatacgctccctatctacctatcagcctgccttcccatcatccctcccttcttcttctgctgccatggttcttaccaccttcaaacattctgtataacttacttatttttcatgatttttgtttattttctgtctccttcatggtagagtacaagttctgcaaaagcagggatcttcttattcattgatgtatcctgaggactgcaggcattgcatggtaacctgtagactctttgtaaatattggttaaatgaaagaattttaaagctaaaatcactcaaaagtgatcttgtcaatcttcacagccaatcaacgacaaatctgataatggactcatttatatcttttctttaatgttagtcaaaccccttcccatcattaacaataaaacttatcacctgtctctccaagccatacttaatgataattcccaaatcaccaagaatagaaagcatatagatggagatcattttacaaagtgaaagtgttccttttaaaaccttgccattctaatttttgagaattgccaacagggatgctgctgcttcttttgtgtgtgtgtgtgtgtgtgtgtgtgtgtgtgtgtaaagttaatccttttgaaaatcatagccatttgtagtaaaaataatcacatctaacaagaggcagtccagtttcctgtaaagaacatgggcttttagtcggtttggggtcccaaggccttcacctgccagatgtgaatcaaggattagacaacttagttgacttctctgagttgcagctttcttgtctataaaatttagatagcaactttctctttcagttatctattgctgtgtaacaaacccctccaaaacttagtggtttaaaacaataatctgttctttttcattaatgctgcctcctttccgtggtttctgtctctttcccatggtttcagctggagtggtgaggcagctagaaggtccaaaatgtcctcacacaaatggcaatcagcttggagctcagctggagccatggctgggggaacaggttctccacatggcatatctgcgtgagcttcctcacactatagtgtcagacttaagaaggtgagttctgagagcagaataagaagctgagaaaaatctcaggcccagtttttgaggttatgcaacattaatttagccacagtgtgtttgttaaaacaggttataggccagccggattcagtgccagggaaaataatctacctctgaatgggagatgtggcattgatgttgcagccatctttaatgcaccacagttaccttgcctgattgtgggaaaaattaaatgagataatatgtatgaaagaattaaatcatgacttaagtactagtcttcctcctcttctggtgtctactttttaacttctaatatatatatatatggagagagagagaggatgttgtgaaaatgaatgttttagtttggctttttgggtgaaggggaatggaataggtgtattggagtttggatatggctgttgaggacctcagctacctcaggtgctcctgaaatctctggtcttctttgtgaacctgcttatttgccatttctctactgattgatttcctctgctgggtaacatagcatctttattctaaaaatgactttaatttcatcctgtgtccacagtgcatgccaatcccagttccaaggctttcctcctaacaggaatgatctcagtgtttctccatcattgaggaggagaagtgttctgattatctattgctgcataacaaataatctgaaaatttagtggcttcaaatagatacttattattattctctcttgtggttctatggattgacggggctcagcctgggagggttgtacttgggatccttatatggttatgggctagtggcagctggggccagactcatctgaagggtcaaccgggatagatatccaaggtggctcactcttgtaactgaacagctggggctgtgctccagagcacctgcttgacttctctgtgtagcttggtcttttcaaacattgacaatttgattctgagagggagcctcccaagagcaggcatcttaagagtcctgggcagaaacaagacttcttatgacctgaccttgaaggtcactgccagtgcattctgatggtcagacaagccagttaggctggcccagactcaacaggagagaaattagaccctacatcgtaataggaataatagcaaaggatgttttaactgccactggaggattcagtaagctgtgttgtgggctgggaacatcttcattgcccttcaccttgtgaaggtttcatagcccatctcatgccttctctgagggtctgttgctgatcctagaacccattcattctctagattgcttctggtagcagggggcagaaactcaccaaagttggagttaatcaaatgaaggtttactttaagggtacccattaaatgaaactgaaggctcttgagaattgaggcagcattaggaactggctactctctccattttctctacttggcctttgtctctctcacagtgactttgcatccctctgcacatcttttgactattctaatccataacttcttctcttcctgaagaattggtgttgactttctcaagaattcccttcatgttcttgccagccacctagcctttctctacagtaggagacagcctcttttcatcccttgccccagccccagctaattagcttaagttgttcagttttgttttgttttccatttaattattgagagaggaaatctgattggcaaacctcatctttgtgcgccaggccatacatatggcagccttgagtcatggcgccacccagatattaatgactttgcttaacatttccatttgtttcaactacctgtaagtgtcttcaaacctttcttgtactgttttgtttttagctctgaattctgtaagtttgccctgaatagtattgtgtatactttggtcataaaatatactcaaagtcaccattccttatgattgaacttgaaatcccttaagatttcatactcactcatatcaaaccaggaagaaaatttcctcatataatgaatacatatactctgacaatcagagctgatgagacagattgcctgaagtggatttaagtcttacttcgcgatctttttcttcccaggatttcctgtggatacgtagcctcatagtgtggttttcttaaggtagaatttttatttcactatgcaagtctctgcacatatcttacttataaatataagatgatgtgaggcttaatcattaggttgagtttttatgaagtcactcttgtgtgacatgtgaattaatcaagatacattatgcattatagtgatgctatagcaataatgttaatttttttaatgcttgtatctttacagtcttttgtagttcagtgaaaatctagtgattatattgttttcaaatgttattattgttattgtttggaatattccctgggagaactttttgcctactccgccaaaatgtaagaccatattaaagattttcttgatttgtacttgcactttatctctgccttccatctcctcttgacttggagggttggagactgtgtctggtattatatgacctgctgtctttgtcaaccatggtcactgctttgccacttgaggagatcttccttcataactttgtgctgacaactaattgcatctcacagaccttgagtaaatggctgaactgagacatctataaatatggatgacagggcctgtgttgcactgttacagctgtgtgtctagcattgtgtctgacatatggaagaaacttaaaaaaaaatctgttgaatgaataaatgcttgactacaaggtgtgggtcatagatttggaaaggaagggtagtgactctgtataccatgttactattcatttagagactgatggccagcaaagaggaattaactccaaaaattagtgggagagtaggggtgcaggaattgagggaatagctgtaaccatggctaggtgtctgcatatccaggatatttcacaagaaagtattccatgatcacccagtaatagaaccaacctttataaggctcctatttattttatttgacttcatttctaagaatgacaaataaataatccccaaatatattcagaatcttaagaacaggatgaagataaacaacttggagcatttggtatagcttatttattatggcttgtattttaagtagaaaagactttattgaatgactaacatgaaattatgtcagagtcatgaaggaatcatagaaaagaggagctttaaaaaaggaggagccaattaatagccaaaaaaaaaaaaaaaaatgctaacctcatggcactatctaaattggcagatttctgaaaagccaagaggcagctccatcggttttctcaaaaagtcctccaggcaatgggactaaggcattggtcttgaatagagttccactgcttgcctactccaatgagaggctctttctccagatgatttcaacttggactgagggcaaaattaaaagaaatatctgatggtactaagggctcatgggtgctatagattgaatgtttattttccccacaattgctatgtttaaacctaactcccagtgtggtggtattagaagagtgggacctttgggggtgattaggtcatgagggtggagcctacagtttgagattagtgcccttataaaagggatcccagggaggtccccactccttcctccatgtgaggacacagtgagaagacagcatctgtgagccaggaagcagtgctcaccagattccaactgtgccggcactgtgatctcagatttcgagcctccagaactctgagaaatgaatttatgttgtttataagccacgtagtctatgatactttgttacagaagcccgaacagactaagacagttaaggatagcctccctggctaagggctgccttcagtggctcagaaatgtcatcttattagaggaaagtccaactttcatgctagacactgggccagccagatacttcctttctgtttttctccctttaccttctctgggaaagtctcagagttgtttgactcaacacagttcaaatattgggccatctttctggatttctagtaaatagggaggagtttgttacgataggaaaatctgaagaaagactgggccatagctttcatacagttaaggtactttagacattgaaggtctgtaaatcattaaactattctggtagtagtagtcaaaatacacatgtataacaggcagaccccaaatgttaacatatttgacaggcctgtaagttaattgctttttaatgtcagtcaaatggattccactttggtttcttggccaggcttctatgggcccattaaaaccccatgaagctgaaaacatgaaacttaatatttgtaaaacatgtaaacagaatagcctttttctgccttaccgtgtggttaagaaattaggactaggatatttcagtttggtatctttctcagaatccaattagagtaagaatttattttattatcttttcaatattgttaataatctagtaacacatttttcacttaagagttttattttcataccaaatcaaaagaaaaaaaaattctatattgctttatgtttagagatgtgcatttggtcagacagtctaacttagtgtattcgtttggtcaggctgccataacaaaatgcctcataccacagagcgggaggcttaaacaacagagactggaagtccgaggttaaggtgttggcagttttggtttcttctgaggcctctcttcttttcttgcagatggccgccttctcactgtgtcctcacgtggtcacccctcagtccatgtgtcgtctgtgtcttaatctctaattataagggcaccagtcatattggattagggcccatccatttgacttcatttcttcttaattacctcttaaaaggccgtaagtccaaatccggtcacattctgaggtcctgagagttaggacttcagtatacaaattttggagagacgcaattcagccctaatgctagggtttaagaaaaggtctttctttcagtttgtgaggactcaggtttctgattgcaggagggtgatgatgtatcttgtgaaggcagtgagcccaacacacttcccttcagagctcgacagggtgagtggccttccgacctcatgccacctcatctttgccagcttctttgtgaggttgctgaatgccgtcttcagcacttgtgaacagttttgaacagcacttgactgcaatttggcaatgtgttttaatttattccatccactgctatttgctgaatatctcttttttacctgtgagctctgcatacaataatagttggttacatacaaattattttcatgtctctatttaacattgagttagtaagaaagtaaatggaaaatatgttgaaccttagattcctttacaagtctttattttctaatttattcaaatgtcaaacactgtcatcacttgtgtattcgtcttaatgaaacataaatcactagacatttattactatatatcttgtttgtagttacaattgtgtttgtgtccagataatcaaaataatgtatttgggtttaagtaaaagtctattctataactttatattaatctatttttgacacgtgtaagcacgcattttagaatgtcagtgtgcaattagatattcttagcacatgtcatttgtgaaaagcactttaaatctaagtacattcaattgagcataattaaaatatcaagatacatattcttcatatacattttgcctcttaattttttaagtagctataagtatctaccatgtgaattcaaattaaaggagggtgattaaattacagttatatttattgcttttagtttaaaatatagttgaaattgcgctatattaaaaaatatactgccatgttttctgtggacagcagactgatgatgggtttaatttgttttaatgcaagactattaatagtctctgaatattctcaagactgttgactagaatgattgggggttgggaggcgtaagaaggcttgtatttttatctaatgagttcttttgacttgactcctgaagtctcaagaaaatgttcaggaatactacctcatttaataaagaagcattggagaaagccttgttttgttgatacaaatgaaaggaaatggatcatggggaaatatgaactggagctcctgaacccttatcctttagataatgtatttaggctactgatatttcctatcattgtgaaaatgagcagacagccttggtgagtcagttttaaggcacatgtaactgttaaacctacttgtccacaactgttggacctaaagtatattatgattttagtgaaggccattgttcttggagtacttagagaaaatggggctgtacgttagaactctggattgtgttgcctttctaaaatatttgatttcttaaaattctgtttgtttgtttgtttgtttgtttgttttccaagatagaggcttgttctgtcgcccaggctggagtgcagtggtgtaatcttggctcactgtaacctccgcctcctgggttcaagcaattctgcctcagcctcccaagtggccaagactacaggcacgcaccaccatgcccagataatttttgtatttttagtagagagaggattttgccgtgtcagccaggctggtctccatttcctgacctcaagtgatccacttgcctcagcctcccaaagtgctgggattacaggtgtgagccacggcacccagcccttaaaaatctgtttttaaaaaataaatagctatatcacttccctgtgccaaaccagaagtgtcaacaatgaagtcattatgtaacatggcaagagggattcgggtggcaaaaccgtaaggaggagaagaagaaatcaagcttatagaagcatgtagacactgagtgaaagacgcagtgataggaaccacagtttggtttttttgcagactagcccatttcagagaaggcggtattagaagaaaaaacctataattttactgtgagccgtgaggaccatttcacatgaaaaaaaaacagagcatttggaaataatgatgcttcgtatcagtagaatgctgtgcgtttgagaagcttggcgcttggacttcatgctgacatggttgtagtcacagtcctattgccctttctggttgctctcagcactcctggatgcaaaggtgaatttatgaagatcatggacttccgatacaaattacagcagccaaaactgtcatatggagatgtgaacttaagattgtattggtagataggtgaagcacccattgctcctatcttgaaatgactatgctatatttagacaaaacctacatcagtataattattttgcaagcccatttgaagaaaattaaaactgtcactagttatatatttttgagcctaaaatatttctcacggctgggcatggtgtatcatgcctgtaatcccagcactttggtaggccgaggcaggtggatcacttgaggtcaggaatttgaaaccagcctggccaacatggtgaaacactgtctctactaaaaatacaaaaatttgggaggctgaggcgggcaggtcatgaggttaggagattgagaccatcgtggctaacacagtgaaaccccgtctctactaaaaacacaaaaaattagccaggcgcggtgacgggtgcctgtattcccagctacttgggaggctgaggcaggagaatgctgtgaacctgggaggcagagcttgcagtgagctaagatcatgccactgcactccagcctgggcgacagacggagattctgtctcaaaaaattggctgggcatggtggcgagcgcctgtagtcccaagtacttgggaggctgaggcacgagaatctcttgaacctgggaggcgaaggttacagtgagctgagtttgcactactgcactccagcctgggcgacagaacaagactctgtctccaaaataaataaataaataaaatatttctcaaggattcagatttggggattttactgccaagtagcctggctttctcattattgattaacctacaaagaaaaatttgatatatctgatgaaaatcagttatattgtacctacaaaaacatctcttccatattacttgatgtattttaatgtcactgaatccattggtttatctttatctcttagaagctcttaaagtcacaggaattctagtccatatgatcagattaaccaaaaattcaggcagctactccgttcaaacaggaaagaaaaaactgaaaatgaattgttgtattgaatctgctttttcacaagagacaactaggcgtaatggttctgagcgtgggttagaaattgggcaagtcgcgttcacattcttttactaccttgaagagaagtctctgcctccatctcatctctagaaagatgggaataatatagcttgtgtcagcatgattgggggattgaaggagatgatgtctgtgaagagtttagcacagtgcctcctacatcagaagtgcttgacacgtgtctggctcttgcttctccaggaaggagaggaggggagaagagagagtttgcagggccgtagttattcaagtagttacagctatctcttctttctggtcacactgctgggtaatttgttcttgaaaagtgtctcaagatgactgctcccacttagtagctggaaaatcacatccttccagaaagggatctagagggcagacatgggtgaagtgtacattgttagagggctgactggaaataatcagtgcagagatcactgtgggcagagccacagccttcaggtcctataaagggcagaacgataggaataatctactgcataggaaaaccaaagaaaagaaggaggacgaaaaacactctggggaggaaaaaataattggggttcactactgggatatctttccctctgctagaagatccttcatacataatgaatcacagtttggaaatggagcctttgaaaaaaaatccttacacaactggtaagagagaagtctcataccagccactgaatttttgcagaaatttgggcctccctccgcaagtgtactttcagactcaaattcctccagcatccaggacctcttgattaactatgtactctcaataaagagaaaaagatgagacctctgggaagcaagaattggtagaagctgggcctggtacagtggctcacacctgtcaccccagcactttgggaggccaaggtgggtggatcacttgaggccaggagtttgagaccagcctgggcaacatggcgaagcctatctctactaaaattacaaaaaaactagccaggtatggtggcgtacacctgtaatcccagctacagcaggaggctgaggcacgagaatcacttgaacccaggaggcggaggttacattgagccaagattgtgccactgcactccagcctgggtgacagagagagactctgtcttaaaaaaaaaaaaaagaaaaagatgctgaaatgtatcaaaaccagcctactcgtcatcctcttttaaaagaaaaagatgagtaaaccatcgcattactcattaggatgttaccagatatgtgagttggtcagagggactcctagctacaagtagaaggagtccactctaccattgactgtgtgcaaagtagcacattttatctacctttttaagatactcggccggatgcagtggctcacgcctgtaatcccagcactctggggggctgaggcaggcagatcacctgaggtcaggagttcaagaccatcctggccaacttagtgaaaccctgtctctgctaaaaatacaaaaattagccagatgtcgtggcacgcacctgtagtcccagctacttgggagactgaggcctgagaatcgcttgaacctgggagatggagtttgcagtgagccaagatcatgtcactacactccagcctgggtaagagagtgagactctgtcttaaaaaaaaaaaaaaaaaaaagacactcagtgactctgtgactctacgtatttggatctttccatttatctagtcttgtgctaaactttaaaaatttctgacactttataaaatgtgtgtaaatgtgtactgatataagatcctctacacgattttttattcagaatattcctgtcttcagacatcttcaggaaaccctgttggggttttgtttaggaggattgctttgaatttagattaacttaggaaaaagttataatatttgactgttataatcatttttaggaaaatttgcattttaaatttatagcccaagtgacgtatttgcaacattgaatctaatgatacttatttctctttcattcaaatgtttatgtgcctttaaaacaatacattttttcttcattttgatcctatatatttcatgttaagttattctttattaatgccacttgtaaaagaataaaaatatgtaagatttcttttggtgtaccagttctattgttctcctctaataaagatatataatgtttttgaatgtcgggtccccttttgaaaaatgctacaaaaagtttgtttacactggtgctagtattcaatactaatagagtgggcaataaaatgttcctcagttcctgataatagcctgggtgagagtacacatggcactgaacttagtaatttatcttctacagtcgtgggtgcacacagtgactcttaatagagaacccgctgtggtgctgcctgcagctctgggtcccctgcagccaggtgcaggtatgcagcccagtgcagatgtgcagccctaagccctgtttaaacacatggccacctgctgtaccttctaacctgttttgagttgaggaacagaatgtgtgagcctatgaactcacctctgtggtcatcagctgcttcatcttctcttctgtgttacagatcacagtaacttaatcataacttcctatggagagccagaatattattttactattgattctgaaggggtcttttgttgctgatgtggtttatgcatcagaactttagttgttcttgtgccaaattcgattctgtttgatttttttaaatctccaaagcataaatagtaaggacaactatgatttgtcagtttctgctctgtaacaaatttatcccccaactctgtatgtcactaaagcaaatgcaaactcttcatgttctacctttcactcctccattcagaacttgtactgttatgcgtaagcacagcataattatccctagtagttttatcttttcactctcttccccctagatattttctccttaattaccctaaatgaattgtcattgtctcttgattgctctcataaactactgtcattttctcactttcccttcccctgcaagtagactacacagctctctcattccccagcattctcgttccaatcctaggtcaccccatgtgctggactttgcctccctgtgtcagtagacattgttggtcctttcgccttctcacttctggaagccctgttcttaactcttgtgcctggattgctgtaccaccggtgtatagcagaggtttttcatcacttcatggtctctcgccactttccatttttcttcttcatcctcccaccttatctaaacccctgccttcagttatatatgtggagtgatgccctcatctgtgtctctcatccctcttaactcacccttccactgccttctgaatgtgtcattattcgtctttccaacactttgttcctattacacagcaaaaacttggatcctttctttgagcttacccactctttttgccctatattcagcagccaaatcctgttggtctctgttgcatccattacccagccacctctattcagtatagatatgactgttctaattctggccttttatcactcacctagtcggctaacaacctaattgtgatccctgcctcaggctctgcctcccggatgagccctctcccctctgctccctaggcatcttcccaaggcatagataatgctcagacctctacagctcctaagctgtgtttaccagctctcctgctgctacatagtcgcacagaccatctccagaatgcagcctgttctaggcagcatcctggaccttccatgagttggctccagcaatcttattttcagccaccttctttcataccccttctccatgccatctagagcaaaaggctgccatgataagaactgtaagtgtgccgctggcatccagccacttgagcttggaatccaaggttcaccttcctagctgcatgactccaagcatgttaaatagcctcctttactttttgtagcctcagtttcttcactgaaaccaggattttatttatttatttatttttattgagacggagtcttgctttgtcactcaggctggagtgcagtggcacaatcttggctcactgcaacctccgctgcccgggatcaagtgattctcctgcctcagcctcctgagtagctgggattacaggcacctgccaccatgtccggctaatttttttgtatttttagtagagatggggtttagccatgttggccagcctggtctcaaactcctgacctcaggtgatccacctgccttgacctcccaaagtgctgggattacaggcatgagtcactgcacccgacctattatttatcttattacttaccttataatattatgaagaccaaaaaacaatttttttttttttgagacagaatctccctctgtcgctcaggctggagtgcagtggcacgatcctggctcactgaaatctccgcctcccgagttcaagtgattcttctgcctcagcctcctgagtagctgggattacaggtgtgcgtcaccatgcccagctaattttgtgtatttagtagagatggagtttcaccatattagccaggcttatcctgaactcctgacctcaggtgatccacctgccttggtctcccaaagtgctgggattacaggtgtgagccaccacacctggcccaagaattcttatagaactcttaccacaatccctggtacttagtaagctagaggagcctcaataaatgctagaggatgatgatgttgatctcatcataattatcatccttattaaaatttcgcttggcagaagtgatgctgggtatattacccatataagtgtgatatgcccttgtcactgttcctttgtgcctttctctgcctggactaccaaaatcctaatcacactgtagtccccagctaacatgttaccttctcactggcttaatcacctcccagccaggagagctcttgccctcctttgaactgtcatatcagtttgtctggaccttggatcttatcatataattatctgttctcatgtcccattttctgtatttatgaggcatatagttactgaactccattgaaaatcctttcctctgcttgctggctatatagccctgggtacgttgctatattagtttgctagtgctaccaaaacaaaataccacaaactaggtggcttaaacaacagaaaatttatattctcacatttctagaatctgaaagttcaagatcaaggtgttggcagggttggtttcttctgaggtctctctctttggcttgtagatagccgctttttccctgtgtcttctcttttgtgtcctacatgtctgtgtctcagttttctcttcttgtaacaaaccagttggatgggattacgtcccaccctaaagacctctttttaacttaatttctcttttaaaggccctgtttccaactatagtcacattctgaaatatttgagagttaggacttcaactatgacttttggtagaacacagttcagcccataacagttgctttaatctttctgtgcttcaatttcctcttatgtaaaatctgcaaaaagtacctcttgagtggactgaaaatatgtaatatatgcaaagcaacaccttaataccccataatagatgtttaatgaatattcatgacttctacccttactacttcaagcttcttgagaatgagaataaagcatcttgtgtccttgcagttctaggacaaactttgaattgcttataaatatttggtgaatgaaaaatcaaatagcagaagtgagtctataataattgtatgcatttctctttctctcttagatggatccagatactagatgataactaagatttcaataacaaagagtataccaggaaacatgtagaaaagtcagtgttaccgctgtaaatataatatgccacactgagccagttcagtatggaatattttcccatgtcctacttgccacagactccagtaagtcatagggaaatgatttgtgacaaaattgcacacacacaaaaaaaacagtatcttcacacagccagagctttcaagtgatgagggacgcaaagacattgtgcacaataggtgttcctgtccattgtctgccgattcagctatctttgatctctgcaaaagaggaaccatgggtatggtactgtgaatgcataatagaccaggaattggaagagcggcacgcagtgtgctgctcagtgatcaagtcgtggagagacccagacaccatgcatctgatgataagcatcttctcttggtgccttggagtctctcatttccttccagttcgactccaaagggcctgtttcatcttcagcacctttacaatgtgccactttgagtctgtaggttctttctttcagaggccaccacagataatgggtacatcattatgttttcttgatatcactacattctttcttccccgtgcatctgcctcctgcagctctctgaagtggatttgactcctcatcatccctagtgataactaactctgctttaaaagaattgttatctgttggttggcttggagtcagggagttgagtgtaagttcttgttttattgtatataatgctagcaacttttaccagtgttagtaaagataagagataataagacaattccgtacctaagaattgtaccctttcataacagcaccacttggatatgtagaaagagtttgttgtgagatcagatgtaaaacaaataaaagttattcgtgaaatgatatggaagactgggattagaaactgtggcattcaagaagccagttaagctgattctcagaattgacagagattctagagatggtgtagtgcagatggtgtagtgcagggattctcagcctcactgcacatggtaatctcataggaaaattttagcaaggacagatgcagaaattcttattaaactgtcaggactgaagtccagaggtcactatattttaaaaaggtctgcaagtgattgtaacatgcatctatggaggaaaacatcagcgtaggagaaaaagggaaagaaaccaactggagtaaaggctctgtcttgagcactgtgctggctcctgtacattctccatctctttttatcttcatagtaagtgagatggtttgacaaatagggagaccgaagctctgccttcatgtgggacactcaactgcctccttccctgctgttggcagtgcttggatgaatatgcattgtatgcctcttctctcttccaagaagactggtttctctgattactttgcattttaccctggatagagatggtcttaccctcttttgagcttcaaaaaatcaggcttcaggctaattccaacctggtgaatctttctcagcaattctacccccataaaacaatctttacattttaaatttctattcatttttctaactattcataagattttcgtatgaagagttctggttcagaaacacagagaaaatccttaccgtgcctctcacatggttacttggttaggtgtgtttcaactcatcattctgccaaccgtaaatagctgagtccatatcacatgggaaatgtaggtgcaaattcacaaaacactcacgggctgtaaacaaccagggagttgttcttctcatggacctgcaggttgcagcagcagcatctgagcaaaacagagctgttctgagcagtagggcggggagcagcacgtctttgtgtggaccagaatgcaccagcctgtgggtgtatcatctcacactctacttcctagactaaggccctttcttgggcctttcagtgaatccaacccaggttggtattttgtgttgtcccccaacccaaacaaaaaattcatttgcacttaaggaagaacaagagtgacttgattaaggtatcaagttggtaaaaatggaaaaacaatttgatttagagagttaatgaacgaacatctttctttgattcttttcattaacattacacatattaggtaaactgtgtataggtgtttatttttctttatggaagtcacacatgatctatatagaaaaaatttcaaatacatcaaaaaaaaaaaaggaaaagaaagatacttgtaatcccaccacttcagaagcaccactttggtgtatttcttccacatggtggtaggggatggcagggggaaatgtgtaccagtattttaaacatatgagcatttttacttaaaagtatatattgaacatttttcactgttgactgcatagtatctccatgcatgaacatactcaagttcatttaacccatcccttaccattagatatttatgttgtttctaatttttctttccagcttttataaataatacttcaaaggccatccttgtagctagttctaattagtacagtatagtttggatgatataaaaatttcatatatgtgtgacaaggaataacaagttgaagtacagtaagaaagaatgtaattgcttgtgataaatataggcttagcttcaaaatagctagcttaaaatttcccttatagtgtactttaaagatttcactgatgatcttggaggtgaggcatctagccattgctggaatgaaataacacacgatgttcaaagtttggttggtaattgacttagtgcatatttttgctactttcatataccacttatctcatatgaaaagagcaattctgtacacaagtaatacataaacaaaaattttaagaatatgtaactccataaaatgagatttgatgattgacttgagtttctaagagaaaaaaataataactttcatctaagtttacgtgttcgctggcagtttttgaatcgttgccagaatcatgaaattcatcattcaagagcctttgtcctcctagtccccgttctgttctgtgtctcctcatttggatacgttctgtgtctcctcatttggatacgttctgtgtctcctcatttggatacgaatgcttttcattttattactgcctttgtgcccttggctttgagtcctgtggtggcagttgtttgtgcttcaaggagcatttgtaatttcagtgtgaggacttggggaggtcaacagaaatctctggtctttgccctccttcagcctccacattaaggacatagggcttcttcctaggcagtaactgtattttgattcatacttgtaatccctaaccgttttgattgatgggacaagggctgaaactacattctcttgaggatagaatatttttatccttgagaataatcattcatctcttcctgacccaccttaccatttctttgctttgatcctaaatcttttttgttctttttaggctggaggctcccaggtgattttcacaaatcctttagaaatcgtcaagatccgtttgcaagtggcaggagaaatcaccactggtcctcgagtcagtgctctgtctgtcgtgcgggacctggggttttttgggatctacaaggtaacttttttttttttttagtcatttatttgattactttctcatctcctaatgcagaaactattcttcaacatgaaatccatttttttttgcatttctacacctggagaagatgttctacccaagctgcagaggcaccttcatgccaattagaaggaggtgccccttcctgccatctgccaaaaaactatcctcatcaatacacaaatctaggatgactatgataggaatcgtgccctctagagttgttcagtgcagctctttgcagcaacactggctagaattttatttggatttgttattgatacgctgagttcagttcaaggagaaacctgtatcataatttattttctgatcctatgcatatggtccgatccatgttttctctatatatgtatgccttgtcttaattattataaatcttaatcatttttcatttagaaaatgttttttcagaatgattacaaaaccaaacttctagatgattcttgaaattttttattcatactgctctaccaaaaagttataatggaatttactagaactgtctgcctatatgccaacctataaggctttatcaaacataatgtatacacaagttttcaatgaagaattttttaaaaaaacattttacgctagcttgactaagtaaacctttagggatatgggagaaaaataaaatgtctacttaagatagtttcatttatttacacagaaatgtatacagtcacattatataaaattaatactgctttgtttctataaacacatatcaagaaatattaaaattattcatgaattttgaatcagcatcttgagctccatttaacccactttttaggtcatctgttagcatggttttgcagaatacattgtcttcatttttatcccaagctttgtaatttgaagcatttttgacttttatgtatgatattgttcctgcaaattttatcccatagacacataatattaagacagtcaattgcttttttcctattcccagttaatcctgaatggatataactggtccccataatgtaacaacttaccatattgctagagtaaacttgaaatgacttgttttgacatttgacacagtatttgtgagatcctcctcccagaaatacttttttactctttttctttctaacctgagttttgcaagtgacctcagtaaacatccagaattagtaataattgtggctgtctcaggagaatctcccttccccgaatggtactctgcttctccaggtcaagtgattggaaagagtactccatgatctgagactttgtgaagattgaatataaagtgatgccctcttttctgggattaattttagcaggggaaaattttgccttatatttaggcatatgtggtacttaggaataaacctgctgtttttttaagtagaacttaaaatgctcaatctgtgattctacaatataacacaatgttctatagctattttgcttaccaatttattacccagctgtaaaaaataaacactgttgtcatgaggcatagcattgatcaatttgaagaaaaatcatcttttctaaatttttaggctcttgcagtctgtaatatgatgtagcagcatgtcattttgacaagatgccaggagtctttcaatgggttgtctggtaaaaagcacttaggtactgtggcagtgactgttattgaaatgtctagatgagtaaaatggtaggaacttgtttgctgatacagaaacagagactgttaaactacctgcaaatgatacaatactgggacttagtgcttttcatcttcacattatttaataatcttaatcccctttaacacttcttggaagtagttggtatcctggttttgtagttcaggtgaatagaggctgccaaccatggtatctgagctgaaattgaggctcagaagtttcttgtttccacttttgtgctaaaattgctttcctgaaatgagcaggattgctcaagtttgagcaagagaactctcccatatgaagttagtttaattactagtctagtagtttaatctagttcagaagcattccacagggcttggtgctcccttctaaaatgctgtttttggtgtactggtaattaccaagaaaatcagtaatgctttgagcttctggaaccttgattttgttgcaagaaagtgacctagtaatctctatcttcctgttggtcatcagtatcagctacattcagagacccgggagtcaggatttcattcagcagatgttgacctctgtggtttggtctcctttcagtctgattagctcttgtattacaagtctggttggtcctcatttatatattcccagcattctgtcttgggctttgtttcatgtgaacctctcttctccagccccaccccacttcacctttacgtggtcagacatcacagcaggttaagatccatctttctagggagcatcacagcattagcattgctttgtagtttaatgtgtttttgtttcaggatagcactttttagtaataaagcttttctgtttctagtcctggttggctagaaaaatgcaaatgactaggggtgacctcacacagtacttttaaacctggtatgtgtccctccaggtgggtctttaaaaagaagaaccactgtcctagatttagttgagacaggtaatctttctccttccctctgttcttttgtttctgttgttaacattacaatgccagacccaagaagggtgagtggttggctctgtctgtgtgtttaggcctgctgagctttaaccttacctaaattggaaaatcaggctttctgtttttcttctgtattgacttgcaaaataagcaaactattctgacttcccagtaagtggcaattagaatacttgttttagaaatacatttgcaactgaaaaaaagtggaaaatggtaaacattttgcattcctaaagtaagaaatagtttagcacaaatatagtaaacaatgtaaataaagcccccctctaaaatgctaacatttagagagatttagttatagcacagaggatgtaggtgactgaagtgaaggcagcataattaattgcctttgaaagagctatttgaatgtaatgtagctaagaaaacaaatctgcaatgtctacttctttttaaaaagaattatgagaatgtatttccctttccctgcataacttctgttttattgcataaacccctggagcataaaaataaaagtcaaataaacttaacatagcaaaaaaagttgtatccatctacttttgaacattaccttttccgtaggagctgtcagagcgttaatgaggggacaaattatactttaggaatggaatgaaacttatcatttaacagtaaatggcagcacagctaattaggccaaaaagacgcttcgttaggaagcagtggaactgtccatgtctctttttgagtacaaaacatggtcagtgaagcaatgacagctgggatccatcaagcactgttgaaaagttttcaaattctataatcacaaattaaaccttgattctaccttggagggtcacttaggaatatggactctgtctgctgtgttctaatcaaaggcgttgtttttttccactgcatttgacagtattcaaagatatttttatccatatacataaatgttgtatacatgtgttcatctataatgtgtgtataaatgattcattggagctattgttcataaactcagaaagcaagttatgatatatcagtacattcttatttattctgccagttatctcaaagagagattgatttttttagtttaaaaagtaaaatataatttatatttcaaaaaaatcaagtaatttagaaaggtgtatgaagaaaagtaaaattatctctctaccctttactgctccattctcttcaaaggatagccactgctgaagattttatattaatatatccttaaaaaaagaaaaactttctgctcagattagtatttctctttcaaaaattttacgaatatcagcatcagaaaagtatgtatgttttccatagcaaagacatagaatcaccctaggttaccattaacaggagattggataaggaaaatgtggaaactacacacaatggagtactagacaaccataaaaaagaactaaattatatcctttgcagcaacatggatgcagctgcaggccactatcctaagcaaatcaatgcagaaacagaaaaccagatatcacattttcacttgtaagttggagctgaaccttgggtacacatgagcacaaagacaccaacaggaggaagggaaagaggaaaggaggaaagggctgaaaagcttcctttcaggtactctgctcagtacctagctgacaggattaatagaagcccaagcctcagcatcatgcaatatatccttgtaacaaacctgtatgtgtaccccctgaatctaaaattaaaatgaaaggagaatattttacttttcttaagtaaaattgtgttttaacacaaatagaatcttttcaaacacaatatatcttaaagctctttcctcattttatttaataactatggaaatttttttgtttaactgtttgctgttgatgaatatgtttctagtttgaagatatatcaagcaatgccatggtgatcatccctatgtatattttgacatacttttgtgattgcttagaaaagataaattcctagcattgaagttgttaggtcaaaggacatgtgcactttttagtgttaatagattttatccagtttttttcagtttatcccttttttcttggtaacatataagtactcataagattaattcttcagtttatcatcttttaaaaacttgtatttttacgtgctcacagccggacctgaaggaagcagttgtttagtctactttgagaacacattgccattctagttttctgatacccagggacatgctgtggttttacaaccagcctagtggtagttctcacccatccatttctacttttatccttcatctgagcatctgtgaaagcctcttcagggctttctttattttgtctcttgactctcctaaatccactgttgccacagcagccaaagtgatccatttaaaatgtaaatcatattaattcactcactcaacacactcattgagagcttactgtgtgccaggcactgttccagcctttaggagatggctgtttaaagccaagtccctgctcacagtatattgggtaggacagggcagctatcaagagaacaaagatatggccgagcatggtgccttacgtctgtaatctcagtatttcaggaggccagggcaatctcttaatgccaggaattcaagactagcctaggcagcatagcaagacaccatccctccaaaaataaataaatataagttagcggggcatggtggtacacatctgtagtcccagctacttgggaggctgaggcaggagaatcacttgaacccaggagttcgaggctgcggtgagctatatgattgcaccaccacactctagccctagcaacagagtgagatgctgtgtctaaaaaaaaaaaaaaaaaagaaagaaaaaagaaaggaatgcgcaaaattaatatgacatcagctggtgctaccgtgaagaaaaagaagctgattttaaaaatgagcaaaggactagaatagatatttctccaaagaggacataccaatggccaacacgtatgtatgtgaaaaaaggatgtaaaaaattttcaacatcactaatcatcagggaaatgcaaatcataactacaatgagatagcacttcatacctgttaggatagctattagcaaaaaaaaaaaaaaacaaaagataagcaatggtgaggttgtggagaaattgaaatctttggtggtaggccaggcgcggtgcctgacgcctgtaatcccagcactgtgggagaccgatgcgggcagatcacgaggtcaggagatcaagaccatcctggctaacatggtgaaaccccatctctactaaaagtacaaaaaattagccgggtatggtggacgtgcctatagttccagctacttgggagactgaggcaggagaatcacttgaacccgggaggtggaggttgcagtgagctgagattgtgccactgcactccagcctgggtgacagagggagactccgtctcaaaaaaaaaaaaaaaaaaaaaaaaaggagatccttggtggtagaaatgtaaagtggtacagtctctgtggaaaacagtatggagttttctcaaaaagttaaaatagaactactatatgatccagcaatcccccttctgggtgtacatccaaaagaatggaaatcaggccgggcgcggtggctcacgcctgtaatcccagcactttgggaggccgaggcgggcggatcacgaggtcaggagatcgagaccatcccggctaaaacggtgaaaccccgtctctactaaaactacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaagaatggaaatcagatatctgaaggagatgactaccaggttcattgcaacattattacaatagacaagctatgaaataacccaaatgtctatcaacaaaggaatgcataaagaaaatatggtatattatagccttaaaaaggaaggatatcctgcttttgcaatgagatggataagtctggaagacattatattaagtgaaacaaggcagtcacagaacttcaaatactgcatgattctattcatatgaggtgtctaagtgtacatattcttgatgtatgagagagagtgactgagtcttttcacaaatataccaacatcaaaaattgaaataagtaaataaataaataaaaatgttgtgccttactcctgatggacttttattctctcatttaaggaaggatttttagaaatttaaggagagggtatcaagtatacctcaaggagtcaggttttgtatctaatatgtgtgaacatttgaaaaatactacaggtcatgtaatgtccataatctctgcttaaagcttgtattaaacaaaaactggaaaaaaaaagaacttttaaaaaataatttcaaattttattttacattggagggaacatgtgcgggtttgttgcacaggtatattgcatgatgctgggatttgggatatgaatgattcagttacccaggtagtgagcatagtacccaatacttagtttgaaaaaaaaatttttctttttacgaaacttcccctgtgcttcagatgaatcattgactcgtgtgtagaaagaggataataatcatacctacctattcatagtatcgttgtgtggatttactaaaataatgcatgtaaagcatacaggatagagttgagcacatagtacacatgatgtgttagttgttatcaacttttcattattgagtgtcaactaagggattcttgcaggaatacctagtttcttccacattattccagtcctgggtaatttccaatgctgtgtggtcaacaacctctccaggccaggtcttctgctttgaactttagaatagcaaattaaaaggagatggcttgaaaaatattatttttataaaacaatgcccagaggaattgagtgtgctaaagacaccagaaaaaaaggattccttaaagtaacagcaaatgatcaatttttttaaccattcttttattctttcaccaaatgtatattgaatgctaacactattagatgctagagtaccaaagatgtgtacagtatcattgccttaaaaatgatctatgttaaggggcaagagaagagaaacatataattctagtgccagcactttgggagtgcaggagttcaagaccagcctgggcaacatagtgagacctcatctctacacaaaaatatttttttaattagctagacatggtgtcatgcacctgtagtcccagctacttgggaggctgaggggggaagagcacttgagcccagggggtcaaggctgcagtgagccatgattgcaccactgcactctaacctaagtgatagagcaagactctgtttcaaaaaaaaaaaaaaagaaaaagaaaaaaatgcaacaaattgcaggtgtaggataattgaaaataatccagactagacacatcagaggaaaactgctgaacaccagagctagagagaagctctttagtggccagagaaaaaaagtcaatttgccttcaaaggggcaacagttgaactgacggctaacctaaaaatggcaacagtggaagccagaagacagttgaatggggtgtcttcagtatgtggaggaaaaaaacttttcaacctagacttgtataccctgtaaaaattgcttttaagaacaagggtaaagatattttttagactagcaaaactcagaaagtgtgtcaccagtagaaccttaatgaaggaaattctggaaggtgatcccaggtggagatgtgtcaggaatgaatagcaaaaaaagtggtaaatgtttagtcttgttaaaagtaaaacttcagccaaagtaagggagtttaattgtacaatgaatgattcgtgaatcaggcagcccccagaatcacagcagagagtgctgaggcgggcagatcacaaggtcaaaaggtcaggaccatcctggccaacatgttgaaaccccatctctactaaaaatacaaaaatttgctgggcatggtggcgcacgcctgtagtcccagctacttgggaggctgagacaggagaattgcttgaaccagaggtggaggttgcagtgagccaagattgcaccactgcactccagcactgtctcaaaaaataataataataaagaaataaagaaaaggtggaacatgttttacagatgagctttgtgaaggtgacatgactagcagcttcaggactaaaattccatgtgataacattcctctgtaccatgtctaggattttcagtccatctcagtgatgagcattgttgatggcaaagcagtgtacaatactagaacaatagagaactagcactgacccaagcagcatttcctacaagaaacagagttgtcaagatgattttgttagaattgcaatgaaattaaggagaacccatatccctaaagtccctggattaaagaagccaagtaatagtcattcatatttcatattcaaattgaagtaatttccatgttcactgatatcaagtcttcaaatgttggctggcttatttggttttaacacaagtgacacaatcacataataggtcttggcaccattgctatttctcagcaagacactcaaactcaccctcctcaaatctcagccatgtaggtggggtctaaccatcctttgactgggctggagaggcactgccaagctgtgtatctaagggttaacttgcttgggggaagccaagaggaatgctaagggatcaagtcatgacatgctgcccattgtttgtagctctgggatcaaaatatataattatacatgccaaataaattctaaacctgtaaggtaggaaaagagggctgggtggctctgacgacaggtgccagaagcattgaataaccttctcagacaaggtgcaccactgttgtcttgaatgctgcagggtccccagtctggcattttccccgtgctagacaatgtgcattcactgctggagtctctgttaagcctccgtctcccagacctgctggctcctggtgcccggcccgacacagaggtgcctttgtgagtgtaattacctttccctgtattagaaatagtctgtttagagctgtgtttgcaggtacagctagaataagcaggaattagcatgcaaaaagacctgccctggccctgacttctttatcagcaccatccttcaggactggttttttccccactttggattgattgggcaggtgatttaccatccaagatgaagagttttaaaagaagaaaaagagacatcggaaattgctgtgcatgtgcaacagcatgcgtgcgagagaaagagagatacaaatcctgttgtgttatatctattgacagtttcataccaggcagagctggcaaaataaacttgagtggacgatcctagcaacttgagaattgattaaagcttccttgggctttcagcacagtgtccacatcaaaaaggcatgagaagcaaaataaatgattcttttgccatgatatgctgccgccagaatctctaagcctatctaattggcctgtgtcaattgtggactattaatttgaagttaagtgaggcctacccttaaagaagcttttctagatcttaaataggatgatgatggagagactttggcatgatatagaattggaatggaggcagagttgataattaaactagatctgagggttttttcccagtttataacgtaggtctaccctgagatgatttttgttgtccctgtctggatattagtgtgccttttatttaaaaagaaaaacccaatagtttatcatctttagagagattagatgattgtattttgcatttattaattttccccaactgattatagtatatactgaggaaattcaggaccaatcagagaatgtttaagggcagagctgcctagaaaaccagtttaaaaaaaaaaaaaaaaaaaaccaaagcaggaaaatgtggggattttcttatatggcaggaatgtttaaatatttttttttaagtggcacacctttgtaacttattaattctcaaatggccaaagtaatatttttgtgttgctgatgcaggctctagggcagcatggaatgtttccctttgttataaagttgccttttcagaatggctgatctcttggtaaaaattatacatggaacaagtagaattcaagtcaaacaggtttatgttttgctgtagtactggagaatgggtgttcaccacaaagtgaaggatttatcaaggaatctgggagagaaacattttcccccttagaactttaagtctttttaacatcctgcttcccttttcattgtgcaagagcaacaggtcaggtattgcctaaggcagtcttacaaattggcacctgcctttatgcctaagacctaaaggaagtggtggggaaaaagaggccagggaaatttaataagtctctgtctttccttgggaattgggctttgatgcctggggtgcaagagaggtgaagggccgcctcctgacgcaactgggagaggtattttctgcagggagacaccagagaaggtgctaggagaggcagggagacacagccctcaggtgaacacatttgtgtcctttaatgtttgtaatgcagtggataccttacaaggactttcacacatattacttcattcattcctaaagtttcagttgtcccagtcacctgaagaagatggcctttggtatttttgacaggtgaggaagcttaagagcttgatttctacaggtgctcatcacatggctaggggtgacaggatgatcacaccaggtggaagttcttttgcttccttgacttttccatttcttcctttttctcaggtaatcagacaccaaagacttcttgcatatcctaacatttgttctagtctgcataaacactttgaccacattgcttgattcctggaaaacgaaatacaacccatttctaggcatttttcctttagtgttgcaattctaccctttcctcagggttatatatatatatatatataaaattgtttgtatgtttggtttttaatcaagccatttctcatctcagccatgtagagttgttttccagcatctcttgaagtacatctcacatctcttgtagatgccattgtaacagggatacatgatttactgtcatgatttcaggaaaggaagaagaaggaggttctcagaaggtggaacactcagtgggtccttcttcagaagacccaactgattcttcatgtgcctttactcttcctgtgcctcagggatgtttataatttcgagtcatgtcttcccatggccttctgatcatactgaagccacatagcataagacaggttaatctgcttctctttctcccctcgccccctttttttaaactttaatgtttcaatacaaaattagtgactgtttcctcctacgttttgttacattcccaacaaataatatgtctttgtttgaaaagctaaaagtggccaggcgcagtggctcaatgcctgtaatcccagcactttgggaggccaaggtgggtggatcacctgagatcaggagttggagaccagcctgcccaacgtggtgaaaccccgtctctactaaaaatacaaaaaactagctgggcgtggtggcaggcacctgtagtcccagctactcaggaggccaggaggctgaagtaacagaatcgtgaacccgggaggtggaggttgcagtgagctgagatcatgccactgcattccagcctgggcaacctgggcaacaaagtgaaactccatatcaaaaaaaaaaaacaacaaatgaaagaaaagctaaaagcttggttttagtttctgatatgtttttccaagaaataatgttttttaatttttattttttatttatttatgttttttattaagatggagtcttactctgttgccctggctggaatgcagtggcatgatctcagctcactacaacctccacctccgggttcaagcgattcttctgcctcagtctcccgagtagctgggattaaagtgatcttcatttgagttgattatttgatgtctaatttgagtatcttctggactgaatctacatgtggatgaatagctagcagcacttacaagaaggcttggggcaaaaagggaaaaggaaggaaaaacagaaactaaacgctgatattgttagccttatacaataacagcccgaattataactttttaaaaaactagttgtaagaaaaggattggatgttacacacagttattaacattatactgtatgttttccctttgaaagagctgggagaagtggaaaaaactcttagagtattgagttttggacttgtctctggaactacctccagggtgccctctgaacaagccaagggcatagccctcggtaaatgcacaattgatagattacccatccaggacgatagattacctgtccaggacgttagtttgtacgtgcctaaaatgactagcttgggtgtggtggatattgtgattcttaattagacatctaacactttgggggtggacaagatacagaagcctgagccggttggcagtacatgaggtagatgagtgcttctctgaatacctgtatacacagagtgaacagaggcatgcttacacatccatgggtaagttgactgaggaagagccaacatgacagaatccagattccaagcatttgttctggttggcaggatgagccaaactaggatgcaacttaataggattaaatctgatgtcctgcctgtgttacttgtgtgaggcaactaattaagttatagtagacttgagttaatagtaattcatatgaaaaagactaagggttttattacccacaagctcagtttgagtcaggagtgaaatgtgcgtgtcaggaaaacaaaggctatagtaacagatacatagtgttaaataactttgacagtttggagcatcagacagaaatacccaagatccagcattactaggcctcaataagtgtcactgggtgtggctagatctgttgactctggctggattcattattttcttttgggaatctctgtatttggtggaaatttttagttattagaaatctgttaaagaaatggtattaaatcattacatgttgaaaagtgatgatttccttcctattcaccctacccaaaacacaatatatgtgttgtggttttcatcataatatatcatatttctgggcactcatcaattcgcggggcctctgcatggcattatgttggcaacagaaactatttgttgaagactttgctgtaggaactgattgttctacacacagctttaaaatgtatccgaattattgtgaatatttcaggctttagagcaggcatttatcaatgtttcataaaccctgggtggcaggtaagtaagtatataataaaattagaaggatccatgaaccccctgaaaagatataattttttatgtatgtgtaatttctttctgggaaacagtccaaacgtacaaaaagcaaaccccttttccccccacctgtataatttgtctacttcctagtgtgtaaacaaagaggcatcttgactgccgttacccgtctttggtgagaccagagaacagatcttccttgaaatgccagtggcttgccaccagtagggatttaaaaggatgtcacaggcagagttccaaaaaggttttaattgaagtcttagcattagaataaatgagaactgccctcctcccatcacagcacacaacaaaactagtttttgttttaaaaacaaagtttagatttattacttgcagaatttgggttatttttttctgttcccctttcaatgtgtgagtacaaatttggtcttctccaggaatattttgttctgaggtgagttccagagaagcttgatctcctcaatgggatatgtgtttcatgtggtttttcttcctttgcaaatgtgcagggtgccaaagcatgctttctgcgggacattcctttctcggccatctactttccgtgctatgctcatgtgaaggcttcctttgcaaatgaagatgggcaggttagcccaggaagcctgctcttagctggtgccatagctggtgagtgtcccccatggagttctcttacttccctgacccttgctgccccccttccctagctgcatgctactacattgaaatttttttgctgatagttcttgacagggtatgtgtgagtttgctagagattgaagagctactgaaaaaaaagggaaaaaattaatcttcattctggcagatgagattattagacaagcttaatttcttaactctagaaaaggctcattaaatattggcttattttgtggtattgtggaactccaattcaagttccatatcatttcatagtctcacttcacagcataagaataactgtttagctggaagtttttaaagatttgaataggtttgtcttaaagatgtctaaaaaaaatagtgcataaaagcctgtccagaacttaaacaatagttagagaaaagaaatgtagtagaaccagaaaagacctgggccaattagagacacctgtttcctccctgtgttacggggggatggtggtaattaaatcacagatggaaataactatcttctttttttcagtgctccattgaaaacatcgatagaaaataattaaccatgccagggatcagttcattttttgatgctgcttcttttcaagggtccctaagagcaggaacagtctggattagctctccaagtggtgacatttaataagttaacaaaccctaaggcggtcacaggatgcctggatccaaacatttttgatacctgtgctattctcatcagatatgtaactagagtctccatgcttttctcaaagatagcataagaacaactcccagctttgagaagttgtttgctgttttgtgcacaccccacctaccctggctgcagcctggggaacccctggatgcaggaacctgtgtagctcctccttaattcttagttaatccttttccttcaaaggcagtgatattggtatataaggcagggctactgtttcctggctgcttagaaacctcagttgtattagcagcagtgataccactgtatctagagcaagagatcatgatttcaggagttgagtataaaattcccaattttaattccagcttgactcatggtggcctatatgtaatttctcatatatctgtaaatgagaaaatgttttgaaccaaagggttataatttatttcaaattatttacttgaaataaggtaggacctaatgagaataactgagtaccacttattaatgtgtgaccttgggcaagttacttcacttcttgtaagctttggtttcctcagctataaatggagatcacaactgcacctgctacagagtgtgtgtgaggctcaaatgagaggatccatgtgaaagacttggcatagttcttagcatacagtaaatgctcaataaacattagccaagtattacattgaatccaaaagaatctgtctgtaaatcactccaaaaaataagttgtgaaattagaagttaagtagtagagctcagatcaaggtctaggactctttcctaagcctcactttcctcacaccataaaaataccatctttaactcttttcttggagaagacaggtacccagaaacgattctgtctctgtggaggtaatccattctaccagagctatagaaatgactggtgagattttttttcatttaaggtttatttttctccttttttaaatgattttgaaactaatattactcattataaaatatttgaaaagtactagaacaggcaaataacaaaaatattattcattatttcactactctaagataattgctatttaacatttttactcatttttcctattcaggtttttcacagagctgtaatcacactttgtatagatagttttcacttaaggttgtgtcttaagcattgttacccatcatggcaaagtagttaatgacatgtgcctgtggggtcagactaccaatgttcaaattccagtgtttccaccctgtgtgaaccacacacattattcattccctctctgccatttctccatctgtatttggagataagaatagtcttaccttacaagattattatgagaattaagtgaattaatagatgaaaagattaaaatagtgcctgatatatagtaagtattcaaaaatgttccataatagtaattttattacatattatttaaaactttccgaacatagtttctaattgctgcatcttatgtatttctcaattttagatactttaattttttccaaaaaattttaaatagctagtagtatgctttttcccctatgttgaatcagttatttttttttaagagaaatagattatctgaagtgagtttgttggtaaaaagcatggttgtttttcggtcattgacccattattcttgagagttttaagtagttggcatccctgtggtgatgttagttcagccctcttgccatcctgttgtctttataaatgccttctgtatttgttatctattactgcatgccaaattccctcaaaacttaatcagcttaacacaactaatatttattttctcacagtttctgtgagtcaggaaacaggtgtggggtagaagcagctcactgggtgcctctggcaccaggtctatcatgaagttgcagtcacagtagcagccaggcttgactgacattggagaagccactttcaagatggctcaatgacatagctgttgacaggaggcctcagttccttgtcatgtgggcctctccattggtcaacttggataccctcacaacatggcagtagattccccagagcaaagtctgagagagagagagagagagagagagagagagagagagagagagcaagcaaggcagaagctgcagtgtcttctatgacttcacctcaagatgatagagaagcagaggcgtgaatgtcacaagggtgcagatctttgagggccattttgggaactggctgcctcacttactatagagcattgacttttattattattattattattattattattattattattattattatactttaagttctgggatacatgtgcagaatgcgcaggtttgttacatagttatacaagtgccatggtggtttgctgcacccatcaagccatcatctaggttttaagccccgcatgcattaggtatttgtcctaaagagcattgactttcctattattatccaccttcctcctgatcccccgtttctggtaaaatgggaaaataccgagtttgccctgttgattttagtcttcaaagagtgaataagctacaaagcttgatggtctttgtgtattctacaaaactataaaaactgtgtaatgcgaagtaagctactttcttaatttaataacagatatcagaagccagtggtcaatgtcatagttaccattccaattaaagttaggaataagacaaggatgtctctctcatctttgttattcagccatattttggaggttccagtcagcatggtaaaataaagtaaaaggcataaataaaagaagaaaggaagcagtcattatttataaatgattatttacctgaaaatcaaaattaaaatgtctaagaagtatattagaattaggaaaaaagattagtaatgcattttgttataaaataaacataaaaaatctatatccagtgagcaggagtgatgtcatggggtgagcagggctgagtgtggaaccttgctgagatgctcaggcagagctgagttcagtgtggagaagggcaagacttttgtcagaagtgtgccccgtgcaaccccaagaagggcagtgagcaagcacaaatgtgcactaatcctgaatgggctgttgggtggaggacggatcaggcccccacattccctttgtggttgccaagaagagcaaaggcatttcttagggagaggatacatggtattcagagaatcccagaaagtatttaataggagaaaagcttctttcaaaatacaaaaatcctcctttttagatggagtttcaggcaactacaatgaataattgttggcctctaacttataaaacaaaaatgtctcatggctatttttatatgtaccatatttaaattgatcacttatacataaaatattttttgctgaacatcagcctattataaataatatggacctgtgattaaatgaatatgaccacgctttctatgtttagataataatttcaattattcagtaatgttatctcactgttttctttccaaaaatttgattagccttgaggttagattgttttagtaatatgtagctttttagcaaaagtggttattggtatcctcacctagagaatgttgggttttggtgtttttgtttttgttttgttcatgtatctagttataaactgggactatatttaaatactggaacatctactccgttatttcacaagatagaacaagactaaccaatatttgaattcatgttcattggccaaagtacatcagctttgtcagaaagtgaagaccgaagcgggggtcctgaaattaagaaatcaaattctaattatctataattaacatggtgctttatcattaatgaagggcatttcaatacaccttgtgaatgatatcaaataaaatatatctaatactcaaattttatagaatgctctatcataccagatgatttttatcagagtgataagatagaggaacaagtcaaactgtaatgatggtctcacctttgaattaattagcttgagattaagttgtaatacagaaatacctttaaaagctgttccagtacacagaagtggaagtgtgttatacatgtgtgatcatgatgcttttgcaaacattagattgtgtattatgagaaaactactgttggtacaaatttgttaattatgtggacataaagcttaagttataatagtttaaaaccagtccttaaacccttaaaaaaagtaatgaagaaattgaatcaagacaatagactgagcatattcatccatctctcctgtcttcccaaataccttaaaatgtcaggaaatgcatttttaaaaaattctttattggcactagaaaatgctaatctggccctcagcagaaaggaaatagccatattgactctgaaactggactgagagatgccccagtccaaaacacagcaggagaaactacctctaatgcaagggctgaactggagaatgttaacctttgagtgaagaatagaatgcctggggtggaggtggaggttttagggtaaatcattaacatgagttaggcaactatactttcttcaggattgccaggcttggagctctctcctggttttcatatggagcttcaggagacagttgtatccaagttaaaagctcagagctcaattttaaagaaagagaccacttccctagagaggataagtgtaaggaatggacagaaagtagggcaggacttaaggtaattcaagacttctaccacagatgcaggaaaaaataaagtgatggcagcttttcccaagaagaattaaggatttaaaataaattcttctacccccaaagtgaagttccctacatttcagcagttcggagggtccacaccctgccagcatatcctaaccccttgcacccagttacacaaagcccatagaccctcccattcaggagagagacctgtgggtgaagcatacctagaatatggtagaagtcacccacaacatttgtatataatactaatcagcctatcctttgaacttgaataatatcaatagacaaccagagatccccagccatgaaggagcaacaaagtaagtgaacagaagaattagagagaaaacaggcaattcaggggacagaagacaacttttaagaactataattaattaatataattaattagagtcctcagagagatttgaaagaaataatcagtaaagaagctttcttgaaaagtaatagaagaactgccataattaaatatcaagcgttagttctgaatgatataatggatatgatcaaagaccaaatttagacatgtggaaaataaagacatgcaaaaaaaaaaaaacccctctagaatgtaatgtgtagcaataatatagagatagaaaaggagagaaaatttaagatacaggtagaattaatcttggaaatctaacatctgtttcataggagttccctagggaaaagtaataaggaaaaggagaatagaaaatgaatcaatagaagattgacttctcatcttcttatctgtaatactggatactttcaaaatcccaaggaaaggatgtcttgagtcgtaattatgttcctgggcacactaacactcaggagggggaaggcaaaactaaagttagtttttcacatgcaaggactcaaagctttcttccccacagaccttctctgaagcaattaaaaagtgaatttaagggcccagcacagtagctcatgcctgtaattccagcactttgggaggccaaggtgggcggattacctgaggtcaggagttcgagaccagcctggtcaacatggtgaaaccctgtctctactactaaaaatacaaaaaatagccgggcgtgctggtgcacacctgtaatcccagctactcaggaggctgaggcaggagaatcacttgagcctgggaggcggaggttgcagtgagccaagatcgtgcgcagccccagcctgggcatcaagagcaaaactcagtctcaaaaaaaaaaagtgaattaagaaggaggaaaatgtaggatatatgaaacagcaaatagaagttaaacctgtggtaggtctccattattgctgactttggtatatgtattcatgcaagaatggttggtttttgggagactgacaaatgaaaggaaggacaaaagtgccagtgcgccaaagtcctccccttgctggaggatgcaaatgctaattaattgcacctgttgtaaatgtacacctatataacaaatgcatgtaacgtttaaatatatttagtcagggaagtggtggggatcaaaagggaaataactggaagcagagaaaatagcataatataggatggcagaaataagtctagtagtcacaagcactgtaaatgaattcagtacccctagtaataacaaacactttaagatgagttttgaaagaaaatctagtcatatgaagtttcataaaacagtgacatagaaagattgaaagacagctgattgaaaaatatgtaccaggcaaatatcaacaataagcaagtagcaatattaatgccatactgaatggaattcaaggttttaaatagcgttcagaagcacacaggcatattttataaaagataaaattcactatgaagacgccatcaatttctatgtaatatcaatgtataatgtcatctctcagcttcaaagtatgaagaaaatgcgatattttctcatacctgatgaaaaactttatcacactgcttttagaagctgacgtattaagtagataatatagatagagatgcaaaggggatttggaaaacagccttgatccaaaataaatagatattaacctttgtattcaataaaaagaaaagcactttccttataaatataaatgggatatttataaaaattaacgatgacttgtgccctaaagctgtattttgccagtcatgttttctttttgttgtaaattatattctactctagctgggccccctttgaagacttgtaattttttaattggttgagacatgccccaagttactcctgtcacagaggtggtggatggcccctgggtctctgtgtttgtcttgtcattgaagaatcaggcagcctgccagtccctttcctgctgagggacctagaggaagcatctctgtttcccagtctcctcttgctcccctgtctttaggaatagagaaaattcagaccacttgatcagcattggcttagccttttggaatccagaagagagcaggcagatctaccagacgtccctgccaaccctggcccccaaaatcaacagctctctggtggccaagttcttgccagtatctgctgctttcccagccttgctttagggcagcctggtgcagttctccaggttaacttagcaaatcctcacactggaaatctcctgtccaccaagatgtccaaaattccttttaggccttaccagatacctgcctaggagaaactggagctgacaatggagatgatgggagttatgttcaagttgccatattctagcattcgccacaactcctatcagttttgccaggcaacttactaggtgtctttcatacctgcttccttcacccccagtacctctattttcataacaaagaagagtttatgaaaattaccctagccaaagggaactttttgcccattttattgcttgtatgtctttcacagtcacagtctgacatgcctgcccaccattgcaaggcggcttttattgcatgtctaaagcaggctgtcttgctaaactctttctaaaccaggaagtaaaacaaaatcggtggtgtgaacacagtgggtttctaagcatttttcttgtttccttccattatgttggaggataaattcctggcccaaagttaaaataattcctacaaatgaacaggaatttcagtatgacttatccagtgaagcactggatataaagtgagctttttgcatgcagaattgtgatgtattttataaaacctcttgagattaatgtttgaggagctaggtaaagatggaagagatactccttcagtaatataaatggaagcgtgtagtatgcagatttacaccccccttccaactcactgtaactttaaagctgtctgttagaaggatgaaatgtagttgtgagccagaccatgttggtttggacagaaattcttacagaattattaagccttaaaaaaagcaaaggagatttatgcatctgcatttgaccaatttggtttggaataagttcataatggaaaagtaataaaaccataagagacagtgtcttctgagtacagtctcgcttttaaaaaatctaaacatgcactgccctattttggatacagtgactgtagaaaaatttcccattggtaactttgggagggttttctgttgttgttgttgttcctttttcattgattatcagccagtataaattttaagctttctgtcaaatatttttctggagatgtcagtcttagggaaaagaaatcctaaagtgttatctgtaggagtctccttctcccaatttcaccccctccccgaaacctccacctcccaccccccaacacacatagtgttttttagatatcagtaaagtctttttctggtgtaactggagaggttggggtttggagagtagggggtggttgaatgtgtgagagaaagcacctcctgtgactgccagcagccacagaagaccatgaagaggaaacgcataacaagcttcacctctgaaaaatcggacctaataacttcgcaagtttttgatttcaacaggaaagaaaaagaaaagaaaaccgctttctccacttattctcaaccacttgaagtagtgttattgataaacaatttcttaaaaatatttaaagatttaggaatagaaacaaaggaaatgaaggctgagtgatttgggcaagggaaggtgtgagtctggtggggaggggtgtaggagcagacatcttgcacacaggagaggcatggttgcatttcccatagaggacagcaaaataggcattttattgaatcggatttttaactttctttccacggccagcagttcaaagcacagttatttttatatagtgagaatgtgaccagactgagatggtgttgtgtctctcctgcaggtatgcctgcagcatctttagtgacccctgctgatgttatcaagacgagattacaggtggctgcccgggctggccaaaccacttacagcggagtgatagactgctttagaaagatactgcgtgaagaaggaccaaaagctctgtggaagggagctggtggtatggaaataatgtgttcttaactaactctttggtatcaggtaaatttttaaaatatctaattatatctgtgatttctccatttttttaaagctcgtgtatttcgatcctcaccccagtttggtgtaactttgctgacttacgaattgctacagcgatggttctacattgattttggaggagtgtaagtatcatgctaaatctgctgctaaattttggctgctgctaatgctctgttgtcgtagggaaaggtacctcagtctagtctctataataaaatagaagagatttagggaaatgttgaaattgtgttaacaaggtcatttccaaggggaacatacaactgatgagaatgtatcaactcctttacattaaatatttgaacaggttttgaatgttatttttatcaagttaaaacaaacaaaaaatacagcttcttactctgttttctcttcttttagaaaacccatgggatcagagccagttcctaaatccaggatcaacctgcctgccccgaatcctgatcacgttgggggctacaaactggcagttgctacatttgcagggattgaaaacaaatttggactttacctacctctcttcaagccatcagtatctacctcaaaggctattggtggaggcccataggaagatcagccctgggatagtgctgtctttttgtgggtactgcagtaaagaacatccctcctgggaatgaagcaatgcttcatcccttttacgtccatctcttgtttaaattcaagtccaggcttttttatcatgtgaaatcattcattttctgggtgttttcttaaccagatcattgtgaaattattcataattattatttggccctctgcccagaaacctttgtttgcatctgaaaattgatgggatttggtcaacactaacatgatttggggaaaggagcaagtcagaatagaaattagtactcccctccttgaactaggattgtagtcccaaagaggctactgtaaggcaatcatggtgctcagagcagtgtttcgtgtgtgttttaaactggtaggaaactaggtgcatatttataaaaataaaaaacactgggagaaatgaaaaaatatatatcaaatatattcagcctggcttcaaattgtaagcatgcacaaattctgtctctggattatattatgaagcttttatgtgaaacatgtttctttgtaatgaaaaccacattggagatgtttagtaatcatattgttactggtaccaagactactagggaaatgcctttgtactttagggaagtacttttggcattttactgtacagacagaaaaaactgagatgtagcccctctcctggaagtgctaattttgaaaaactgctcatatgatgtacatgtactgattactgcctattttaataaacactcttgaaaaatgcatgttgccctgttgctgcctgccctattctcctcatctccccatcattggtacccacttgcttttaaaatccactttatcttgaataatgtaagacaaatatgttctgacataagtatttaattcatgttgccttgcataatggtcagaggcgcatgaatttgtgaaggtggaaataaactatttgtaaagtga

SEQ ID NO: 16 - DNA, 78739 bp, Homo sapiens
  source 1..78739: mol_type = genomic DNA
tagaaaatcaggtggagatgatagtggcttgcatgatggtggtagagctggaggtgcagggcaaaggtcagattctgaatatattttgaaagtaaaggcaacaagatttcctgacagattgattatggtgtgtcaaagaaagagaggaatgcaggatgattccagtgtttttgttgacaactataagtctggagctgccaactggatgcagaagttcactggagggcccagcctggggaaaggatcaggagcaggttaggcatgttaagcttgagatgtctgttaaacatccagataggaatgtcaaagatgcacttgtgtttaagagtcaggaatgcaagagggaattttaggctagaaacaaaaagttagaaattattcgatacagatggtatttaaagctgtgtgactgactgacatgacagaagtggcgagaatagactgagaagtccaaggaatgagccttggaccactccagtgttaggtaagtagttgaaaaaaagagagagagagaaggcatcaaaggagactgaggaagagtgatcaggaaagcataggaaaatccgagaaacatatggtgtcctggaatctatatgaaaaagatatattcagaaagacagagtgataaatctgtcaaattattgaatttgtcaggtaaaataagaacagagaattgatctttggacttagcaaagcagagattatcagtgacttttataaaaatagtttcggtagtgtggaaagatcaaacttctgtttagagtgggtttcagagagaacaacaggaattgaagaaagtaataaactttgccaaccagtttagctccaaaggaaaagagggaaatatgatggtagctggcaggggaagtgtggtcaagagaggttttttgtttgtttttcaagatggaagaaataacagtatgtatgtaagctcacaggagggatccagcaggcatggggaaattgatgatataggacagaaagggaagaatggctccttgtgaaagtgaaaggggatgggatctacaggatgaacatgcaaacaaagactggctgcaaagagaggcatgaatagttcatttacagaaacagcaaaggcagagtgttggtacagatgctggtaagtggaaaaatatcatggtaggaggttatggagttccattctaaacacttcaacttcatcagtgaaataagcacggtaatttagcagaatgtgaagatgtaaaagaacagaatttgagaaaacagacgatatgaaataattattagaaaagcaggtgagtgaatgaactaagaaaacatcttatgactattggtcagtaaacgttgggatacatagtgaattttacaaaatctttgccctcataagtcttgcatcccacagagtgggcaataaataataaacataataagtacattatgtatacagtatagggccatgtaagttcatggcgaggcaagcccgatgactttgtatttttcttcagacatgttctgctgcatggtgtaggttcacagtagctcagtaacttgaattatccaggattgtggttttactaagcaagcctgataaagagagagggctagagggttgtgggtgttttcaggctgagttaagagagaagacatgaaggaggtgaggaacagtaaaaaggtggtaagatcagtggactgaaggatgcattaaagaatgactgtgtttaactctctgatacatctgacgtatgttctccatctccacttccctgctagtcatagcggataaggatactccctggattcgaattctagttccatcagttataagatattgattctgttttactttgtctgtctcattccaaaacacatgtctctaattaccatagtttgataatgagttttgatatttatttagtaaggcaaacccataaataactgataatttttcaagataaaagtgaaataaattttcaggaaaaaaaagctgagaaaatttgtcacaaactaaagaaaacaagaaagagacagtagatgaaagagtgctcattaggtgaaaggaaaatgatccaagagggtagctttgagatgtaggaagaaacaaaaagcaagaaaatgataaatgttttgataaagctaaataagtatcaactcataaagaaataatattcccagaagagtcatgaatatacagagaaaattaaagtacatgacaatggcaatgtaaaagttaggggtgaataaaaaagagacttaagagttctaaaatcattgcattgtcctggaagaggaaaaagtacaatgattagtcaaagatacatgtcataatccctagaaaggagatcattattaaatagaaaataaaagaatacatcttatagaaaggaaatctaaatgataatattaaacagatctaaaataaggcaaaagtgaggataaaaaagaaagatggaaccaatggggcaaatagaaaaagtaagatagcgtggtagggcattaattccagccttacatcaatgcataagtatctcaatattctactgtaaagggaaagtaaagatttcttacagcctgagtgtaatggagaaatctagtttatcatagtgctttaaatattgtaagtcttcaacttctagttgatgaataaatgatggaattctcagtgatactgcactgttatcaaataaatataaaaggagctcctggaattggatgtaatacaggtaaagaagtaaacacagccatataggcatggcttcttgcagggacaactttgtgaatcggctcagacagacagacaggcaaatacacctcattgcctcatacatgttatttgctttagtttttgttctgaaccttcctactccttcaagtatctgcatttactttatcaaattctcttttattagagactgaagaaactgtcatctccttatgtgctaatgagtttaataatgtcctccagtcaccacaagccttctttcaaactacacaattccaactgcttccgtctcagagtatcttgaaataatgatctgaccgcctgttagaccagtgaagggaaggaatttgggttgatttaagaagagaatcctcatggtcatggtagactgatatggagagaaaacattttgaggaaaaatactcaactaaattcatttctactccagcatgcagtttcaagtcaagttccaccttagctccaggtggcaggcagagcaggatgcagaggcacagcacaagtaaggggtgagtgccgaagctgctggctcctgttccagtctttcttccttggcctcgcctgaacttttactataataatagtcaccatttattaggtgtctcctacgtgcaggacactttacacacagtatccctaatcctaataacacccttattttatagatccaatgactgagtcaagaattacataacctggccagacagctggtacatgggaaaggtgagattcacaccagggtccacccagcatctctacttataccatgctctgctttaaggttctctgagaactcagacaagccttgggctaacaattgtgttaacaggacatagcaggtgcaaggacccactggtcatcctgctacctgatcagaaggaaggaaagttgtatttgttgctcacctactatgttttaggcatagtactaggtgcttttacctagtacttaattcccttatcctcaactcatttattcctcgcaataacctgataagggagatgtttttatcctcattttacatataaggaaacaggcctagagaaatgagcacagtgtccaaagtcacatagttaataagatgtgaagctctgagtttgaaagtctccggtttcaaagccatgaaacttatggctccccgttttagacacttccttttgggaagagtgtggaggaattaatcagaaagaagaaagtcatactcaaataggtggtaggagcagagacaattcaatacagacagaagtcttagatgagagcagtgagccagggcactggactgggactcaggaggcttcccctagactctggttccaccgatgcagcctcaggcaggacttcacctctctgggcatccgtttcttcatatgttaaacatacggggttttaattagatgatcgctgaagacccctctagccctaaaactctgtgtctcttaagtgctaagagggcaccaacagcgttcctcctccccaaggagcataatgtgatggttcctgccggccctggctgactctcgccgtccttggagataattgggttcagtgccacctggaccagaactggggatgcggaagcaagaggcgagtctattgctctctctcggtcctgggccgccctgtgattgttgggcgtccggaaactgtctcccctatgggtttaaaaacaaaactgagcgcccatggggtgtgacagtcatctgcaggggcttgggtggcccatcaggcgaggctttctcggcacccgaggctccagcctgatctcggtcttatcctgcgaccgggctggttctggcgggtcgccagggtgggcggcggccccagccgggcgccccggcggcaagagcggcaggctgcgcccctggcccgcgcctagcctggggagagagctgggcgggcggcgggagctgctctcgcgggccgcggccctcgccctggctgcaacggtaggcgtttcccgggccggacgcgcgtggggggcgggggcgggggcgggggcgaggccgcggcgagcaaagtccaggcccctctgctgcagcgcccgcgcgtccagaggccctgccagacacgcgcgaggttcgaggtgagagaggtccgggcgcgtctggcctcgaagggagacccgggacgtggggcgcggggcgggagtggccggacctccacccagtgcccccgggccccgcgactcgtgcgccgggccgccggagagggtgtacttggttctgaggctgtggtttctcctcaggctgagatggatcttgaggcggcaaagaacggaacagcctggcgccccacgagcgcggagggcgactttgaactgggcatcagcaggtacatccccagcagccactggcttttccgttacacgccaatcagcaggactaagttcacccttggaaagaagttgtaaaaatcggttgatgcctttgaagacctttgttttggaggcttctttgaagggtcttgcatccggttctgaccttggagcaaacgtgttgtgtggcctcaaagaatgtcactgaggctccttttggaacagattcaggaagaaaaggctgtcttgaaaagtgctcccttccctttgtgcaggggggattcaatgaatatctgcattgtataacattcattgtattacgtaactcttgaaacttttacaaatgactttcatatacatcatctgattgttcagacttaaagggtgtcagacatctgctgttgatggctgtgctttttgaacaagggcagtgaagcaaaaactccctcccctcctgcccatcccctgttatgtctcttcctccttgtcttacccctccccctcctctcatcgccaggcttatttgtatttctcctttctgggaggataggtggggagggggaacttctgtacatccgaatcagttttgttcaagtggtagggggaagcagcgcttcctttgccttcatgtctttctcggttcccctggcccttgttaaactcacttcacaggctttatgagcggggcagaagttcccagtcaatggcgtgtgtctttgtttcctctttcactgtgggaatagtgaatcattttcgcctttagcctgaaatagtttatgaggctattacggtctctgagttcataccaggctacccagaaaaaattgacctgtgtcaagtgatcacccagagggacaaatttatcagtctctgtagtttgtcctcaagctgctaggggcttgattagctaactgaaaacatgcctacctgatgcttaaactgaagcattattttagcctgttaatgtggttgtgcagtaaccttgctgtatttcttctaagcaccattgtattttttcatagaaaatttagttttgccatgtagaattgaaaaagtgatagatggtgttacttccaatggaagtacttacacacgcaatagaaaaatatggttttcatcagctggctgtttaggcagggattgactgtgagtctattaatagatggcattttcatgaagaagtctatttatgtattgcactggcttaacatttgatgcgtgtgcaaaggagctattcctacaaaaggtgtagtaacacttcagaacccaggaaagtcctcagaggggaagcccacagcttctgctggaaagaagaaagcagctcaaaagagaaatacagaaagttaacaataagttaagaccacatgattatgaaatcaaatgtagtgaaactaatttttataaaagcagaccaaagataatatatttaaaggaagttaagcctgcttcaatcaaattagttatattcttgttctaattatgttgctattgcccatggcacattcttttgaacatatttagtggcagatgtttgtccagtgattttagtcaatactttacataatttggaatcatcttatgagtaaaactttatcatttacctggataaatgcatcatatttatgtaaaaatcatcatatatatataaatcatcatacacacacacacacacacactccctcatagagtttatattatagtacggaggacagacataaataatgtacatactaaataagtaaaccacagccaatgttagaaggtaattaacgccatggaaaaaagcattaatccaggttaaggggatcaggagtacaaaaggggagtactttgtaattttaagtagggtggttagggtagatcttattttaaaggtaatatttgagcaaagacttgaaagaaatgagaggagacagctgtgtgggtatctaaggggagagcattcccggaaaaggtaactggcaatgcaaagaccctgagtcaggtacatgtttggtgagttcatggaacagcagagagtccaggctggttggagcagagtaagcaggtttgggagtagggatgtggtcagagaggaaataagcaaacagatcgtgtaggacctcagaggttaatgcaaggattttggcttttattgtaagaaaaaggaaagccattgtaggtttttgagcaaagaagtagtgtatggcttggcattttgaaataattactctgactgctagttgaagatagactgaagcggcataggtggaagtggagagactaggcaggaggctgccctactggtgacagcaatgaaactggtgataagtggttaaattctagatgtactttgaatgtatcaccaacaagattgcctgacaccactctccacaatccttcagaagaatagacattcctaattttaaatcatgattttttttaattttagaaaacaaataacttaattgacttagcgacactgttagcatacttatctttcctgtgtatgtgagctctgtaaggcaggcgaccatttcttatgtatccatgtatctttgtagtaccttcgacagttacttttgtgcttgctatgtttgttgaactgaataattttgacattttgtgaacatcactcttatatttgaaaatataatagttgaatattgtaactaaacatatttatgttcaattgattgtaaaacattttgtaacagttttaaattgaagcaattctattttttacagcaaacaaaaaaggaaaaaaacgaagacagtgaaaatgattggagtattaacattggtaagctgtgaaatgttaaatgtgaataatcctaccttttattcaaatttgaggtattgaatcaattacctttaaagcaaatactttaagattgtctagctaggcgagctgactcatacttgtaatcccagcactttgggagactgaggtgggagggttgcttgagcacaagagtttgagaccagcctggacaacatagtgagatctcatctctacaaaataataaaaataaaaatcttaaaaaatagcatatgtcatggcatgaacctgtagtcccagctacttgggaggctgaggcaggagggtcttaggagtctgaggctgcagtgagttatgatcacaccactgcactccagcctgggtggcagagcaagaccctgtctcaaaaacaacgacaacaaaaaactgtctgcagacagcaataaattgtccttgctgcacctgtgctgtataagtttggcttattatagtcaatgacccacattcttaagatggatgattttttaaaaagtagagacaggctggcgatgacaccggacagagctaactggtgtgcaaggaaagtgaaaatgggaattgtgttagtagcacaatgcaaactcaacaatttcaagaaaatgcatttctgcatttgcttcacagacccccaccccaaatttagcttaaaataagcttgcatttcaagaaagtaattgttaagtacataaattttaatttaaggaatctacattcacatttggtttccaaaaaattggctaaatagggggtaactattaggaattctgattatgcttaaaacagttttcggtgcttttctgttggtacaagacaagacaatatttttggaagaagtctcctcatctggttttcatttgaaatatgtcttacagaggcagctcaagaaagcatttgcccatttttggtaaatatgacgtgtttcaaactgtgacagccattatttggtagcaaagaagttagaattaagtgtcatgtcagctgaaatccaacttagtaattaaatggataaaaagacaccaaaacatccacactctcaaacactgctgcatacttctcatgtaaccaaaagcccctattcattgtcttctctcctctttttttatttgtttaaaaagcctcagtaagggcaatttaaaaaaaaattagcactttggagaataaattgtttatcaaatgaaagctggttttatttatttttttagaagtttttttttctttatttttttaaatttgtttaaattatactttaagttctagggtacatgtgcataacgtgcaggtttgttacatatgtatacatgtgccatgttggtgtgctgcacccattaacttgtcatttacattaggtatatctcctaatgctatccctcccccatccccccaccccacaataggccccggtgtgtgatgttccccttcctgtgtccaagtgttctcattgttcagttcccacctgtgagtgagaacatgaggtgtttggttttttgtccttgcgatagtttgctgaggatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgctgcaataaacatacttgtgcatgtgtctgtatagcagcatgatttatattcctttgggtatatacctagtaatgggatggctgggtcaaatgatatttctagttctagatccttgaggaatcaccacactgtcttccacaatggttgaactagtttacagtcccaccaatagtgtaaaagtgttcctatttctccacatcctctccagcacctgttgtttcctgactttttaatgattgccattctaactggtgtgagatggtatctcattgtggttttgatttgcatttctctgatggccagtgatcatgagcattttttcatgtgtctattggctgcataaatgtcttcttttgaggagtgtctgttcatatccttcacccacttgttggtggggttgtttttttcttgtaaatttgtttgagttctttgtagattctggatactagccctttgtcagatgagtagattgcaaaaattttctcccattctgtaggttgccagttcactctaatgatagtttcttttgctgtgcagaagctctttagtttaattagatcccatttttgtcaattttggcttttgttgcctttgcttttggtgttttagacatgaactccttgaccatgcctatgtcctgaatggtattgcctaggttttcttctagggtttttatggttttaggtctaacatgtaagtctttaatccatcttgaattaatgtttgtataaggtgtaaggaagggatccagtttcagctttctacatatggctagccagttttcccagcaccatttgttaaatagggaatccttttcccatttcttgtttttgtcaggtttgtcaaagatcagatagttgtagatgtatggtattatttctgagggctctgttctgttccattggtctatatctctgttttggtaccagtaccatgctgttttggttactgtagccttgtagtatagtttgaagtcaggtagcatgatgcctccagctttgttcttttagcttaggattgacttgccaatgcaggctcttttttggttccatattaactttaaagtagttttttccaattctatgaagaaagtcattggtagcttgatggggatggcattgaatctataaattaccttgggcagtatggccattttcacgatattgattcttcctatccatgagcatggaatgttcttccatttgtttgtgtcctcttttatttcgttgagcagtggtttgtagttctccttgaagaggtccttcacatcccttgtaagttggattcctaggtattttattctctttgaagcaattgtgaatgggagttcactcatgatttggctctctgtctgttattgatgtataagaatgcttgtgatttttgcacattgattttgtatcctgagactttgctgaagttgcttatcagcttaaggaggctttgggctgagacaatggggttttctagatatacagtcatgtcatctgcaaacagggacagttttacttcctcttttcctaattgaataccctttctttctttcttctgcctgattgccctggccagaacttccaacactatgttgaataggagtggtgagagagggcatcctgtcttgtgccaattttcaaagggaatgcttccagtttttcccattcagtatgatattggctatgggtttgtcataaatagctcttattatgtttagatacctcccatcaatacctaatttattgagagtttttagcatgaatggctgttgaattttgtcaaaggccttttctgcatctattgagataataatgtggtttttttctttggttctgtttatatgctgtattacgtttattgatttgtgtatgttgaaccagccttgcatcccaggggtgaagcccacttgatcatggtggataagctttttgatgtgctgctggattcggtttgccagtattttattttattttattttattttattttattttatttatttattttttgagacggagttgcgctgtttcgcccaggccggactgtagtggcgctatctgggctcactgcaagctgcgcctcccgggttcacgccattctcctgcctcagcctctcgagtagctgagactacaggtccccaccaccacgcctggctagtttttgtatttttagtagagacagggtttcaccatgttagccaggatggtcttgatctcttgaccttgtgatccgcccgcctcagcctcccaaagtgctgcgattataggcgtgagccaccgcgcccacggtttgccagtattttattgaggatttttgcattgatgttcgtcagggatattggtctaaaattctctttttttgttgtgactctgccaggctttggtatcaggatgatgctggcctcataaaatgagttagggaggattccctctttttctattgattggaatagtttcagaaggaatggtaccagttcctccttgtacctctggtagaattcggctgtgattctgtctggtcctggactttttttggttggtaagctattaatttcagagcccgttattggtctattcagagattcaacttcttcctggtttagtcttgggagggtgtatgtgttgaggaatttatccatttcttctagattttctagtttatttatgtaggggtgtttacagtattctctgatggtagtttgtatttctgtgatatcagtggtgatatcccctttatcattttttattgcgtctatttgattcttctctcttttcttctttattggtcttgctagcagtcaatcaattttgttgatcttttcaaaaaaccagctcctggattcattgactttttgaagggttttttatgtctctatctccttcagttctgctctgatcttagttatttcttgccttctgctagcttttgaatgtgtttgctcatgcttctctagttcttttaattgtgatgttagggtgtcaattttacacctttcctgctttctcttgtgggcatttagtgctattaatttccctctacccactgctttaaatgtgtcccagagattctggtatgttgtgtctttgttctcattggtttcaaagaacatctttatttctgccttcatttcgttatgtgcccagtagtcgttcaggagcaggttgttcagtttccatgtagttgagcggttttgagtgagtttcttaatcctgagttctagtttgattgcactgtggtctgagacacagtttgttataatttctgttcttttacatttgctgaggagtgctttacttccaactacgtggtcaattttggagtaagtgcagtgtggtgctgagaagaatgtatattctgttgatttggggtggagagttctgtagatgtctattaggtccacttggtgcagagctgagttcaattcctggatatccttgttaacttctgtctcgttgatctgtctaatgctgatagtggggtcttaaagtctcccattattattgtgtgggagtctctttgtaggtatctaaggacttgctttatgaatcttggtgctcctgtattgggtgaatatatatatttaggatagttagttcttcttgttgaattgatccgtttaccattatgtaatggccttctttgtctcttttgatctttgttggtttaaattctgttttatcagagactaggattgcaatccctgcctttttttgttttccatttgcttggtagatcttcctccatccctttcttttgagcctatgtgtgtctctgcacgtgagatgggtttcctgaatacagcacactgatgggtcttgactctttatccagtttgccagtctgtgtcttttaattggagcatttagcccatttaaatttaaggttaatatagttatgtgtggatttgatcctgtcattatgattttagctggttattttgctcattagttgatgcagtttcttcctagccttgatggtctttacaatttggtatgtttttgcagtgactggtactggctgttcctttccacgtttagtgcttccttcaggacctcttttagggcaggcctggtggtaacaaaatctctcagcatttgcttgtctgtaaagtattttatttctccttcgcttatgaagcttagtttggctggatgtgaaattctgggttgaaaattcttttctttaagaatgttgaatattggccccctctctcttctggcttgtagagtttctgccgagagatcagctgttagtctgatgggcttccctttgtgggtaacctgacctttctctctgcatgctcttaacattttttccttcatttcaactttggcgaatctgacaattatgtttcttggagttgctgttctcgaggagtatctttgtggtgttctctgtatttcctgaatttgaatgttggcctgccttgctagattggggaagttctcctggataatatcctgcagagtgttttccaacttggttccattaatcctgtcactttcaggtacaccaatcacacatagatttggtcttttcacatagtcccatatttcttggaggctttgcttgtttctttttattcttttttctctaaactcctcttcttgtttcatttcattcatttgatcttcaatcactgataccctttcttccacttgatcgaattggctactgaagcttgtgctttcgtcacatagttcttgtgccatggttttcagctccatcaggtcctttaaggacttctctgcatcggttattctagttagccattcatctattcttttttctaggtttttaacttctttgccatgggttcgaacttccgtctttagctcagagaagtttgatcatctgtagccttcttctctcaactcatcaaagtcattctccgtcctgctttgttccattgctggtgaggagctgcattcctttggaggaggagaggcgctctgatttttagaattttcagtttttctgttctgttttttccccatctttgtggttttatctacctttggtttttgatgatggtgacgtacagatgggttttggcgtggatgtcctttctgtttgttagttttccttctaacagtcaggaccctcagccgcaggtctgttggagtttgctggaggtccactccagaccctgttttcctgggtatcagcagcggaggctgcagaacagcgaatattgatgaacagcgaatgttgctgcctgattgttcctctggaagtttcgtctcagagggctgcccggccatgtgaggtgtcagtctgcccctactgggtggtgcctcccagttaggctactcgggggtcagggacccacttgagaaggcagtctgtccattctcagatctcaaatgctgtgctgggagaaccactactctcttgaaacctgtcagacagggacatttaagtctgcagaggtttctgctgccttttgttcagctatgccctacccctagaggcagagtctacagaggcaggcaggtctctttgagctgtggtgggctccacccagttcctggccgctttgtttacctactcaagagcttcctggccgctttgtttacctactcaagtctcagctatggagggcacccttcccccagcctcgctgccaccttgcagattgatttcagactgctgtgctagcaatgagcgaggcttcgtgggtgtgggaccctctgagccaggcgtgggatgtaatctcctgatgtgccgtttgctaagaccattggaaaagcgcagtattagggtgagagtgacccgattttccaggtgccgtctgtcacagctttgcttggctaggaaagggaattccctgacctcttgtgcttctcgggtgaggggatgcttccccctgctttggctcatgctcggtgcgctgcacctactgtcctgcacccactgtccgacaagccgcagtgagatgaacctggggcctcagtaggaaatgcagaaatcacctgttatctgtgtcacttgcactgggagctgttgactggagctgttcctaatcagctatcttggaaccgcctctgaaagctggttttaatgcataggttttaaatctgcctcctacagaaaatacaatcctacaaaccttaatgtaggaacagaaattttcatttgaatttagaagttttagcttaagttaaacttaaatttaatatttattttcacctcttactagatatcttaatagatattttttgtcctgaaagaggttgaggataaaactgtgctctaacaggagttagaaatatattattttctggaaaatcactgaaaacaaacctaggtttacttaggatgttgctgtgaaattcacctcgttttaaatttatgcttagaggctgtaaaattgtattcaattaatatgaaaacatttaaaatgctttttaatgttaacaacctgaccctgtgcttttaactatagctgacagactcaagtgttctgttttccttttcccagaaccactaaaaatgaacctttgggacactggtccctttgtgacaattttagggacccagctccattggctcttgactttacctgctcccattgttttatccaagctctgcctggtttctgaccctttgtctctttcggttctcttgcttgccctgtgtgtttgatgatggagtttgtccctgtccctgaaaccttgcctgaactcctggaaatctttgagaatggtgtacacacatatccactttccaccatgtgcctctaacctcagcctcacccgggttattgacccagtctgacctagcttcagccctcaaaggctccactgtgccaagcctggctcatcaccctctctcccaataactgttctttgtccccaaaaggggctgaggtggggggaatgggcagagtaaagcattttaaaagagaggagagaaaaaaaagataggaagctatagaaatggaaatgtaagatgaggaaaatgtagtctagaaggcagaggaggaaagaagaacaaagagaaagagagccataaatgggtcaatcaaaaacagaaagaaaaggtgagaaatggaagaggactaataagacagtaacaaagtcctttgaagtgttagaacactgaactgctggttagttcttgagggttgtgcacttcactgtgacaactggtatcacccttcccctctgtaggtagtactgtgtccaagattcttggtgtggcccaccagcgcaggccttctatctctctccaacatcctctcccacactttgtactgtgcccttcaggaattccactgccaggggttacttaagcattccatgtagtttctagttaccttcttattctaagcctaaattcttcctacttcttttacactcgccgattcttctccagcgaactccctcttacccttcaaggttctgcatacttggcaggtgacactggtgaaaactaaatttttaaaaaaggttctgcataaggatctccataggcaagacttccctaaggtgcatatatagacacactgtaatgtttattgtgcttcactactgagttgcctttttaaagctaacttaaaccttctaaagggatcttatctcaaaactcagagcatctattttcctctattttaaattctccctctgaaatattctgaatgcttttttaaaggatgtggtgtgtgtgtgtgtgtgtgtgtgtgtgtgtttaaacttaatgtctttccctagccgttctttattaccacaggagctctgggatatcaaataatatttcttaaacctttatcccttttgattgtatagtaattatttattcaaatcagataccaattaaacataattagattgatttcttcacagaatacaaaataaacagaatcatgaaattaagttgttaatgatttgaaggcctccttttctaagacattcatttacaactcttaaaaaagtactgactttaaataaaaatccaaagaatatataattatggaagaggagaaattccattccacagctaagtattattttatttcctttttttagtttcgatactccgattggcaggataaattgtttatgtcgctgggtaccatcatggccatagctcacggatcaggtctccccctcatgatgatagtatttggagagatgactgacaaatttgttgatactgcaggaaacttctcctttccaggtaagcatttctttaccttttaaaaaaatccatagcatttctttaactgggtaaaaatttgggagttgattttgctattcattaccatcttatttaatgatttggatatctggttgactccagatatcatagaaggagttgtaaaattctcagaaaattgttcaaatactcgtttaaatttaaagaaatatgtgtattgttgtttgacttttaatacaggtgaaggaaatacacaggaagcttctaaataaagtaaggaagtcactctacttgagaacagtggaaatgtaatgagagtatctctatgcagtatccatcccattagtaattgctgatgagtttcaaagcacatcagttaaacatggcagtacttcttagctgtgtttagcttgtagatctgtttctgggttttcttttcttctctccccttcaccttaaaaaaaattatacccattttctgtctctaattttggatcaaccagattgactggaacttgagatggcatttcactaaagagtgaatggattcaatacgtcccttggaactcacccaaaggactatgattactgaagagccaagtgtcccataagttaatgttatcaatacgagaggccctgacaatagcattacagtggggctccaatagacatggttattttcatagtaacgaaattcaacatagaaaggaaaattttcatgctttctaccaagcctgaagcctcttttctctaagagaccttgtgggcactgggctggagaagactgagtgaagctttactgttgcacagatggtagaatattttcaaaacactggtaaaggaaaggcagctttcttagcaaagatatgtaagaaaaattactctatcatttagacagcattgaataagaatttacagtgttcactgactgagaactacatatttagttactattgtaggccttacgtgtaatttcctaagagaataggattgtttaattaatacagcagaatatgtttacataaatattgataaatattaatgccttttaaaaatccagtaaaagcatcctttgaatatttaaagcaaactcctataaaagtttatttatttattctcaagtaatatagtttctgaaaaaaacctctttataataaaaataacaataatggtgatttttcattgtgcttactatgtgctaggtcctatgctgagcactttacatacattattccactttaccctcacaagaacaatactacacagtaggtaatgttatcttctgtgatagatggcaaaaccaaggcttggagagggcaaataacttttccatagttacactgctggtctttctgccatccaaaccatgcttattatcatatatagtatagtgtcaatatagatgattcggaaaaaaaagtgcttgggaaagttttaaatggattgcttatttgtgactagtgaccaaaactttaacataaacattgtgaagttgtggtaggacagatagtttaaaaagtctttaaagaggctgggtgttggtggttcacacctgtaatcccagcactttgggaggccaaggtggtggcaattaagttttgagtttgggagttcgagaccagcctgaccattgtggagaaaccccatctctactaaaaatacaaaattagccaggcatggtggctcatgcctgtaatcccagctactctggaggctgaggcagaggaatcgcttgaacccagggggcggaggttgccattgcactacagcctgggcaacaagagcaaaactccgtctcaagaaaaaaaaagtctttaaagaaatgggagaggtaggaattttctattgtgtatttgttttcctagaaaatctacagatctacaacatattaattttgtatacatatagagcaggatgatgcccatattaagacacctcagttaaaaatctatttcttatggaatactacacacctataaaaaatacgaaatcaccagctacttgggaagctgaggctggagagttgcttgaacccaggaggtggaggttgtagtgagccgagatggtgccactgcactccagcctgggcgacagtgcaagaccttgtctcaaaataaataaataaataaataaataaataaataaataaataaatacaaaattgtgtcctttccagcaacatggatacagctggaggcaattatcctaagcaaattaacacaagaatagaaaaccaaatactgcatattctcacttataagtgggagctaagcattgggtaacacattgacataaagatgagaacaatagacactgagatctactagagaggggagggagggcagcaagtgttgaaaaaccaaatactaggtattatgctcactacctgggtgacaggatcattcatatcccaaacctcagcatcacacagtatccccatgtaacagaactgcacatataccccctgaatctaaaataaaaattgaaattattttaaaaagaaaagaaaaaagaaatgcagactcccaggccacatctggacccactgaattagcaatggtattttagcaagacatttccttccccacagtgaatcagagatgcatttatgcacattaatactcaagggtctattaaatggtctgaccttccagatgcggagctgggtttctcacccatccctttagtagcaggacaatgactgtataggaacttacaccagctgcctttgatttccatcttatttcatctggaaaaaaaaaatcaaagaaactacaaagacgtttctccaactcctgaattgtcagcaccatatctccactgcccctactttgaaattatctttgggtttcacatttcctgatcttcaaaccataaagcaccatttattagagcaccaatggaatatttttgtggaataagacccaactttatctgttcatgtatggtctagcacctcttttcaagtgtcgcagatattatctcttggtgactcacattagccttccagcgaagcacttatatgtccataaaatatctgtgaaataatgtagagaaactgatgattacttctagggagagaaagtgagtggctttgaaaatgggtgggtgtgatgtctccctgtattctcgcttgtaactgttgacgtatacacctttaccaagaaaaaataaatttaaagtaaaaaaaaaattttaaatggcttctacacagggttaaaaaaatcagattaacagatgaatggaaaaataagatatggtagatacatacaatggaatattattcagccttttgaagggaaataacttctgacatatgctatgtcatagatgaaccttgaggacatgacgctaaatgaaatgagccactcaaaaaaagataaatactgttcgattctacttttatgaggtatctagagtaaaattcataagaacgcaagtggaatggtggttaataggggttgtggggaggagcagtggggagctgttgtttaatgggtatagaatttcaattttgcaagttgaaaaagttctggaggttggctggacaacagtgtgaatatacttaacagtactgaactgtacacttaaaaatagttaacatggtaaactttatgtaaggtattttatcacaattaaaatttttaaagtcagattaaagcaatgcaattcacttatcacacatcatttctcttttggaccaattttattagttctgtttttgtttttactaataccagaataattcccaactttcttatttggagcagtttgcttttttttttttttttaacttgtgcctaattatgaaactgaatggctttaagctggacatggcagagaggtgccaaattcaaggtctctctggggaatggcacaagcaagtcacttacagaactgtggttgacacagagataaactcgcgagagttgccaactttgttttggtagcctccgaattataaacactcctgttatgatgcttggtaccctgtagccatgtttctcattaggcttactggatgctatggagtatttagatggaaagttcctcaaatgttatgaatttccagcatccactctttggtcgtttgtaaaaataatattctcatacctcttagaagacaatgaaatctttaaaggatactcactctaaatccagactgcttattgatgtgttgagagttgtagagtttaacaaaaatcatgggggttgggaacagatagagtgaggtacttagctgaggttccagcttatctcttagagatgtttacttagtctattctttagaattgttggatgcttggacaaccagacttaataggagccaaatgagaaaggcatgttagaagaaaaaaaggttcatattacaagagggtctgacaatgacttattgtgagcaaagctcgtccttgtcaacagaataaagccactccatgacagggttgttccctcacaatgagtcagttgtgcagaaagtatgcacacaacattctgcatccaaaacattaaggacggagttggagaaaacagtttttctgcagagtgtcaaggacttgatatcttttatgctgtctctgtgactataatagtctagaaaattctgcgggaaaatagctgcaccctgattgtccttgcattgcctcttgtttgaggggaaaaatgccattttgagcccccaagatatcttcataactgtccatagtgcctagggtgcctgaacaaacaccagctctttattttataatgaatagttctatgtgttaaaagaagtcctaggcaacatttaaaaataactaaaagtacataattggattgtttgtaacacaaagaaaggagagatgcttgaggtgatggatacctctctttcttcccctttgaaaaaaaaagaagtcttgggcagaatccgggaaggcagacattgatttactttgagactcaaaagtgaaaatgaagactatgtttccctatctaatccttaatgtatacactgcttattcagacccttcacccataagctgtgtgaccatgagcaagtctcttaacctctataatccttactgttctcatctttgagaggtaagcatcaatttactgatagaattaagtgagatgatttgtgtaaagtgtctggaacatagtaaatgatcaataaatattgggacaaactagctataagaacttggaaatgaaacaacccactctgtctcttcatctgtaaaatggataggttatataggtactctctaaaatgaacaggcagcttcaggagttccccagttccttactacgggaggcattcaggtggactggggtgtaagttctccatcctggcatattagaatcaaccagggtactttttcttttttgagacagggtcttgctctgttgcccaggctagagtgcagtgaagtgatcatagctcactccagccttgagctcctgggctcaagtaatcctcctgcttcagtctcctgtgtagctgggactacaggcacctgccaccatgcccggccaactttttgtaaaggtggatttcaccacgttgcccaggctggtctcaaactcctggcctcaagtgatcctcccgcctcagcctcccaaagtgctgtaattataggtgtgagccaccgggcctggcggggggcactttataaaaatgtgatgctctggactcaaccagagattctggctgcattgggcttgagtggagcctgaacatctgtaattcttaagctccccatgtaattctaatgcacagacagcgttaagtaccaccaagccaaatgaccatgtagatatcgtttatgagactgaagcagaataggtagcatctgacaagaccaggagtaggctcttttcagatctagcaggccatgacttttcaggcaacacaccaacatatgtttagttcacctttgtcccaggcagcagaaactctgagtttccccggggactctggagctcctcaggttactaacccagcactagatttccattcttgagactctgagaaaggagcgggtccaatctggaacgctcatagattctttcctaggagggagagtcaatttgagttggtatctgtgttagtccattttgtgttgctaggaaggaatacctgagactgggtaatttatgaagaaaatatgtttatttggctcatggttcagcaggctgtaaaagtatggtacccacatctgtttggggcttctggcaaagcctcaggaagcttttactcagtgagggaaggtgaatggggagcagatgtgtcacatggagagagagggagcaggagggagaggccaggctctctttaacaaccagctgtcacatgaactgagtgagaactcgctcattatctcagggagggcaccaagccattcatgtgggatctgtccccttgacccaaacacctcccatcaggccccacctccaacactgaggatcacatttcaacgtgagatttggagggaacaaatatccaaaccatatcagtatccttattgagagaatttaaaagtttgaggtaggtgttgaaagagaggaaaaacttatttaagatttcacccaatttttcagttcagggaaataaaaaaaccacaatgatttttacaaatgccacagctttagaatagcttgcctgcctctagttccaaatactcttccaatttgccctatttaaaacttcaggatggaaatgaacacacagaaaggaactgataagatgaaaagtaaaatagggtatgaatcttcaaggttctgatagcttataaagagctagattaataatcggaaatttcactgtgaacatcagtagaaattataatcctgggggaaagatgatgctgcagttggggccagatgcctggtaattgatcctgacagtagtttgagttttaaataagtttcaaccttatctttctttggaaaaagataaggaggatacacagcaccacgaaaacacgaaaacacgacccctgggctatttacacatggcaaaggaacaaagagaccaatttctctcctaggaccatggaaaatgagaaatatgtaccctgatgtgttttctcaacaatgctgtggtgatattttatcctattattttgtgaatgcagtagatgtaggctgtttcttattttttcatttgtcttttctaaaaaataaaaataagtcattgtcacatgaataaatcagtatagtatagtgttacgagcataggccaaattgcctgggctgactttcagctctgccacttactagctgtatgacattgagtaagttactttatttatctgtgcctccatttcctattctataaaatggggtttgtgaaatagtctcacctcataagataattaaatgaattaacacacctaaagtattcagagcagtgcctggtatttaataaatgctcaataaacattagctattattaaaacatggaaatcaggaaagatacattgacattttatcaaattagctcaaattaatagacaatagatttctttccaattaatactgcttcaaaaaatactagaatacagcagtgctggtaaacaagaggtggaatgcaggatgttcactaattgccagtgatcactgacatgcctttgagcaactaagttatcttccctgtctagtttttcctcctttgcgatggatgtaacttagcctttcccttacttatgtcatatgagacatgtaaagaaaaaacacacagatataaaaataaaatttattgaagttctataaagtgctttgagccaccaaaaaaaaaaaatgcctcttaaatcctgtgttttctattttaaatatttcttattccctcctctgtcttctgtgtgttttgtggcttccttgtctcttcagtggctcctctgtgcctccttagaaggctgctttgctaaaggctgagaccgccaggatgggggaaagacctgggagggcttatcttcccctttcttggcccttaatgtccagtacctaaacccttgggctctttacttgagtaaagtgaaaagaatgcacttaagtgtgcaaagaaaagtgttttttaaagagaaacttaacaatagcatcttctagctttcatacatttaaattattaacagatttttaaaaacctggcaatgcctattaatagtttgatcttttaacatgttttattttattttttaatttagtgaacttttccttgtcgctgctaaatccaggcaaaattctggaagaagaaatgactaggtaactcatatatatggtctacttttttaaagtttcatttgaagataatttccaattacagagttataagaatatacaaataacgtgtactctttacccagattcacctattattatcatttttgctcccaaatcccaatttaaagtaagatgcacacatcatggccctttactgcagtatgactcctaagaataaggatattttcttacataatcacagtacagctattagcttcagtaaatttcagtacttttatctaatataacatctatattccaattttgtcatttgatccaataatgtcatttatggcattttctcctccttctagtttctcaatagaaatctctaaagcctgtaagcatgatgtttgtatgtctgcatagcagtgttgctgattgtaacgagtgctgtctgtatgctaaaaggcctgaaaggtgtctatctggaagcagtttataaaattagataataaaaatttgaaagtattgatatgtacttattattttttaaaatactaactttctactaatttggtaaaacattccaaattcgtttgaattcatgacattttatcatatctttttttaaaatatttcaaattctgacaaataggaacaaagttttttggttctttttataaagaatgtggaaaaatcaatatggaaagggcgatttcacatgttcaatctgcttattactatatttgcaatatgtaaatagtagtgaacttttcagtacaataagatatacaagtctagaatataattattaaagaggagttaaattgtatccacaagttatcaatatcagttaaaaacaaatcattaacttttttgcagttaacaacaaaaatttatccattttctttggctaacagttcaagtaaatagatttgccatcatggagctcatcactttataatttaaaaaaagaaaaatgtaatgtctgtttgttataatgtcctatacagtttttgttttaagtttagtaaattgattaatttccagttctgaaaatttctcctgaaagagatgaataaaggatggtagggtgggggtggtggctcatgctataatcccagcactttgggaggcggaggtgagcagatcacttgaggtcaggagttcgagaccagcctggccaacatggtgaaaccccatctccactaaaaatacaaaaattagccaggtatggtggtgcatgcctgtaatcccagctactcgggaggctgaggcaggagaatcacttgaatccaggaggcggaggttgcagtgagctgagatggtgccactgcactccagcctgggtgacagagtgagactcagtttcagaaaagaaaagaaaagaaaaaagaaaagagaaggtatttaatagagcctttctcttttttttcagatatgcatattactactcaggattgggtgctggagttcttgttgctgcctatatacaagtttcattttggactttggcagctggtcgacagatcaggaaaattaggcagaagttttttcatgctattctacgacaggaaataggatggtttgacatcaacgacaccactgaactcaatacgcggctaacagagtaggtacattgttaatgtcacactttcatatagaaattaattactgtgtgaaaatatgtcaaggaaagattttaaatgaaaaatgttactagattgagcatctgatctatattagaaatcgatcatctggcagccatgtctagcagcatctatagcctatgccattgcatgttggctttcccccaaggtgcatagtaggtttatttgaggactgaattcacatcttatacctgtttatttctcatggaactttctactgcaggacgtgacaggtgctagactgtcagtaaagatggttgaatcaatgaatagatgattgaattaatttacaaagagacttgctttagtaattgtcaactcttcacttattcaacaaatatttgagggtgtttcatgtgcgaagtaccattctgtgtgttcgtaatatatcagtgaacaaagcacagatctctgtccttttggtgcttacattccagtagagggagatagatgataaactttcctgactgggagtcctggcaaaggcatcctgagcaaataagtcaaaaaaaaaaaaaaaaaaaagggaaaagcaagacatttagggccttgtaaacctccacaaagacttcaagacttcagctttcacccagtgaaatggcagccgctggaagtttctgagctgaggagtagcatggtcagacttgcattttcaaagcatcccactggctgctgtgttgagaatagacttggttgggaatagggacaagagtagaagcaaagatctcttccctattacttccctataagaagaaatgcagtaatacttccctactactgttgcttattattgttgcaatgttcttcttaattcttgcttttaaacagatacatttttatgctcaaaatgttaatgcttctctcataggattgactcatttaatagtatcaacttaatgatactaacttattagaagcattgatcaatcctgaatttcttcctttgtgcggtgtttaggtggggaagatgttattcaagaggctaagactctgaaagaggcttgcagtcagtgaacaaattttacttgtctatgtgtttgttggatgtctacttcatctttctaactgaaacctcctgcctgtaaccacttaggtgtgatcttttttagtgacatctccaaaatcagtgaaggaattggtgacaaggttggaatgttctttcaagcagtagccacgttttttgcaggattcatagtgggattcatcagaggatggaagctcacccttgtgataatggccatcagccctattctaggactctctgcagccgtttgggcaaaggtatgtgaaagctgggcctttttatgtgtgttaacccctgcacacagtaatctttaatatgcagaagtctcgtacttgtacctgttcaggtctacattaaatgtcagttgaaactacatccagtaacatggtgttaatatgatgctttcataaggaaattaatttttaacataattcaaaatgtcacaggctgggtgtggtgactcattcctgtatcccagcactttgggaggccaaggtacataaatcacttgaggtcaggagttccagaccagcctggacaacatggcaaaactctgtctctactaaaaatatgaaaaactagccttgcgtggtggtgcatgactgtaatcccagctacttgggaggctgagacaggagaatcgctgaactcaggaggtggaggtcgcagtgagcccagatcatgccacttcactccagcttgggtgacagagtaagacttcatctcaaaaaaaaaaaaaattcacagttcttacttcgattacccttagttaaggaagtgcaactttaaaatataacatttccctcaaattattgcatgaacataaaaattttaaatagagtttgtatttgttctatttgttttaatcattacctgtgatggttaagtggcactctgccagttttgcctggcaataaaatacacaaaatgtattctactttagccaacacttcagagttgagaaattttactggcaatttttgctcatcctgacgttgatgatttacacagtgaactacctgtatctcttttgttttgattcttcctttgcttttctcctgaaacatcttgtttggctatcttattattcagcagaatgcccatgaggaggtctggaagtattgtttttatagtaattaaaaattgtgacacaagtccaaagtgggtggatcacgaggtcaggagattgagaccatcctggctaacacagtgaaaccctgtctctactaaaaatacaaataattagccaggcgtggtggtgtgcacttgtagtcccagctactcgggaggctgaggcagaagaatcacttgaaactgggaggcagaggttacagtgagccgagatcgtgccactgcactccagtctgggcaacagagtgagaccccgtctcaaaaaaaaaaaaaaaaaaaattgtgacacaataaagttaagaatggtaaattctttcaaagcagtaaagttttattttattttaccttacaactaacaaagaaaaacagtagatgtggaacttgacagtgttcccaagagtgctatttagagaattatgtgtggattttcttttttcctgagtactcttggggagcctatcaccagggtgggtcagatatagcctttgagggatgtggacgcagccattggatccagaacactggcatttgctacatgactttaatatttgttaaaggagagggtttgggaagaaaaagtaggttaaagggttgaccagagtgcctttaaacttttctccctatacaaaagtgatcactgtttcttttctgtccagatactctcggcatttagtgacaaagaactagctgcttatgcaaaagcaggcgccgtggcagaagaggctctgggggccatcaggactgtgatagctttcgggggccagaacaaagagctggaaaggtcaggaaggttctttagccactggtttaaggaatgtgtttttacattttgttgcttcttctttgtggtatgtgttttttaccttccctttcctaatattaacccttctcgcataaattataagcaccctttactgatggctatagttgaatgtcagactctaaagcaagattcttaatcatttatgttccatggactcttttggctatgtgataatacaaatggactcccttgtttttaaatgcataaaccaaaatatgctagccctttgggaagccaaggcaggagggtagctggaatccaggagctcaagaccagcctgggcaatgtagtaagaccctggctctacaattttttttttttttaataagctgagtgtggtggtgtgcacctgtggtcccagctactcaggaggctgaggcaggagaatcccttgagcccagaatgtcaagggtgcagtgagctgaactccagcctggatgatagagtgagcctctatcacaaaaaaagagtaaaaattttttaaaaaccaaaaaataaataaataaaagccccaaaaaacaaaataagtagggttacaaaggaaaataattatattaaaaatacttatcaaaatattttttattttattttactccttaatgactatgaactggaatatagaagagaaaaacctgagaaaacatcgacttcctagttatagcccagaattctttgtagggccttgtgggtcctccataacaatgaggcagggcttcccacccaggcctctggcattcaactttaatgatccaggataagcctggaaaattgaccagtatctggaggcatgttgcaaactcttctctgaaaaaattatcaaggcatgattgacatatgaaaagctgtgtatacatctttagtgtgtatatctcaatgagtttggggataagaatacacctatgaaaaaggctattctgctctacttaaatgaaaataattacttagggttttatttaaataacaatatcccctactgtagttgaagtatgattccatataaagtattttctttggctattctatgggactcttgatactcacaactcttggatataaaaattctctggaaattctctagcattaaaaacaaagtttcccttattccccccatttaattttctacttttctattccttaatccctcttcaaagccaacatgtttctgatcctctaacctcttccttttttctctctcactgctgcttcctgtacataatagtccacacagaccacactaaccctcagttggacctcaggatgtcagtgtaatctgtgccgctccattagccccggtaagcgagccacctaagcaaaggtaattacagtgtgtccgctgctgtcactggagctgtgtgtcacactgggcagatgcaagtcttcctgccacgccttgaggctcagccacacaggagaaatcacagcgctagctgtggcctgctggctacccccagagatgcagctgtgctctatgaatgcagcccccaaccagaggaaagcaccctgaagacctgggtgctttacgcaataaaaaagacaaaccttctgatggcagaatatgttttttaaaagactaatgaattctcatgttttatttggttcaacactaaaactggtgttgctgtgttttgttttttgtttttttttgtcacaaagaaaaatatcctagtttgtgtgatattttcccctcgaagtgtcattgcatacccattggatttttctttaaatttcagggagcccaaattaaattttacataccctctgggtctagtatgaaaaagtagatttgatttaacttgatgaaaaaaaattgtaatttaacagaatcattctagatattttaaactttatatcaaatgccagcagccagtaataatgcatttgaattatgattcaaagatatgatagtaatagaatgagcaaaactcaggaagagataaaagttgaacacaatgatactaatataatagtaagagaaatgatcaggcttgctaactatgaaccagctactgtactactttctacaattatctaccaacctcacaattatcttgcaaattaggcattattaaatccatttttcatatatgaaactaaagtctggaaaaattgaataagaactcatattccataagtagtgactaccttataacctgtatctagcttgacagatgaaggtcagcctgatttttaaaaaagtcaaagagagaagcctatgtttatgtacaacaacatgtaaaattttcatccctcacccagtggacaatagagggacgattttcttttctccagagaagagacattgaccagagttaagaatctaactgtttatgagttccagtgacatttacaatcaattctggtttggcttggtttctctcattccctcttaaccctgacttgtgatattgccgtgaaggtgatggagaagctcttccatatcccagggtgagccctcaattctggaataaccacaggaatgttggttggcttggaatggatgaagggaaatggaaccgggccagtaaagagaaggcttggatctgttctaggcctggctgatcctgaattagttcaattcccaaagatctgggtctcaccatgggttcattaccttgactgactttgttacttaaacctccaactatataggagccgagtgtgactcggactatggattgttattcttaattataatgttttccctctcatttttctggtaggtatcagaaacatttagaaaatgccaaagagattggaattaaaaaagctatttcagcaaacatttccatgggtattgccttcctgttaatatatgcatcatatgcactggccttctggtatggatccactctagtcatatcaaaagaatatactattggaaatgcaatgacagtaagtagttctcctaacatttatgaagaatatgaaaatcttatttctccatctaccttctcttttctttgatatcgctcctttttgaaagatgaacatgattataggtttttgtttttggtgaatctttccactgtccagtgggcagagctgactttctagtatatacaagtcataattatgagtgtggataagaaaatagcatgtggttagaccatttgtgaaacatatacaatgtataaaaggaaataaaaatgggatgaatttaggaataaacaaatatggatgggagccatcctccctctgccgttgagttttattgtataagaaagtaagcatcattattacagaataggtcattgcacaagaaaatgttacatttatatcacttaaaacaatcagctctctgaaatacaagaagagatgttatgttagtttgtttttatttatcaaaatgaagatagcttcattttatgattgttaaaataatatatactaattttacaaaggattaggatacagaatttttaaaattaaaattacttacaatctaataatttatattctcttgatgataatttttggcatatatcttccaggtcattttctatatatatacacattgttttctttcaaaactgggatcatactatgtatatctttttgtaaccacatttatgaactaccaatattttgtgaccatcttttcatgtcagagactcagaacaatatgtaactatttaaatagaaatcttttaacatctgtacttccctatcttgctaaaatgaggatactgagcataatttggccctttgatgatgacttggggtcattatgaaagtgaatattttcagaatgctttatgcagtggtatcttcagacttcattgagaggttgtgggtgttcgacttggtgagccctcattaatgctgagtctaatttttctcacttccatcttctctctggcagtcggtttggaagcttgctaccctttcttcacttcctcatttactattgatgttttatgaagaagggaggttgaatcctgacaaccgttcacctttggtgatgagtttgtcctctatggccttaatttcctcatttgtagtatgtggataatgacacctatccggtagggctgagattgctatccccagagggagcccaagcaaagccctctgcatagagggcagggactctattgcattaaccttatggcaactattttggtcaacattatttttctttcttactggtccttatctgtattgcagatgggggatagatatttaactgatatttgagttatgggtaacatgaagtgttgctgtgttttgagaaaagccaaattatatgtagaagttttaccatgccctgagagaaaaaaataatttatcttcacttatgtttttctcagttaagttatgctaataatctggattcctgaagctgtattctgagcttctttatatcaattcattttcctagtgaaaaaatactgtgaagggaaatgtgttaagtgttgtatgctacagtacagaataactgtgtaaaggaattgctaaccagtgcacactggagtgattttatgttttatgatgtgcaaactgttactttttatgttaaaaatctttaaaaatatatgtgacatggtgctttttaggagcattacatagggccaaaatctgccatgttttatattgaaccgtctatgtaattccatgcatagttagagaaaatcatataggatggaataataatactgactgaaaatgtttctttctggtggcatttgtgagtgagtcaatgaaataggtttgaaaaatctttttaactctgtatgtattcaggagaacaataggtagtttgagaaaatagacccactcaggcaataaaatgctatattagccttgcaaatgttgctcttccacaaaaaaaaaaggaaaggataaacctaaacttaatcctttatgtactatgttacatatacatcacattttagataataatgaatgccagaatgtgacttaaacttttcctcatgttattttgctcaggtttttttttcaatcctaattggagctttcagtgttggccaggctgccccatgtattgatgcttttgccaatgcaagaggagcagcatatgtgatctttgatattattgataatgtaagtcatttattattttagtgccaaaagaagtctttgagcttgtataattaaatctggctttagtttgcatatttttgaatcaactacattgaataagttgtactgactaaagtgacatttaattatatgaaatgaatgacctgttagtaataaatgaaagaaaatacctcttattaatattttttaaatgtatctttagataatataataatactgatctcattttggaaaaggacatctgcactagtgcagagcaaagacgtttctcttcctagtttttatctttttcactttcatgttgtagccagactgagaatcttatgatttctatatgggatggggggtagataaattatcggtgggaccaaaattgacagtatattttgctgtgggttccccctctccaaaaaattatcactgcatgtttggtatgattttaaataaactacattaaataaactgactacagtgaaaaagaaaaagttttgacgtaaaaaagtaagtcactgcattcaaatattgcaaggtagctaagtgaaatttgatcatttaatctaagcaatttcctttttcattgatccaagtcgtgagaaaagtgctcagtttctgattgtattaaaagtttacattatttctaaataactgctataatcaaccattcaatcttctcaattcaatctattacatttattatttaggaatgagctaattttcactaaatgctgaaatacttggctataatatatatcaattatagcatatttttgttattgcacttgtataaatatgcatatctgaccatttagaaaatttatgaggatatgccaaaaacttaaagggaaatattatatgaaatgagatgaatatctcttacgtacttttcaggaaaacactattttctgaaaaggagtatttctttaaacagcacacatacatatacacacaatcttcatcttgggtttttcttatgtaaaggggattgtgacattccaggtcctatttttggaatttgctgaatcatattccttaaaaatgcaacttgtttgtgctatgatggaatagtcattacattttgttttatttagaatcctaaaattgacagtttttcagagagaggacacaaaccagacagcatcaaagggaatttggagttcaatgatgttcacttttcttacccttctcgagctaacgtcaaggtactgtaagtaatatttataggaattcctaactgaggttgattgttgaatcattttaaagaataaagtctctattattttgatacttatgtgccttttcctttgggggttatattcccttatttgatacttttttttcaaatttcaaactgaatcgaattattcccattttagggctttgttgtgaagtgtgttcttttttctcattttccttacagatcttgaagggcctcaacctgaaggtgcagagtgggcagacggtggccctggttggaagtagtggctgtgggaagagcacaacggtccagctgatacagaggctctatgaccctgatgagggcacagtaagtgggaagaaccaagctttccagagtgggaagctggatacaaattggccctttgaaattggtttttcagtaacaaatttgcgtgtgaatccagttttggtaaaaagcctacaaaatggcaatgccgatggataatgccttcacacccttgggctggtttcacaaatgcattaaataaaagtcataaaagctgtggaagctggacaaagctctcctctgttctgactaagctttcataacacattaaattactgcaaagcagtctacaaaccactgagaggattactttcaatgagttagagtttggtcaaacatactccatatagcaattgttgggaacaattgatgacaattagggtcaccagatattttaggacagcaattaaattcatccaagacagttgagttttcttaaacttaggaatatctaagggggaaagtgggatggtctcttaagaaactagtctcttgagaaaattctagaaacacagagacagtaatagcctagggtatgtttttttgccatttaaaagttttgctataaatttgaatttacagaaaattgtaactagagaactcacagatccttcacccagatttagattgtttatattttgacccacttgctttatcatcttctctttctccgtgtgtgtgtgtatgtgtgtgtttatgtgtgtgtgtgtgtattatgtatacccttatacttcagaatacattcctaaaaaggacattctcttagattaccacaaaacaatgattaaaaatcagtaaatttaacattaatgcaatatacaagtccacgagctatattcagaatttcctcagttgtcccaattttagagcattgagtttatctgatattaaaatggattataattcaataattgtgaaaacagaagattataaggtaaaaagtaaaaataatggcatgccaaaaccaaaaatcataaaaaggcattgggacagaacagagatctccagaattaatacataattttctacaatacatggaactatttatttaatttaataaaattaatattattggaaaaatctgatattactatgggggaacataggcccattctcatttactaaagtaaactctgggttggttcaagtgtaaatattttctttattttttaaaaagaacctggtaaaataccaaccattgagaattaaattattattgaaacaactgacatttttaaagaaagcatatgttaacagaaaaaaaagatcttcagaaattctataactcagagatattcactgttaacatcatgatttaacaattttcttaccactgaaataatagaaaaaaatgcccagtggcataattgattaattcagttgttccttaagcctctttccaataaaaaccaataaaactatgatgaaagaaagcaataaaggcctgacatggtggctaatgcttgtgatctcagcactttgggagattgaggtgggaggttcacttgaggccaggagtttgagatcatcctgggcaactaatgagaatctgtctctacaaaatattttttaaaatagccaggcctggtggtgtgcacccatagtcctagctacttgggaggctgaggcaggaggatcacttgagcccaggagttcaaggctgcagtgagctattgttgcaccaatggttgcaccactatgctcctccaaagcctgagtgacagaatgaaactctgtctctaaatttaaaaaaaaaaaaggacaaaaataatgaattggaacaaaagatttattatatatggaaaaagtattatatttattattagagaagttaatatgaatatatgaaggtaaccctgctcattatgaacatgcgactctctggaatatataaagatttgtaaaaagtttcaagaaatggtcaactttataaatgtatacaaatgaaaacagatataagctatcacctcatacctattaattggaagaaaacagattaaaatgataaaacccagtgctagtaaattacaatgaaacagatatatttatatattcctgttgacaatgtaagttattaaaatgttttaagataattatttagccttttattaacaagcaacaaatgcccagcaaatccagtcattgtacatgtaagcaattgttgtcaagggagaaaaaataaatcataatcttcaacttagtaattctctactcttgcaataaatattgaagtaagtcaaatatttaagaagaaaggaagtaaattaaagcatgtaaaaaatagcaaaacatgggccaggcgcagtggctcatgcctgtaatcctgtaatcccagcactttgggaggccaaggcgggcggtcacgaggtcaggagatcaagatcatcctggctaacatggtgaaacaccgtctctactaaaaatacagaaaattagccgggcatggtggtgggtgcctgtagtcccagctactctcgaggctgaggcaggagaacagtgtgaacccgggaggtggagcttgcagtgagtggagatgggccactgcactccagcctgggcgacagagcgagactccatttcaaaaaaaaagcagaacaccataagctatcaaaattatatgtagaccaggaaggtaagtgtgcatttttatttaaatttaatattggaacataaaaataatggtatgccaaaaacataaaacccaaaattgtttatggcaaataatccttccacgaaaaaactgtatatatgaaaataaatatcaggagagagcataagctttttatttttgttcttgcatattgctgtttatttctaattattatttctaaacactgaaccaagttaaatattaggtaggatgtttttcatgaatggtcctgatacttcagctattaaatggttaaatacttaataggaaatatttctttctttcagattaacattgatgggcaggatattaggaactttaatgtaaactatctgagggaaatcattggtgtggtgagtcaggagccggtgctgttttccaccacaattgctgaaaatatttgttatggccgtggaaatgtaaccatggatgagataaagaaagctgtcaaagaggccaacgcctatgagtttatcatgaaattaccacaggtaaagcctctgataaagtagttgtccttgaaattagaatttcacctcataggactgagtttattcttcaaaggtttagctaataatgtttgagatgcaagattgtccaactttgctagataagtcccctgaatgactcagttaggggttaaaggattatagcatggtagatgattaatataaaattttatacagcatgtgtcagttttttataattcagaattcatttatcttatcatactttatgatacattaaaatagttaagacaaagctccatgttgtctttatgtagttctatagaattcctagcctttttaaatttaagttacttcaagagctgatccatgttttctgtgttagaaatttgacaccctggttggagagagaggggcccagctgagtggtgggcagaagcagaggatcgccattgcacgtgccctggttcgcaaccccaagatccttctgctggatgaggccacgtcagcattggacacagaaagtgaagctgaggtacaggcagctctggataaggtcagtagactctaaaaagctgaaggaccaccacattgaaacctattgaagattcttgccagtgcttccggagtctgggctgagaaacagaaacatagcaaatggagctacctcatggagctgtattgatttctcctttctgtcaggttacattgtcttcagagacaggtgaagggtactgacttgttttgaccatggtgcagtgagcccagatccaggtctttataacaagccatttagctttgtttatttcttgcacatgggctattgcaagactacttttgaccaaaagtagtcatgttaaaatatatatatttttaaatccggttacccagacactggtccagctgaaaactaattcagaatactcaccctattttgtaggcagtgacatcatctttatctattcatgtaggtgaccaggtgcttttctggaaataaagttcaactctgtacttgtctaagcatataaataaacaattcattttaagggtgctgagttcatctgtccagctcagatatttctaagtctctcattagcatttttactaagctgaagtgtcacaggaaagaccttatcttggtacacttttgggggtaatgctgatgtcatctgtattaacaacacaatgtaaataccagagtcagatgacaccatagaaattagtttcaaacacataaatatcataaatatatttgatttaagacagttcagtaataatatgtgcaagttccttaaggaattctatctgaaccacctcttacaatttaagagacaagctgcacgaaccttattttctcaggaaaatttatatctgaatcctaagttaacctaattcccttttatgctgtaaactgtagttaattaatgcctcatggtttatcagcttaatatcttgactctttttgttgttttttaagacagggtcttgctctgtcacccagcgtggagtgcagtcgtgtgattatggctccctgcagcctccacctcctgggctcaagccatccttccacctcagcctcctgagtagctgggactgcaggtgtgcgccaccacacctagctaatttttgtatttttggtagagatgggtttttgccatgttgcccaggctggtctcaaactcctgagttcaagtgatcatcctgcctcaacctcccaaagtgctaggatttatagatgtgagccactgcacctaaccaatatcttgacttattttatataatttaataatgattaataacacaataataattattccttacaaattcttgcactgaattatactgcttttgtgtatattaaatcatgatattaaggagtcaaaatataatgcatatgagactggtatatggttggttattctgaagttacttaaagcagtacatcataaagtaatacatgcataagttattctaacttaaaaatataattagacattcatgtattggcatagactttttagagtaaagtcgggtagaatgagagatatatttaccaaaaaatcaaaaacaaaaaagagtcctattcagccctggagtctaggttccaatcatttccaggatacagatattcaatatacaatatagttcttgctgtgctaaaagaatagaattattggagatgaccagtatgtattgtttttcataatatgacctctgccagaaaaactgtgatcttgcaagttttagtacgtatttggacaagtcaattcattcaattttagctgtttcttcgtgttctataggatcatagcacactcctcagttgataaccttttttatatttactttaaaaatagctgatgaactactcataattttttaaagtctccaggaaaagccattagcagcttagggtgatggttaagagcacaggctttgatgctaggctgggattggagtcctggctctgttcttttctagctgtgtccttgggcacgttaactaacctctctaagcctgagacatctctgaagtaataggggaagaggggacagaaatagtatcataggattatttaaagaataaccaagatactgcatgtaaagttattagcacatgcctagcacatatgaaacacttgatattgttggctgctgctattattatggtgattagcattaccaggattattattattattattttttggttgctaaattggttacctattgctatgtaagaaactatcttgagtccacgcttaaaacaattcagtgtattggctgagtagatcctctgttctttccacctgagcacatggctgcatttacctggagggctggcttcattaaaatggtccatggtggcctcactcacacgctggctgttggctggccatctcaattctccatgtgacttctcacactcatacaataggctaacctggcttccttatatgaaagtttcagggcagtgtacccagagagcaaagactaatgtgtgaagtgtccagaggattagactccagaactcatcttgttggtcacagcaagtcataggctagcccagatttgaggagataacagactgtgcctcttaatgggtgagcagtaaaaaatctgtgaccatattgaatcttctaaagcatgccctctgtcacaattatttacatttcttccacatgcaaaagaaggtcacctcttcctcagaccctcaaaatgttcatacagtgatagcatctggctcaaagaccagtatctgaagatctgcatgtggtctaatacagatgagggtcttcattttcagctcatcttgacccacagacctatgaaaaagacaagttatcatcaacacatactctcaacatagagtggcggtgcagggacaggataatcatagcagatactcattcaaaaaggatgagaacagaaagctcatagcagtccttggccatagcaattctgacatgcagccaattaccccactactccagggaaatgggatgtttcttgattaaggcctgattctgctccccaggagtgggttccctagtccattgttctctttagttccagggtcttttaccttccctctaagagggctttcctttttcataagaaatgatctgtatctgcagctgagtggatttctttgcatgtttctgcccatagaaatttggggcccttttcattttgtatttttttcagtctcttttagactaagctgaaggactgtcttaaagactttgtgagtttacttagaatctagctgtcatttactcaagccccagaagttatgcctatatattttattttgagacaggctcctctcttctttgggctgcaagtgaacctgccatcagaaaactcttaaatagtttttaaggctttttttttttttgtagctgaaagtgtccactaggctctgcctaaaatctttcagagatttttgctaaaaatcttacacctacacactctgatttttgccctaattttattggatgactaacaacttcattttccaactgagtactggggtctgctttattgtcttaaattctccttgtaaccaagtagctcattctttagctgatcattctcttcccaaacctcattgtacacagctaggggaatccacttgtctctcctatagtctgtctagagatgtctgaaatctcctcagccagatgtacaggttcattaagtaaaatgtctttcttccaagtcactgcaggaaatatttttgtcaaattttccaaggttacataatgaaggtactccttttctatcctctaatagcaatttctttactcttgtttcagtctccactaacaatattatcaccttcctttcaaccaccacctaccactcaatcccaaagccaatgtcacatgttttaggtttttggttacagcagcataccaatctaattactaatttctgtatcagttgttttaagccaagaatttagtgacttaaaatacaacttttattgcccacaaatttgtgggttggtaaagtggtttttctgttggttttgcctagtcttatttcagctcagggtcacctgggctggaatattcaaagtggcctcactcatgtgcctggcagttggggatggctgttgcctaaggcaggttgcttttcctccctgaagccagttatccttcaggaggctagagaaacttcctttcactgcggttccagggtaacatccgaagatggcaaacagacgagctgtgtgagatcccttgaggcctgggctccagaaattgtagaaatcaatttctttacattttctttgtcaaaacaagttacagggcctgcccagatatgaggaggcagagaaattggctccacttctgtataggagaagctgcaaagtgtttgtggccatattaatctgccatagttgctatgaaaacagtttataatctgcactaattggctccacactgcaaggtaattatgctaatatttttacagacaataaaccatacctttaaagataaaccctttattactatgtccccaaagaagataccaatcaatcagttagccagtcactctaacttacaatccaactctctttttaatgatgaaaagttgaatttcataaattgtagtcttgcctctgaggaccataaggatgtatcactattatatctactgttatttctactcaattacccatcctggaagaataatatttttattttgtggatcctttatacattgatcaggccttccttgtgtggcaacagcttactgtagttacctacttatttttatgccttctctttcctaggaagaataaaccaccccaggaggcagaattaataaaaagattcatatttgaatctcttcaacagcccagtgccttgcacatagtagaggctaaataaatatttactaaattgactatgatggcccagctcattgagaaaatatgtctacattaaaataattttttttttgagacggagtctcgctctgtctccaggctggagtgcagtggtgtgatcttggctcactgcaacctccgcttcccgggttcaggcaattctcctgcctcagcctcctgagtatctgggactacagtcacatgcaaccacgcccagctaatttctgtatttttagtagagatggggtttccccatgttggccaggatggtctcaatgtcttgatctcgtgattcgcctgcctcggcctcccaaagttctgggattacaggtgtgagccaccgcgcccggccctaaaataaattttaatagtgatgaccatattagcttttgactctacagatagcaactatttgtcaaaataaataaaatgctattaaatataagatcttgaagaaagatataacagcagattttgtattttgactcttttaaagaaaggcaatacagtttcatacctacatgcacactcctgatcatggtgttatcatagaagaacaggaaaagaaacaaaatggtggccaggtgtggtggctcacgcctgtaatcccacaactttgggatgctgaggctggcggatcacgaggtcaggagattgagaccatcctggccaacatggtgaaaccctgtctctattaaaatccaaaaaaaaaaaaaaaaaaaaattagccaggtgtggtggtgggcacttgtagtcccagctactggggaagctgaggcagggtaatcgcttgatcccaggaggtggaggttgcataagccaagatcatgccactgcattccagcctggcaacagagcaagactccatctcaaaaaaaaaaaagaatgaaaacggtgattttatggtgatttttataaaaagattccaaaaggtttcattctgatgctgttttaccaaagttccagaaaggctagtagattagtcctccctttgtttaggcccacctttcatccctgaacatcccaaattagtcaaaggtctaaatttcataatagctggtgtccctaaatctaggatatttatttatcaatgtcctgtcatcatcagggtgtctgggagctctgaaaaaaaaaaaaaaaaaaacaacaacaattttttgtgtcaaagctctactttggccaacttctcttggtcaaaggtgacagttgcttacttctaaattgatgaacacgtactttatttcttttacatagcaatcattcactcatacatctgattccaattcctttgtgtatatatgttgacatatcatcaacctattatcatcatcatgataatatagtcattgttagcaatttattcatcactgttagcatcatgaatataattacagtaatcaaattattttgtatatgccttattatatatggactaaacccagcttccatataagtaaatatttgtgagtgcttctttggggcttatatactaaaaatcaaataatagtcttaaatgttgtccaagagagctgtgttctagcctctctctctttccagtgatgtttctcttttatatttacttaaaaacaattgattcatctggatttattttaatgtaaggactaaagtagaaataccacattactttattaaatggctgcacaattgtcccaataccatttattgtataattcaccttttctttaccaataggtagtaccatatttattgtaattaaattcttagatggtttatgtctatttctggactctccatttggttctattgatcaaattacccattcacgtgctggtttttcctaggttttactattttaattgctgtagctttttatatgctaatatctgttagagatatttccttctcattactcctctcattaacttctttttcagaattttcatggctatttttaaaaaattgagatacaaacacatgccataaaattcaccctttaaaaatatacaattccggggtttttagaatattcacaaggttgtacaaccatcactgctatcgaattccagaacattttcaccacctcattaagaaaccagtcactctgcattccaccctcactctagcccttggcaaccatgaatctaccttctgtctctatgaatttgcctactcttagatatctcatataaataaaatcataccatgtgtcatcttttgtgactggcttctttcacttagcacaatgttttcaaagttcatctatgttgtgatgtgaatcaaaatgcattctattttatggcctaacaatattccattatatggatataccacattttaaatctgtttgccaattgatgaatatttggattgtttccactttttgcctattatgaatctagcctctcatttttaatttatatgttaaccacttaggtgaattagactattctctaataaccatcctaatgatgtggtttgattgtctcagagtaggagtgatcttaagctattgggtaaaagggctaatgagtgtcagaaagagtagccattattaatgacataatatcaatacttttattggcattatccagggtttaaatgcccatttataaatccacccagcaaacatatgaggccactaaactagttagacaggtgatttgtagattttagcatgcataaaaatcacctagggcacttgttaaagagcagatttacttgccttactctagagattatgctttggatggcttttgaaccataattttaatagtcctgatcccaaggtacattttcacctaaactgcctgctttcagttcatcagaattagttaagatcaggctcttaaaaagagatcctacagcagtgctctggaaaaggctgtcacttggcaacaacttccctaaaatatttctggtgatgtctctagcattccatataacttagagctagggcttctcagacaagtgtgaaaacactgaagaaggatcaaacccttatttttcttaagtaaacactgacactaccataggtttctggagaaatcacccatcctcctactgaaggggttagccacttgtctggtcccaaactcgtctgactttaatttttcataaagagtgatgcctttgccataatcacgcagagatctggagtataaactactctctaatcatctacaaacagcattcatccaagtgcttaactgtgcatgttaattgacagtgtgccaatactgtaaccctgatgcaccacatttttgttcttttaggccagagaaggccggaccaccattgtgatagcacaccgactgtctacggtccgaaatgcagatgtcatcgctgggtttgaggatggagtaattgtggagcaaggaagccacagcgaactgatgaagaaggaaggggtgtacttcaaacttgtcaacatgcaggtacttgcttttcaggaattttttctgctatttgctcctcaatatagtgttctttaaatattaaaatatgatccagtgaatgctatactgagcaagaagaaacttcaacaagatgcctaaaagtgtatatctgagactttaaatcagaatctgtaaagaggtagcaggtgagaaaataggggaaagtgccaaaaacatcatggatatattccttaggacagattcctaattgcctggggaatgtggtcaaactaaaaggtcctttctaccataatgggatggtcagagttttgggagtcagaggacgagaaaagtgtttcgacttgtccgaggagccccggctctgagttatatggaatgccagagactttaccagaaacattttagggaagtcattgacaagtgaccgccttttccagagcactgctgtagggttccttttgaccagccaggatctctagtggttgagggaggtctcatgtgatctaaaattgtttcccagatgatcctaataagaccatcatcaagatttgtggctctaggaagtgaatagtttgtcttttaaaaggaaaaagcaggccaggtgcagtggctcatgcctgtaatcccagcactttgggaggctgaggtgggcagatcacctgaggtcaggagttcgagacgagcctggccaacattgtgaaacccccatctctactaaaaatacaaaaaattagctgggcatggtggtgcacgcctgtagtcccagctactttggaggctgaggcaggagaatcgcttgaatccgggaggtggagattgcaatgacctgagactacaccactgcactccagcctgagtgacagagcgagactctgtctcagagaaaaaagaaagaaaagagcactcattcattctagttcctaaaacaggttatattgataatgattggtttttcatattattaagacatgttattatactcagtcacttgagcaacattgcagaataaataacctaagaatattttattctatgaacgattctatttgtgaaagtatatacatttgctttgatacaactgtaattagcatgtacacacatatttttgttcttttttcttaacatttcagatatacgtcatccacatactattattttaatgggtgctcagaagttcattttattaatgtgtgaaattagtcatttttctaaagttagatatttggtctgtttccagtatttctctattctaaatattgccactgtgagcacaagtagatcaaaaaaggttgtcaaaattttgccttgctttctgacaagtaactcttctgagccttcgtttctacatttggaataccaaacctaccatgagaggttgctataagtttagaaaaataaacatctgaatacttgtgtactaaaaacaacctactgaaatgtttaaaagggtggattttgtgatatgttaattatatttttaaaaagctgtttttctttttttttttttaaaaaaaaaaagacctgacacaaattagatgatgataaatggtggttactaaaatttgcaaattcccccaaatgaaaataccaaatgaaatgacgaaaagttttataactcaggcttgcatgtgccagagggtgttctacagtggagggaatcaatgatagtgtctctgccgaatgctaccatatggcctagccaccataaagggtctttgtcatttcactagttaggaatgcataaaatgttactttaaatccattttagttttaatttcatgagtggttaccaagggtctgtgattttgcccataatgacatgttgaatcctcaagtgaaataaccacttggctgtcctattgccataagctcttgtaagaatgacctctgcttccatcaggacttggattgggagactgctaaagagatgcagacagctctgacctttctatatcaaattcccaagcttactttcttaggaaaagttgtacatttgaagactgaacagtcagtggtctggcatgatagaaatctgtcaccaactaggcaatagctttgagcaagtcatttaaccaaattgggttttgttatcctcacttgctaaatgagcaggggcttcaggtaagatgacctctgatatttctaccagctctggcattctgtgattctcagcccctttgaatagttccacctgggtacccccacatttcccatttctgatttgagttttgccctcccacttacttggtgaggctggagagatgagggaaagacccactgtgagcctgagagtcagcagatgctcaagctaatgcagtactcttttctcaagtttcaaagaccaacctggttttcattcacccttgttttggtattgtttctaacaagtatcactgcttttccattaggtagactgttggctcttagttgtttcttttaaatgtatcttaatttttttctgattataaaggtaatgcattctttttaaaaatcaagcatttttttaaaaaatccaaacattacattctagaaacttgaaagtcatcataagccaaatccctacaaacagccactgatagctatttcgtatttatttttcatctttgccagcctaaagagttaaacagtatcttcaaatttaactatttataagattgagcttatttctacatttttattggccatttatatttttcttcctctgtgaaagtatttgttcctgtattaggatatttttctgttgtgttgttcatgatattctcattgatttgtgagaactctttacataaaaagaaaatacactcttctcttgcgtgtattggagagatttttttttcctgctttgttcctttcaatttcactttgttgtatttggctgccataaagaagctttaaaatgtatgtaattaggttgtcagttttttcctccatgtcttcaggatttgaggttgttctccgaaaggatatttaccccatttcctttcagcattttttgttctgcttttttacaattaaatctttgagacaactgaagtatacctgggtggaagaaatgagggctattggttttaaatagatactttttaacacctggtggaaaagtggctatcttggcttggagctcaatgacctttcagctgaagcacccaacaccaactgagtgttttaggtaaggcacagaaaaaatattatgaaagagacaggtaatgttcatttggtcatagaaggaagctaaaatctgaatgggcttattggaagaactgtccattgagatggacctcttgatagcatggatgagattaccaaaagaggaaaagttctggggaggtattcatgagaggtggtctggtttgacttgccatgagctagatttttggggatccaggcttgggcaggtagtgggaagctggggatgattttgagctgccctttaggaaaataaatctggtagcagtgtgggaacagatggcagtgagaatgcaagggatcaattacaaagtctgcagcctaggttggtttttgttgagagatggtataaaactgattcagtaatgagcaaataaggaaatccaccaagcagaacatatcactgcaatgtggttcaaggcaatatataagcacatgggcagtgttctgtcagatgttgaatgagcaactggaaaactaagagatcatgattggctattgtatgtacagtaaggcactagccaaaggattgggttcagggcaggtcttgaagggaggagcaagaacaagacactactacaaggactaagaccctgaacaaactattaagatgtgtagttggacacatcttaatagtggaggaagcaaatagggaaccagtccaaagtccaactccagcagggcttgatgttccctcacccttactaggcagtgaactagaagtccttagatcagcacccccacccccattcccattaaaaagagaactgatctcacagccagcaatgaggctgagcctgcatgttgggtctcgttgtgtgcatgagagcaggactgtgaggaaggaagatgaccatactcagccagtcgaggaagacagttttacctcccgtgggtagtgaccaggccctttgattcagcttttcttgtttgtagctttaaaaacaagcccttgttagtgtttccatgtagtcttcttccctttcttggtggccatgacttgttccctggattattgcatattaagtaaattcctatataccttctggattacgaaaaatgtgtctttaaatttttagaaaatattcttatactccgattttcttattgttcaaattgaatttaacctttctatactttatagttttctagctatccttgattgagaagcagttaggaaatctgaaaatcttgatacatgtaatattccaaattgctttatgattctaaacttggaggttacatccatttggagacacacacacacacacacacacacacacacacacactttaatgtcttgatattctttcagacatcaggaagccagatccagtcagaagaatttgaactaaatgatgaaaaggctgccactagaatggccccaaatggctggaaatctcgcctatttaggcattctactcagaaaaaccttaaaaattcacaaatgtgtcagaagagccttgatgtggaaaccgatggacttgtaagttgtttttcacttaaattaagtcttttactttgtagttttgctacaattattgaaattcttagccttgcaaatatttttcaggcacagatgactgctactatgagccatactctttgtaaagaaaaaaattttcaaattttaaatgtatttgacaatgaattgaaatcagttccaattataaatgggttttcaagggaaaaaaaatccagaaatgtagtctttacgctgagatgcttaatattaaaattaaatttgacattcatctttgaggtccagaggtaataagactggtccaaaacgagaggccctgatatttgcatactctattgggtaggattacatttgattatctatattaggaaacccagaatagcatccgtttaagcaaattaagagtttttatttctgtttcacatgccaaaatcttagaggtgaaaaacccagggctagaacagtagctccacagtccccatagacacaagctcccttcatctttatctgcactaccctggcatcaggtttccatcctcagggtcacttatgatctaaggtggctcctgaagccctacctatcacatctgtggtccaagcaacaggaagaaacaaagaggttttccagaattcccacacaatactattacttataagtcattggtcataattcgatcacatggccatacttagcaatgagtatggaaaattcaattttttttttttgctgtatgcattgacattctaaattagattggaattctcttacttagaaaaagaggagaatggtgagaaatagcaacgttggatttaggagattattaactccagttaacaaataattttatttatttatttatttttaattttattttttgagacagggtcttgctgtgttgcccaggctgaagtgcagtggtgcaatcttggctcactgcaacctccacttcccgggctcaactgattgtcccacttcagcctccttagtagccgggactacaggtgtgtgccaccacacctggctaatttttctgtgctttttgtagagacgaggttttaccatgttgcccaggctggaacaaataattttattatacagagggaatccattccaaaaaaagatttccttatttcaagatatagttttgatatattttgatgttatttgttaatgaagactgagtttatttttactcttgtgttggcctgagaaaactaattctaccaataatttattgcatctgtttttatctgtgcatgctattactgcagaaattacaaggactctcttagaggtcttaatcttggtatatttatagaaagaagaataacaattgtaccattttggagcgtcattattataagtcagataagcaatttcccctcttttggctatgaaattatccacttttcatttcctcatttattttgagagttattttgctatctctttaaactccagtattttataggagcacgtctcttgaagaaatgcacagagaagagggggaggcaggaaatgctgcaatcaacaagattgtcccaagtaccatcatagggagaaaacaacatgccaaaggagagggagagattaagtctgattagagggacctgtttgtgtgctgaagagcagtaaccaaagaaaaagattcattcattatgctggagatagggacttaaagataatgttaactagggaggaaaaaaaaaaaccctgaaatacagaaaaaatgggtaatttgaaagaaggctcagtagaacctacttctatattctctgttttatagagatataaatataacctttctcagtgacctcaagtttttgggattccatagtcacctctgtctcaagtttaatgttaaactgcttctatcatcaaaacattctttatgagacctaaatcctgcatgcttggccagacatttaattaaacatttgctgagaatcttatatgtgccaggaattggactactttctaggaatataaagacataatctttaccttaaaaaaagttacatactagaaatggaaatatgtaaacaaaaaaatcacagacaagctaagctatgaaataagagaagtctgcacagggaaaagtgtggtaagagaaaaggaatgtaattaatttggttttgtgagttggaaatatggtacagaaaaggcaaggttttggggtgaggaggccaagcccatgttctccagttagtaatggtttcctacatttgcaaagatgtttatccatctactcaggtgtattgtctcatttgacccagatatcatccctgttagagaggcaggactgtatcataatatatgagaaaactgcagctcggcttatgtggtccagccatgactgtcacaccaatacagtgttgtgtaactccagagctggatgccaaggtatttgtgcccagatcctgctacctcgcagtctgctgaggccagaatagggacgggctaagcatcccatgaaggttatttcttggccgaacaacccatactcagcttatgatgtgtaatcagtaaacattgttaacatgttataatatactgtcctactctctagtagtttgcttgtcattctctgcacctagtttgcgagtcccttgagggcaatggccatgccttttctatgtctacagactctggtaactgttgtgtcatcaccagtttgccctgatgtttatatgttctaggaagcaaatgtgccaccagtgtcctttctgaaggtcctgaaactgaataaaacagaatggccctactttgtcgtgggaacagtatgtgccattgccaatggggggcttcagccggcattttcagtcatattctcagagatcatagcggtaagtttgcaaacaccacataacagcctgaattagatcaattcatcagctgctgcttctcccaacctcactgactggctccattctgggattaagcagccttaaattaaactaagccaaagtccttaaatcccttttgagaaaagctgtgagggaaaagataagtagcctttgaatcactctaagttatgatattaatgaaattataaaatgtaaaatcaatgaagaaggcattctaatgagctctcttcatttggtgaaactggtgtcagacaatgatccccaatctgtttgtgtagaaaagctggtacaagtcgcacagtgaggtggagagagagtggagcagggaggggttaaagtcatagagtttaataagagtccaggcactgggtatagactggcctcaccactcaatagctctcggtacctcagtttcttcatctatacaataaatctacctcataacatggctgaggattaagagattatataggtaactatctggaaagcatttaagagtgtgtgccttgtagtaagtattcaaaaagcgatagccaccccattttagcaatccttccaaggcttggggagtccaagactaagaaagaaaacatactagccaatcattcaattaattgggggatatttaaaggaagttatcacaaatataaagcctccatcaattccatgaaatccagaattcatattctacaatttcagtcaagctctaatgttattggagagactttgttgttgaggataaataattctccatcatgttacgagtttattatttttgtgatgttggacatcgatccacaattaagaccacaagccaaaaaataaataaattagaaaagatcctcctccaaatcttttaaagtttcaaaacaaagcaagctctggctctcttgcaattcaaggcaatgtggactatatattttggggcatctgtctgcctagtgctgctccaggcactggagatacagtggtacacaaataaaccaagttgtgccctcaaacagcggtttctgtcggggaagacatgcaatggacaaacaaaaaaataaccccacaaacatgtaacatgttgagggataacaagagttttaaaagatgggtagggtaatagagaggtgttagctgggggtgctgtttcagataggatgctcaggaaaggcccctctgggtggaagcctgatggaatgagaagtggagggctgggacagggaggagtcacagggagcaagggacatataggaagaggaacaaatgctaaaatgtgcaaccactcacagtccatatgcagtatgtcaacctatgttaacaaccatgcagtcagaaagtagaatagagattaccaggagctgggaggaggagggaatggggagtcagtgtaatggtatcaagtttgggaagtttgggaaggcgaaaagttctgtagatggatactggtgaaggttgcacaacaatgtgactgtacttaacgccactgaattatacacttaaaaatggttaaaatggtaaattttgtgttatgtatattttaccacaattaccaaaaccctacatatttgaagcctagttttaaacatgtgacactcaagccactatttatgagaggaatgaagaaggatcagttatgtaatccaagtgggcgttttaaatattcttttgtagatttttggaccaggcgatgatgcagtgaagcagcagaagtgcaacatattctctttgattttcttatttctgggaattatttctttttttactttcttccttcaggtaggtacccatgatttgcctttctcatcaagtttataatttaattagagaaattaaattaaacctaatggagcttccaaattcttacagtgaaataaattgcaaacatgattggcataaggctctgctggagggtagactccttatcagggggaagtgtgacttccctgtgtcctaacttatattacattacaagtttgccctcagcagacattcattaccaaggacaagagacctcagtttactgcagaacataagagtaacttaaattcaacaggttgggaactgggaaagtacagtccaatagcattctcttttctgttgttactctttatagaatatcaagtaacttctctgatcttttcctacttaattgatgaactatttgaaagaacataatattttgcattctaacgttgtagacctggccaaaataaactagtcaaactctctaattgtacttttctacccagttagacttctctgtaatttcttttgtctctttaacccagtgggcaccacataggcctttcgaatataatacaatccatcaagtcagcaaaatagtgtttcctagtcatgccagcatgcttctcttttattattgttgaaccaatggcaaagtaaaccaagttttttatttagaaatcattgccctactagacacaactcaatgatttgatccagccccagtccctggcatgctagggagtgcagctagaaaatgtgtttcaggggccgcaggaacagtgggctgatgcatagaacctgtagcaatccgccagcaaatggagggggagggcagtctggtcctggacaaggaacacctggggccgattcactgggtgcactgatcatctatccccctggcttagtaaacagttctgatgtgcactcccccgtgtgccctcggcacggctaccccaacactcacactgtggctggagactcacacgtcccagaagtaagcccacttctggatatctggactcctctccagtttggatgtggtaattagaaagtaggaaattgtcccaaagaggctggggaaggaagagtaccctgattgttccccaatctgagtgcaggtggagctgtgaccaggaaccagcatactcatttggatcttgtttctaaggtcatccttcctttacactgcatgagccaaaatgaattcgtgtgtaggactttgttacttctgtatttaactggtttattggaagtagtaggaacacactgaattttgtagttaaacacagtatctttgtcactgagatgttgtccttcaaagttttgaaaaataaacctatttagaatggtttagaagccagaactggacacctttaagatttttggcctttgattgtaatgcatactgatgattttgcagtacatgaatttgacgtgggggctttgaattcgtatttggtcctggacttttgttatttaaatagttaacatacaaataatgtaaaatcaatgtgaatataggcacctgtgtcagaatactagcaactgttacccacacaacgggcaggtttggtcacttggtgggtttcaacccaatgaccacatcaaggaggatttagcaaaggaattttataacttgtcacaagtgagaagctcacagagcttagttcccaaagcagtatctccccaagctggaggctgggtcaggttttataagcgtatggtaatgaagtgtgatctgattggatcttgcaatgaagtgatgccgggaagcaccatctgactggatcctgccatggggtggtgtcagagctcaatctgattgaatcctgcatcctgccatgtggtgtctgcttcttaattcagtccctgattcttgtttcggagcacttaggttcctgctatggttgcatgcttgattcatctggggctgctcaggttattaacatgacttgaggatccgtggcaactgtaaaacaactcataactttgctacataaaagttgaacatgattggtctggtgcaattacatacataaagatcaaaagagaccatagccttttttctcaaccagggtttcacgtttgggaaagctggcgagatcctcaccagaagactgcggtcaatggcttttaaagcaatgctaagacaggtaggagtgtgcgctggagaatgccttctgatctttcacatttcttccatattaagcttcttactgttcttattgttatgtcgatatgcatgttttccccccagggtattcacgcaaggatggggcagagtcctgcaaattgtcctggtccttcaagagctaaagacttctcatgttttttttgttttttttttgtttttgttttttttcatagaaataggctttatttgggtagctttggcttattctgtaaatatctctctccatgtagacactatcatttcgaagacctgtatctcttttctggatcctgtgcaggccctggtgagtccattgagactccaggatgtctttaaaccaagaaaaacctagttgatagcatttaatctcatgtaccacaatctaccatactaactgtaggtatcctcaaatgttaataattgagttttgtttatttcttatttgaggtctattttcacattaattcacttgtttgtttattcaaacattacttatcatgtaccagacactgtgctggtggctggtactgtataatccattatttgctctcctcgtaagttcacattctagtgcctgacataggaaaatatgcaaacatgaattatctatttttatagaaaatgcctaagagagggccagaatattatccattcaattgacaggaactgattacatttctgttcacaaatgggcacatagtaggtagtatattctgattaaatctgtctacaaatcctatttcagtatctcctaaactcttgctatgcaggaaaaattattttatgtgaaggtaaaagatgccatggatgagtagcttacaattaaaattaagtctcagacatgcttctttttttatccctgtggctaactggagatcagacacactttcaatcagtgtttaacaaaaaatcaaacaaaagcttggtgagaaaccagtgcttattttctcctgcctagaatctatcagaacaacatgtccaagacagctccaccaccctttatgagagacaacaccatatcagggcagaagtgtccatagtgaaagacctgatgattgggtgaatggaatgcctaccagcctcccagccttgggaggagctggcaaggagcatggcagccatctgggtgagccctgcccccctagaccagagatgccctccctgctaccacagagcagtcaggaagctgggttctgctagattctgggggtgtgtgctcagagcaaggccagggactctacactgcatatgaggtctcccctaaatttcctcagcattggagctttgggaggctttgtctggttttctttgcttgttttaattttgaactaacataaacgtgtattttatgccataggacatgagctggtttgatgaccataaaaacagtactggtgcactttctacaagacttgccacagatgctgcccaagtccaaggagtaggtagactgcactctacttgtagttttttacataacatggttttagataagcatgtagcatacccacacttgttaagatgcttccagctagaaatagcagaaagctcaaatcaaaactgctgtaaacaataagcagaagattaaacttcaaggttgattgacccactgccccctccagatttaatccagaatccaggttccctcattggctttggctttatcccaaggctgattccctgcagtcacaggatggctgctaatagtaattagaactacaggcttccttatttcccatccagtgaaagagagcacacacctctacctcaaccaccaaacaaaaaccctttgctgaaatctaatttgggctaatttgggtcacatgccccaccctgaaccactgtctccaggggatggtggtgttctgagtggcctacgtcccccacccctttagctgaggtgggttactttgcagctcactgcttccacacaacaggagaaggaggaatggatgcagagagctgactgcaatgttgctacagccacctttgttttctgagtggtacaacactaattcatccttatatgtgctttgtggtggatgtctcttaggacacgtaccctttgtaacaacagatggtctctttcccttttacacttttgaattaaatggtctttaaaattacccaggtacattggagttagtttcctctttgaacattgcatctatgaaaaaatacatgcacccccagtgcccatccacaaagcagagaagttgattacttggttctagaatgttggttcaggtgggcaggagaggaatgagagtgtaaaggcacaatgaagaaatgtctgcagagcctcatgagttaagcacaggtgttgtgggtttattgtaatgaaagtaagccaatgtagctcaggcatagaacccactcatcattctgaccaagaggctaaggctggagcgcatgcatttggagcttaaaactacagttgctttgtgctttttctctcccaggccacaggaaccaggttggctttaattgcacagaatatagctaaccttggaactggtattatcatatcatttatctacggttggcagttaaccctattgctattagcagttgttccaattattgctgtgtcaggaattgttgaaatgaaattgttggctggaaatgccaaaagagataaaaaagaactggaagctgctggaaaggtaggtcaaataagatttcaattggtgttaagtgttgtttttagacatgtgttttatttgaattatttatcatgatatgcaggctttaataattaaatgtttgtgcccactacaactaataattgtcaattgtgtatgaaatattttactgtattaatgtctagaacttaaatataaggtgattaacataaaacgttgagcctatagaaagcacttaacatagttatgataaagaacttctgaatattcaaagtgcatttcattttacttcatgtccaaatgctactgtttggacaaatgtcatccctgtttcacaaaccttcatgcagaagactgtaagtgaattgttcagggtcggacatgtgctggcatttaagagatcctcttctttttggctgtgatttctataattaagatggcagccaccagatggcagtaatgcctcaattttgtggttctcactataatggcaattgggcttaacatttacttgagccttactacgtgccagttattgtgctacatatttatatgcaccaatttattacatcttcacaataatcctataaggcaggcactattgttatcccaatttcagaaatacagaacctgagattcaaacagaagttagagatttggctgggatttaagttcaggtctagtttcaaagctcttacctctactatatggtctctttatatgtgtttaagtgtctaaatctacacataaacattttatttacaagtacatgcactgaaatgttcacatgtagattataaccatgaacattcttagtcttatttatgtaattattatcctttattgaaacatgaggaagtgaagcagataataaatataaattgtgatataggttttatagcattgcactttacaaagcccttttacaagcattactgcaactgaccttaactagttatgagaagtggaacagacagtatctctatagggaagaaggcgtcagagactgggtgagtgactagcttcagaggcaccatattaagagggaagattaacattcggactaaccatgtttccactaaaccaattatgtctggtgaaatcctttcttgtcctcttgtaatcagcatcagctgccgctgcatgcagcgttaggtataatagtatctccaggtttccatcagaattcactctcctcattttcacgctgcatcctctccaagacttggagcttgctaggacaatatgtggttcccaggacttgggaacccctgggtgtctagagttcttgaagattctcttggctgctggctgtgggtactttagggcatcatttccttgacttctgagtgtctcaactaactgctgaagaaacactgtgtagctctgtttcctcccctgcccctcaatcctgcttctttccacatttcatatgggagaatggtcagttggatggaatgaaaataaacttttcttagacaagttacatgatagaaaacatcttgaatctagttaatagtcttagctccattaattgttagaattttgtcagagtagagcaggtagaattgagcagtattgaaacaaaacaaaatcttgggttattagctttggtcttgctattcacagtgtgtgaggctggagaagatccccaacttctctagtcctcatgtcctaccttagtaaaatgagaaattgtaccagatactgccccaagttccttccagctaaaaccctgttattctaagcatcagagattgaataactcagactggccagtttaaatttttttagtagctactttaacctaatagggttatgaaatatgaaagattaaatatgaaatatgaaagattttaaatatgaaagattaaaaatgttttaaatgttaatatcagcagttcaatcatagtttaatattgtttactcagtcagcacttgcttaagagtcggaaagaaggttctagaaaaaccccaaatcactatttaaaaagaaacactctcatttacctgggtacagtttcatcatcattaaagtacaacagggtttgaggtattcccatcccaattttccaaaaagggcttggtagtgagggtgttggttactgggcagggagtggggagggaagactgcctcataaccatcttgacccagggcttgtctggtcactgagattaagggccctctgtgccacagctaacccgtaagggagttgatccatgactagaatgtcaagaggagtgtcaagtcattactggtttctccttgtgtaaattacacagcaggggtagcagaatagcattatggcttaggaacatggactccacatcagatagtctcagttggaattcttgctttgctacttattaactttagaacttaaggcaattcagttaacttctctgtgcctcggttctctcatctgtgtaaataggaatactatttccctttcaaggttgtgaggctaaatgagatcatattggtgaatgaggtaatacttggacatagtaaaagctcagtaatttttctctattcttgtaattgctatctgttatatctttattacaaatgaaaaatctatggttattcagtctcaagcatcacatatcttcctttcagctcattgcagaagctaagaactgaggtaaaaaaaaaagtcttaaagctgttaaaaacctaaaattaagatcttatgctccatgtgctgttggtttagatgactcaactacagaactaagatttagactaaatagctaagtcacagacaatcaacatttgtcaagggtggtttggctgtaagaatcagagaactgctctggctggtttgggtaaaagcgatttgatataaggacactccaaagtgcaagaaatacaggcagtttgtgtgtaactggctcttacagccacaggctctaatatctgagtcttcctatacatctattccattcctcggatgctgtatattcagaccagcttcttacacatacccaatgtgacatcagcctctgaagccccagggcctcacggttcaaacttgtgtccagggccaggaaaccaaatctgattgacccagattagtcagatgtctgactctgatttaatcacggatttaaagcatgctcatgttgttgacaattgggatctccttcccattgtgggtggacagcttttataagaagttatactcagggaggaaataattggcagctccaataggcccttagaaatcacagcctaatcctttcttttaggactctgccttgtgaagaaagccaggccacaaaggggttgtgactaaggccagtcatgtaactgcctggtggcaggctgggaatagaaccaggcccttggttcccaggccacagttcttgcccttagctgatcagccttcctgagcatacaaagacttgcctaccatacttagcacagccagaagtaccagttttgtcataaagctagtcttgaacagattatgcctttggtttttaatttaaaggaaattaaagcctatcaacgtaaccttcaggatacttttgacagagccctagggcttatttttcattatttcagaagtgaaaacaccacttctaatgaaggtctattctgtgttacagattgcaacagaggcaatagaaaatattaggacagttgtgtctttgacccaggaaagaaaatttgaatcaatgtatgttgaaaaattgtatggaccttacaggtaatgaaccatatgattcctgctaagaacctagtgctttcctaaggctgaattattgtcccaaaaagataataaaagctctgctgctccaaacaatgatatgactataagggtggccttttttcaacaattctgtcactgaaaataagtagctttttgatgtgactaggacacagaattatattttttacatcttatgcaaacaacaagaataggtctccaagacgtaaaagatatagagaattgcacagtctttggttatcagtgcaggcaacataaataacctatctgggtgacttaagacaaacattcctttaaggaattgctcaaacctttctttgcagtgtgtagactgaaccaaaagtgagacttgctattgggtatgttccagaggaaagtatttcatttgttctctgaatgaggaccagatccaacctactctgaagataaagaaacacagactatttcagtggtttatagttgagcaattcaagaaactcctaatggcaccatttgccactcatttccactgcagcctgattttataaatgagtatgttttaacacaaagttgaacacaacttagattacaattttgcagactggaacagtagttttgaacacttgcaaatttgaacagatatctttgaaagtctcaatttatgccatctcctcagttatgcacacttcatatgatactaaataacatgcagctacacctttgtgtccatttgttgtttgacataaaacatgtatgcaccattaatgatgacctgtttttaacttcaaggagggttaaggaagaatagaaaggtgaagctaattatgaacttggttataatttaaagattcaatagcttcacagaatgctcaagttttgtaacaccatgttcacagcacataagttaaaccatccaaattagtaatactttgaatttttccttttgccaaaaacaccctcatatttgagagtaactcaattatagttcttttggaggattcagaagccaataaagtatagcatgaagtcaaattagaaactgtacaaaataaattatatacaggggcggctggcaggatctagcttgggaaaggacttctggtgtatatctatgtaaacttcagggactcaacttttgtgaatctgaaacatgaattttaacctaacagagtacaattagttacaggaaacaacataatagtagtaaatcacattcagataattcaaacttaaattcagatcctgacattttaggtatttttgaaacaacaactatgcttaataggagttgaacattggagtcatcagatattaatatgtaataatatcagttatcatttgaggaaccactatgaactaggcactgtgctagacatttatatggtttttgtcaaaacaattctgcattacagtgattatttccatggtataaatgtttagagaagttatcatttacccaaactaatataactggaggtggaacttaaacccactcggccagacttagaagccgtgctctttccactacacagcgctaaaggaggctgaagagatggttacaagtatactgatttgcttttcaggaattctgtgcagaaggcacacatctatggaattacttttagtatctcacaagcatttatgtatttttcctatgccggttgttttcgatttggtgcatatctcattgtgaatggacatatgcgcttcagagatgttattctgtaagtagctttagaaatattaagattattctataataaggttttagtaggtttatgcaaaagtttagagtaggaaaaaaatgactcctgtgtccaaagatgaggtcagggatttaaatttaccacagtttccatcctggcaggcacagagatctgatcttgttaatactccaagtgcagtttcattttgcgggctacaattaagcttatgaaaatgatcagaaagcacagttttagttgtacatatgatcctggtcaggatgatgcaaattttctcattatagaatataggcagaaaaaatcataattagaaagttgctggtgaccatggactcaaaacagggttatatagcttactattatctacaaccaaaacatggcctggaaaacaagatgggaatacttgttggaagtctggcaaaggcactctctccctaaccaggcctgagatgagacagccctgccaacatttgcctctcagcctctcctttttccttggtttccaaggcaaactactggtctttctgtttgatgccttctttcataatgtgctcagcacattccattaggttgcaatctgggcttgaaagagggaagcaactctttttaagatcatttggtatgtttctgctctggtgggatgattttaaagcagtggtgaacagccatttttgaaacagggtcaagacaaaaaagcgaaagtgtgttaagagctgggttttttttttcatccaaaattaaaattaccatgaaaaaatgtatctatataatctttgtatcaggatcccagcaggaaacaaatggcacagcaaatgggttaattgatgagtttgctaaagggtctatttacaaaggcctggaaagtgttaaggtaagcagtacccaagaaggaagttaacaccccagcaatacccagctggaaactgctaccaccctaagcctaaaggcaagagaagggaaagatagccagaactcagcataggtgctttctgtggtctttgatggagggacagcaactgcacaagcaatctgacaagaaagaagccaaagaaacaaataccttggcctcactcccttccagcctccctatcctctgctgtgccttccattggccaaatcctatgaaaccagaggacaagaaaaccttttgattcagttcatgatagttggaatccccagacatggagtagggggatagaaggtagagatgggtaaaaagtgaggagtgattttgggggacaaatggaactagcagctggggattacaacttagagtacaactatttattgtataaaaaatattgagaacatttctgaaagtgaaaaccgttggaaagtcacattattcctgcttcctttcttttttaaaatcattgaaatgttaaattatggaaacctagaagacagctttaggcagtacagggaagctatgcagccacatgtgggttgttcatcactattttaaaacttagtttttggcaactcaccttttcgtcaagcatttaaaggaaagttttactatacctctcatcccagcccctaggtattaaaacccatttttaatatcttagctttagaaatttgaaggtgaaaacttaaagttctccattattagtagagaactcccactcctttctctggggtagtgctggtatcagaagtaaattgctttgtgaagttgtagatctcaggatctttagcccttcctaaaagttgtcataatcaatatccatctttaaagagcatataattagaaaatagaactttagtttaaggtgacttttttttccagagtgctgtcaatagttattttaacttttattttaggttcaggggtacatatgcatgttcgttaatacaggcaaactcatgtcatgggggtttggtgtacagaccatgtcatcacccagatactaagcataataactgatagcatagttattttaattgtaaataaaaagctatttctagtaaaagcttattttccctaataaaaattatttacagtgatgatgattatcatttgtgtggtagtacagaagaaaccacaaactggaagtcagggccagagctttatcagaaaaagcttacttggaactgatcaaggcccttacacactttgtgcttcaattccctcaactctaaaaagagtataaccagcaactaaaattagctgagctcacagatcagattcagttataagcctcttcttgaaagtaaaaacctttgggaagtcacagtagtcctaagaaattaggggctactatgcaaagggaagtcagaaagcaagtcgagaaaaggtaaaccctcaggaagtggatcttgcccctctcctagatttctcttgttactagaattttatgaaaatgtatgtcggggagaaaggggatgattaaggagtaaagggaaaaaatactggtaagcactatacctttagactttcaaacatcatggagttaattataaaagctaatttttgaattcctctacttctgtctagggtgttttctgcaattgtatttggtgcagtggctctaggacatgccagttcatttgctccagactatgctaaagctaagctgtctgcagcccacttattcatgctgtttgaaagacaacctctgattgacagctacagtgaagaggggctgaagcctgtaagttctctgatgcctgatgatgcttgatcaatttttccctaaggtttgctgtctgctagattatagctacaggataagtttgtgatgattacaccaacatgtgtttcatttaatttgtaatatttatatagctaatatttgggcaacttgactgacatttaaaaattttataggtggtttcaaggatcctgaagtttagcacatcaaaataaaaaaaaaagggaaaaccagatatattagaactgaatagtttccacaaaaatttagtcatttctacataaaggtataattctgccatgttaatgcaattagtaatttgactttaatcactttttataatagttaagatgtaattggtaagaagggcagttcgttcacaatgagagtaataatcctgtgctttattatctataaaggtaacttaaactcacatctgagtgttctttgtatgacacaagatgctacacgttgtaatatacaagcagctgtgtaggtaaagaggctaggacttaacacagtctttccaggactttcccaggtatttcatgttctgataaaattgctgtgcccagtgagtgagataaagaaagtgaacttaagaaactgccagggtttgccatcagggctgcccactgaaactttgggtagaaactgttgctaaatttccaagcctttagagtcttttggacactggcttgattccagcttcagaataagcagttgggaaagctaaatgaatatcttaaagaaatcagaaactaagttagataacaactcatggtaatgactttttgtctaatctcacctatacccctatctctcaccttcatttcacaccataataacttgctatcaatattaactggcaccagaactataccaaatatgaattttatgtttctctactacagtctttggtaaagtttccttgaaataatatttcttattccaataattatcaggccaattataatagcaacatttaaacatttattcaggataaatttgaaggaaatataacatttaatgaagtcgtgttcaactatcccacccgagcaaacgtgccagtgcttcaggggctgagcctggaggtgaagaaaggccagacactagccctggtgggcagcagtggctgtgggaagagcacggtggtccagctcctggagcggttctacgaccccttggcggggacagtggtgagcacatttccttataacttgattgaaggctatattttaattggcccaaccaatattgtcataatggaaaatattggacaaatgtagacctagaatcctgtttgatacaatgaccacattctataaaccccaactggcaccatatctgggaaatatatggggacaataggacagaatgtctggaattcagtctagctcagaaaatactgaatataagtttaatttttaccctgtcatgggcctttccagtcagtctgattgttctaagcaaatactgacttactggcttataaaggtgaactacagactcctgcccaaattcaaagctgacttccaaaacagggtgctacctgcttattgcctccccaccgctttcagttttgctgccttctcttaccttgaattctcggctctcgaactttgactttgatcctcaacctccagccctttcatatttggcttttgtcattgattttctagcatgtagccccgtggctctcttccttgagtgaagaccaactcttactgataatgcttgtatctgccataaccttgggacagcacccatgacagagccctgggagcctgtccccattagacagtcaccaaagtgttaagccttgtttcttttattaatagttgttaagcctaaatcagccttgttaagcctaatttagttgtttctctctggaaatcttctgctttgctattatagctattctgcaggtaacataggcaaaccagctcaccaaaactctgtaaatatggtgtgctgatacgatggtgggaatttttttctttattgagatcaagactagctggacttgtgtctattcctttgcctgtaagctttaccttacacgaggctgtattttcaagtacatattacaacacttccctaggagcaccatgcctcctgcctatagcaagtaaaacaaaaacaaaaccatcactgccagcaaaaataatcctcccaaagacactgccctttgtaacttgttccttttccatgggattcttgtccttagtgctatcagagaggtgagggaaagttaaggctagtagttttcagggaaaagagaggtagaggtaggaccagagtcaaccagcttttggggccctgcttctgatcagctttttcactgctgtgcatgggggaaggggaaatcaagtcaaggtgaagggttaggattattctggggacagcagacctgagtgggacaccttgatgcaggcttctttaacgcagagtaggacacagatggctggaggagggcagacaaggacaaagagaagtgtgaaaaaagagggtcaaatgtgctaccattttgccagttagaccaagatagggatggcttaatcaccataaaaatcatcatgttggccatgctggcctcaatggtataagtcttggagggttgttgttttgaagctgctgacaccctcatgcaacgatcctccaaatggacaatctagtaactttttagtttttttttcttttttatacccttcttatagtttgtggactttggttttcagcttctcgatggtcaagaagcaaagaaactcaatgtccagtggctcagagctcaactcggaatcgtgtctcaggagcctatcctatttgactgcagcattgccgagaatattgcctatggagacaacagccgggttgtatcacaggatgaaattgtgagtgcagccaaagctgccaacatacatcctttcatcgagacgttaccccacgtaagttaaagagtagctgaaatcagaagagactactttttatcccccaaacaattaccaaagttatgccaacaaaatcttgtaacaaaatatgttgatttactaacattaacaacttggacaaggcacttcaggataccaagcttccttatttgtaaatgggaatacattatgcctacctcatacaaatgtagtgagaagctcaaaaccaccatacttcaggttacagactggtggttgagggctgcatttagactgcagtcatgtttggtttagccctatggtacttttaaaacaattatagtttttattttgagataattatggatttacatgtaattgtaaggaatacagagatcttatgtaccctttacctagtttctgccaatgacaatatcttgcaaaactagtatacagtatcacaagcaggatactgatattgatacactccactcatcttattcagacttcccttgttttacttgcattcatttgcatatggatttagttctgtgcagctgtattgcagatggggattcatagatccactaattaagaacactggccaggcacggtggctcacacctgtaatctcagcactttgggaggccaaggtgggtggattacgaggtcaggagattgagaccatcctggccaacatggtgaaaccctgtctctactaaaaacacaaaaatcaaccaggcgtcgtggtgggcacctgtagttgcagctactcaggaggctgaggcgggagaatcgcctgaacctgagaaacggaggttaaagtgatccaagatcacaccattgcactccagcctgggcgacagagtgagactccgtctcaaaaaaaaaaaaaaaaagatacagaacattctcatctccataaagatccctcatattgcccttttagagccatgcatatatcccttcctcccaccctcattcctctcaaactctggcaaacatgaatctgttctccgtttgtataattttatattttaaaaatgttttataaaaatatatacagtatgtaaacttttgggattaacttttgtctttcagctaattccctgaagttgtgtgtattcataggcattgctttttattactgagtgatattccacagtgtggatgtaccacagtttaaccattcacctgttgaaggatagctgggttatttcctgtttctggctattgcaaataaagctgctgtaaatacttgtatacaggtttctgtatgaattcaagtttttatttctttgggataaacacccaggagtagaattgtggagcagtatggcaatttcatgtttagtttataagccactgctaaactgttttccagagtggccatcccattttacattcctaccagcaatgtgtaagtgatgtagtttctctgaatctttgccagcatttactgttgtcattagtttttatttttaccactctgataagagtgtagtgatacatcactgtggctttaatatgcatttcccaatggcaaatgatgttgaacatagttttttatatgcttatttaccatctatatatcctcttggtgaaatgtctccatgttgtttgcccatattctaattggatttttatcttttactgctgagttttcagaagttttttttgtttgtttgtttaacatattgtaattactgttggatatgtagtttgtaaatgttttctcccagtctgtagcttgtttattcatcctataagaaggtctttgcagagcaaaagttttacttttgatgaggtccaatttaccaattcttccttttatggattatgctttcagtgtcaagtctaagaactcgttgcctagccctaggcccaaaatattttctccatgtttttttctaaaagttttatagctttacattttaaatttcagtccatgatccatttttagttcactttaaacatgtgtagccctggaaggatggcttgaggtccctaaaagtgatggtagggacaattcattttatggcattcttccagcattcggggttccactgggttacactgacgtagagcttaattatttttgcttttattttctgctatagttagaaatcactcacacccacaaataaaattttaaaaccctttcattttggttagccttaccaacctttaatgcacattgacctgaatcaaatattggatttgactgtgaatagaaaaatttacagcttcagctcttaatataagtgaccactggaccttaggaaattaattcacatgatatacatcactgcataagccctgcaaactgaactgactcaatttacatctctattcatatgctctttctcagcctagaatgctctctcaaaatctagctccccaaacttctctaaaaagatttctttcatttatttccccttttttctccttctaccctgtctccataacaacttctatctccttcttctgatctttcatagtgtgctgtgtatactactacagtcctgtgttacataacaacattttggtcaatgacagactgcgtataccacagtggttcccataagattataatggaactgaaaaattcctattgcctagtgacatagctgtcataatatcatagtgcaacacaaaattcaagtatttgtggtgatgctggcataacaaagcgactgcactgccagttgtataagagtatagcacatactactatgtacagtgcataatacttgataatgacaacaaatgacttattgattcatatatccgttatagcatttgttattttagagtatcctcctcctattttaaagaaagttaattataagatagcctattgtagaataccattgagaattaaagtcactagttttctagtttgattttgaaaataaacactctgttaagttgaaacaacgttatagaaactgttattgactctaaatgtttttcttgtaaatagaactgtcaactgttaagcaacagttcattcaacatatttataatttggttaacttgcagaaatatgaaacaagagtgggagataaggggactcagctctcaggaggtcaaaaacagaggattgctattgcccgagccctcatcagacaacctcaaatcctcctgttggatgaagctacatcagctctggatactgaaagtgaaaaggtgtgtgtggcctcccaacttatgtcttatttaatttatgaaatagaagggattttgctgtcaaccatgaaaaaaacacacacaagcacagggggaaaaacacagaacgttagatagtggtttttatttttatttttttgagacggggtctcgttgttgcctaggctgtagtgcagtggcgcaatccagctcactgcaacctctgcctccagggttcaagcgattctcttgcctcaacctcctgagtagctgggactacaggtgcctgccactatgcccagctaatttttgtatttttagtagagacagggtttcattatgttggccaggctggtctcgaatcctgaccttgtgatccgcctgcctcggcctcccaaagtgctgggattacaggcgtgagccaccttgcccggctgatagtggttattttgaagtaatggaatattttattctaaattttctaaaatgattatatattttataaagtaaagcattcaaaagaaaaaagctgcacaaattacatttttagcacattaggaatgaaaaactggaaaatactcaaaagggaactagttaaacagaagattagaaaatttaaatacttatgaatttttttacagcatgggaacccatttgtgttatatttaaaaagcagaacataactatgtagattaaatgttgattatacaaaatacacatgcataaagttcaaagattctaagatactagaaattaaaagttgattagaaaggtaacattttcaaatttacttgaatgttaaaactaatttatacaatttttgggataaggtgtctgtctgatttatcaataggttgtccaagaagccctggacaaagccagagaaggccgcacctgcattgtgattgctcaccgcctgtccaccatccagaatgcagacttaatagtggtgtttcagaatgggagagtcaaggagcatggcacgcatcagcagctgctggcacagaaaggcatctatttttcaatggtcagtgtccaggctgggacacagaacttatgaacttttgctacagtatattttaaaaataaattcaaattattctaccattttatctgacttgtaaaataagtttctggtttgtcatcataaaacataggtatgtctgtctcattctagatcaatttagaagacccaatttggggtttattacggcatttgaaatttgagagttagaagtgacacctgtcttgatgaagtattgaaacaacaggctagctctccctaagttattagaaacatccagaaaaagaacaaaattcaaggtaagtacaggtgtagaaatatagaagccacagacatagggaaatggtcttatggtcctgaatgggttgggtagacaggaaagtttgggaataattttcccaagtacaaaagaaaaataaattgttcaatagcctc

(The sequence listing continues in the following parts.)

What is claimed is:

1. A method of treating a disease or condition characterized by a deficiency in an amount or function of a target protein in a subject in need thereof by modulating expression of a target protein in a cell of the subject, the method comprising:

contacting the cell of the subject with a therapeutic agent that binds to a targeted portion of a pre-mRNA that comprises a nonsense-mediated mRNA decay-inducing exon (NMD exon) and that encodes the target protein, wherein the therapeutic agent promotes exclusion of the NMD exon from the pre-mRNA in the cell, thereby increasing a level of processed mRNA encoding the target protein and increasing an expression of the target protein in the cell of the subject, wherein the therapeutic agent comprises an antisense oligomer (ASO) comprising a sequence of from 8 to 50 nucleobases that hybridizes to the targeted portion of the pre-mRNA, wherein the target protein is SYNGAP1 protein, and wherein the targeted portion of the pre-mRNA to which the ASO hybridizes:

(a) is within the NMD exon;

(b) is within an intron sequence flanking the NMD exon; or (c) comprises a 5' NMD exon-intron junction of the NMD exon or a 3' NMD exon-intron junction of the NMD exon, wherein the NMD exon is defined by the pair of genomic coordinates GRCh38/hg38: chr6 33448789 to 33448868.

2. The method of claim 1, wherein the therapeutic agent interferes with binding of a factor involved in splicing of the NMD exon to a region of the targeted portion of the pre-mRNA.

3. The method of claim 1, wherein the targeted portion at least partially overlaps with the NMD exon.

4. The method of claim 1, wherein the targeted portion comprises a 5' NMD exon-intron junction or 3' NMD exon-intron junction.

5. The method of claim 1, wherein the targeted portion is within the NMD exon.

6. The method of claim 1, wherein the pre-mRNA encoding the target protein comprises a sequence with at least 90% sequence identity to a sequence of SEQ ID NO: 189.

7. The method of claim 1, wherein the antisense oligomer comprises a sequence complementary to at least 8 contiguous nucleobases of a sequence of SEQ ID NO: 189.

8. The method of claim 1, wherein the antisense oligomer is complementary to a sequence of SEQ ID NO: 189.

9. The method of claim 1, wherein the antisense oligomer comprises a backbone modification comprising a phosphorothioate linkage or a phosphorodiamidate linkage.

10. The method of claim 1, wherein the antisense oligomer comprises a phosphorodiamidate morpholino, a locked nucleic acid, a peptide nucleic acid, a 2'-O-methyl, a 2'-Fluoro, or a 2'-O-methoxyethyl moiety.

11. The method of claim 1, wherein the antisense oligomer comprises at least one modified sugar moiety.

12. The method of claim 1, wherein the target protein produced is a full-length protein or a wild-type protein.

13. The method of claim 1, wherein the therapeutic agent increases the level of a processed mRNA that lacks the NMD exon and encodes the target protein in the cell.

14. The method of claim 1, wherein the therapeutic agent increases the expression of the target protein in the cell.

15. The method of claim 1, wherein the disease or condition is associated with a loss-of-function mutation in the target protein.

16. The method of claim 1, wherein the disease or condition is associated with haploinsufficiency of a gene encoding the target protein, and wherein the subject has a first allele encoding a functional target protein, and a second allele from which the target protein is not produced or produced at a reduced level, or a second allele encoding a nonfunctional target protein or a partially functional target protein.

17. The method of claim 1, wherein the disease or condition is associated with an autosomal recessive mutation of a gene encoding the target protein, wherein the subject has a first allele encoding from which:

(i) the target protein is not produced or produced at a reduced level compared to a wild-type allele; or (ii) the target protein produced is nonfunctional or partially functional compared to a wild-type allele, and a second allele from which:

(iii) the target protein is produced at a reduced level compared to a wild-type allele and the target protein produced is at least partially functional compared to a wild-type allele; or (iv) the target protein produced is partially functional compared to a wild-type allele.

18. The method of claim 1, wherein the subject is a human.

19. The method of claim 1, wherein the disease or condition is Mental retardation, autosomal dominant 5.

20. The method of claim 1, wherein the targeted portion of the pre-mRNA to which the ASO hybridizes is at most about 200 nucleotides upstream from GRCh38/hg38: chr6 33448789.

21. The method of claim 1, wherein the targeted portion of the pre-mRNA to which the ASO hybridizes is at most about 200 nucleotides downstream from GRCh38/hg38: chr6 33448868.

22. A method of modulating expression of a target protein by a cell having an pre-mRNA that comprises a nonsense-mediated RNA decay-inducing exon (NMD exon) and that encodes the target protein, the method comprising contacting a therapeutic agent to the cell, wherein the therapeutic agent comprises an antisense oligomer (ASO), wherein the therapeutic agent promotes exclusion of the NMD exon from the pre-mRNA, thereby increasing a level of processed mRNA encoding the target protein and increasing an expression of the target protein in the cell, wherein the target protein is SYNGAP1 protein, and wherein the targeted portion of the pre-mRNA:

(a) is within the NMD exon;

(b) is within an intron sequence flanking the NMD exon; or (c) comprises a 5' NMD exon-intron junction of the NMD exon or a 3' NMD exon-intron junction of the NMD exon, wherein the NMD exon is defined by the pair of genomic coordinates GRCh38/hg38: chr6 33448789 to 33448868.

* * * * *